United States Patent
Doucette-Stamm et al.

(10) Patent No.: US 6,583,275 B1
(45) Date of Patent: Jun. 24, 2003

(54) **NUCLEIC ACID SEQUENCES AND EXPRESSION SYSTEM RELATING TO *ENTEROCOCCUS FAECIUM* FOR DIAGNOSTICS AND THERAPEUTICS**

(75) Inventors: Lynn A. Doucette-Stamm, Framingham, MA (US); David Bush, Somerville, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/107,532

(22) Filed: Jun. 30, 1998

Related U.S. Application Data

(60) Provisional application No. 60/085,598, filed on May 14, 1998, and provisional application No. 60/051,571, filed on Jul. 2, 1997.

(51) Int. Cl.[7] .......................... C07H 21/00; C12Q 1/68; C12N 15/00; C12N 1/00; C12N 5/00
(52) U.S. Cl. .......................... 536/23.1; 435/6; 435/243; 435/320.1; 435/325; 536/24.3; 536/24.32
(58) Field of Search ............................. 435/243, 320.1, 435/325, 6; 514/44; 536/23.1, 24.3, 32

(56) References Cited

U.S. PATENT DOCUMENTS 5,589,168 A    12/1996    Allen et al. ................. 424/93.4

FOREIGN PATENT DOCUMENTS

WO    9520658    8/1995

OTHER PUBLICATIONS

Genbank Accession No. M226630 (Apr. 26, 1993).*
Genbank Accession No. Q03568 (Aug. 2, 1990).*
Genbank Accession No. U13165 (Feb. 14, 1995).*
Genbank Accession No. Y09570 (Dec. 5, 1996).*
Genbank Accession No. U30472 (Nov. 21, 1996).*
Genbank Accession No. T05868 (Aug. 14, 1996).*
Genbank Accession No. L32090 (Oct. 8, 1994).*
Genbank Accession No. Q87587 (Dec. 19, 1995).*
Genbank Accession No. L78824 (Jun. 15, 1996).*
Genbank Accession No. U70214 (Sep. 21, 1996).*
1990 Sigma Catalog [Published by the Sigma Chemical Company, P.O. Box 14508, St. Louis, Missouri 63178, USA] pp. 776–778.*
Atlwood, Science, vol. 290, pp 471–473, 2000.*
Wella et al., Journal of Leukocyte Biology, vol. 61, No. 5, pp. 545–550, 1997.*
Russell et al., Journal of Molecular Biology, vol. 244, pp. 332–350, 1994.*
Gerhold et al., BioEssays, vol. 18, No. 12, pp. 973–981, 1996.*
Arthur et al., *Genetics and Mechanisms of Glycopeptide Resistance in Enterococci*, Antimicrobial Agents and Chemotherapy, p. 1563–1571, Aug., 1993.
Saha et al., *Occurrence and Mechanisms of Glycopeptide Resistance in Gram–Positive Cocci*, Infectious Agents and Disease, 1:310–318, 1993.
Leclercq et al., *Resistance of Enterococci to Aminoglycosides and Glycopeptides*, Clinical Infectious Diseases, 15:495–501, 1992.

* cited by examiner

*Primary Examiner*—Ardin H. Marschel
(74) *Attorney, Agent, or Firm*—Genome Therapeutics Corporation

(57) ABSTRACT

The invention provides isolated polypeptide and nucleic acid sequences derived *Enterococcus faecium* that are useful in diagnosis and therapy of pathological conditions; antibodies against the polypeptides; and methods for the production of the polypeptides. The invention also provides methods for the detection, prevention and treatment of pathological conditions resulting from bacterial infection.

34 Claims, No Drawings

US 6,583,275 B1

NUCLEIC ACID SEQUENCES AND EXPRESSION SYSTEM RELATING TO *ENTEROCOCCUS FAECIUM* FOR DIAGNOSTICS AND THERAPEUTICS

This application claims priority of U.S. provisional applications No. 60/051,571, filed Jul. 2, 1997; and No. 60/085,598 filed May 14, 1998, all of which are hereby incorporated herein by reference in their entirety.

FIELD OF THE INVENTION

The invention relates to isolated nucleic acids and polypeptides derived from *Enterococcus faecium* that are useful as molecular targets for diagnostics, prophylaxis, and treatment of pathological conditions, as well as materials and methods for the diagnosis, prevention, and amelioration of pathological conditions resulting from bacterial infection.

BRIEF DESCRIPTION OF THE SEQUENCE LISTING

Incorporated herein by reference in its entirety is a Sequence Listing, comprising SEQ ID NO: 1 to SEQ ID NO: 7310. The Sequence Listing is contained on a CD-ROM, three copies of which are filed, the Sequence Listing being in a computer-readable ASCII file named "GTC-012 sub seq.pto", created on Jul. 13, 2001 and of 14,112 kilobytes in size, in Windows NT 4.0 format.

BACKGROUND OF THE INVENTION

*Enterococcus faecium* is a Gram-positive, nonmotile, nonpigmented cocci, that is widely distributed in nature, animals, and humans. Enterococci are part of the normal gastrointestinal and genital tract flora, and among the 17 known species, *E. faecium* is one of the most prominent in humans, with the highest levels of multidrug resistance (A. Kaufhold and R. Klein (1995) Zentralblatt fuer Bakteriologie 282 507). Pathogenic *E. faecium* infections include urinary tract infections (UTI), bacteremia, endocarditis, and wound and abdominal-pelvic infections.

Vancomycin resistant Enterococci (VRE) have emerged in the midst of high level resistance to penicillin and aminoglycosides (Centers for Disease Control and Prevention, 1993 *MMWR* 42:597; and S. Handwerger et al., 1993, *Clin Infect Dis* 16:750). VRE are characterized by resistance to virtually all available antibiotics, including vancomycin which is considered the "last resort" antibiotic effective against gram-positive bacteria. Treatment options for physicians are limited, with the latest strategy being combinations of antimicrobials or the use of new unproven compounds (R. C. Moellering, Jr.,1991, *J Antimicrob Chemother* 28:1; and M. K. Hayden et al., 1994,*Antimicrob Agents Chemother* 38:1225; and N. Mobarakai et al., 1994, *J Antimicrob Chemother* 33:319). From 1989 through 1993, the percentage of nosocomial (hospital incurred) infections by VRE increased from 0.3% to 7.9% (Centers for Disease Control and Prevention, 1993, *MMWR* 42:597). There was a 34-fold increase in Intensive Care Unit (ICU) patients, and an increasing trend among non-ICU patients (Centers for Disease Control and Prevention, 1993, *MMWR* 42:597). These numbers may not be an accurate reflection of the actual total, as clinical identification of vancomycin resistance is not consistently detected, especially in the VanB phenotype which confers moderate resistance (F. C. Tenover, 1993, *J Clin Microbiol* 31:1695; and D F Sahm, 1990, *Antimicrob Agents Chemother* 34: 1846; and R J Zabransky, 1994 *Microbiol Infect Dis* 20:113). Patients can be colonized and carry VRE without symptoms, with chief areas of colonization being anus, axilla, stool, perineal, umbilicus, wounds, foley catheters, and colostomy sites.

Epidemiology of *E. faecium* is not completely understood, but it is thought that most infections and colonizations are a result of the patient's endogenous flora (B E Murray, 1990, *Clin Microbiol Rev* 3:46). Recent evidence suggests that *E. faecium* can be spread by direct contact with other infected patients, indirect transmission from hospital personnel (J M Boyce et al., 1 994, *J Clin Microbiol* 32:1148-; and E. Rhineheart et al., 1990, *N Engl J Med* 323:1814), or from contaminated hospital surfaces and equipment (L V Karanfil et al., 1992, *Infect Control Hosp Epidemiol* 13:195; and J M Boyce et al., 1994, *J Clin Microbiol* 32:1148; and L L Livornese Jr., 1992, *Ann Intern Med* 117:112). Increased risk for the critically ill, those with underlying disease or immunosuppression i.e. ICU, oncology, and transplant patients, cardio-thoracic/intraabdominal surgical patients and those with urinary or central venous catheters, has been demonstrated. In addition, risk for; *E. faecium* infection increases for patients with long hospital stays or previous multiantimicrobial or vancomycin treatments (J. M. Boyce et al., 1994, *J Clin Microbiol* 32:1148; Boyle, J. F. et al., 1993,*J Clin Microbiol* 31:1280; L V Karanfil et al., 1992, *Infect Control Hosp Epidemiol* 13:195; S. Handwerger et al., 1993, *Clin Infect Dis* 16:750; Montecalvo, M. A. et al., 1994, *Antimicrob Agents Chemother* 38:1363–1367).

Additional concern stems from the ability of the *E. faecium* plasmid borne VanA gene, which confers high level vancomycin resistance, to transfer in vitro to several gram positive microorganisms such as *Staphylococcus aureus* (Leclercq, R. et al., 1989, *Antimicrob Agents Chemother* 33:10; and Noble, W. C., et al., 1992, *FEMS Microbiology Letters* 72:195). To date, no clinical isolates of *S. aureus* or *S. epidermidis* have shown vancomycin resistance conferred by plasmid transfer, but clinically isolated strains of *S. haemolyticus* have shown vancomycin resistance (Degner, J. E. et al., 1994, *J Clin Microbiol* 32:2260; and Veach, L. A. et al., 1990, *J Clin Microbiol* 28:2064).

These concerns point to the need for diagnostic tools and therapeutics aimed at proper identification of *E. Faecium* strains and the eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting, treating, and preventing bacterial infection, in particular *E. Faecium* infection.

The present invention encompasses isolated polypeptides and nucleic acids derived from *E. faecium* that are useful as reagents for diagnosis of bacterial infection, components of effective antibacterial vaccines, and/or as targets for antibacterial drugs, including anti-*E. faecium* drugs. The nucleic acids and peptides of the present invention also have utility for diagnostics and therapeutics for *E. faecium* and other Enterococcus species. They can also be used to detect the presence of *E. faecium* and other Enterococcus species in a sample; and in screening compounds for the, ability to interfere with the *E. faecium* life cycle or to inhibit *E. faecium* infection. More specifically, this invention features compositions of nucleic acids corresponding to entire coding sequences of *E. faecium* proteins, including surface or secreted proteins or parts thereof, nucleic acids capable of binding mRNA from *E. faecium* proteins to block protein translation, and methods for producing *E. faecium* proteins or parts thereof using peptide synthesis and recombinant DNA techniques. This invention also features antibodies and nucleic acids useful as probes to detect *E. faecium* infection. In addition, vaccine compositions and methods for the protection or treatment of infection by *E. faecium* are within the scope of this invention.

The nucleotide sequences provided in SEQ ID NO: 1–SEQ ID NO: 3654, a fragment thereof, or a nucleotide sequence at least 99.5% identical to a sequence contained within SEQ ID NO: 1–SEQ ID NO: 3654 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 3654, a fragment thereof, or a nucleotide sequence at least 99.5% identical to a sequence contained within SEQ ID NO: 1–SEQ ID NO: 3654. Uses for and methods for providing nucleotide sequences in a variety of media is well known in the art (see e.g., EPO Publication No. EP 0 756 006)

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures,are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 3654, a fragment thereof, or a nucleotide sequence at least 99.5% identical to SEQ ID NO: 1–SEQ ID NO: 3654 in computer readable form, a person skilled in the art can routinely access the sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information).

Computer algorithms enable the identification of *E. faecium* open reading frames (ORFs) within SEQ ID NO: 1–SEQ ID NO: 3654 which contain homology to ORFs or proteins from other organisms. Examples of such similarity-search algorithms include the BLAST [Altschul et al., J. Mol. Biol. 215:403–410(1990)] and Smith-Waterman [Smith and Waterman (1981) Advances in Applied Mathematics, 2:482–489] search algorithms. These algorithms are utilized on computer systems as exemplified below. The ORFs so identified represent protein encoding fragments within the *E. faecium* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *E. faecium* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *E. faecium* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator, BLASTN2, BLASTP2 and BLASTX2 (NCBI) and Motifs (GCG). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the E. faecium genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the E. faecium genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the E. faecium genome. In the present examples, implementing software which implement the BLASTP2 and bic_SW algorithms (Altschul et al., J Mol. Biol. 215:403–410 (1990); Compugen Biocellerator) was used to identify open reading frames within the E. faecium genome. A person skilled in the art can readily recognize that any one of the publicly available homology search programs can be used as the search means for the computer-based systems of the present invention.

The invention features E. faecium polypeptides, preferably a substantially pure preparation of an E. faecium polypeptide, or a recombinant E. faecium polypeptide. In preferred embodiments: the polypeptide has biological activity; the polypeptide has an amino acid sequence at least 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least 5, 10, 20, 50, 100, or 150 amino acid residues in length; the polypeptide includes at least 5, preferably at least 10, more preferably at least 20, more preferably at least 50, 100, or 150 contiguous amino acid residues of the invention contained in the Sequence Listing. In yet another preferred embodiment, the amino acid sequence which differs in sequence identity by about 7% to about 8% from the E. faecium amino acid sequences of the invention contained in the Sequence Listing is also encompassed by the invention.

In preferred embodiments: the E. faecium polypeptide is encoded by a nucleic acid of the invention contained in the Sequence Listing, or by a nucleic acid having at least 60%, 70%, 80%, 90%, 95%, 98%, or 99% homology with a nucleic acid of the invention contained in the Sequence Listing.

In a preferred embodiment, the subject E. faecium polypeptide differs in amino acid sequence at 1, 2, 3, 5, 10 or more residues from a sequence of the invention contained in the Sequence Listing. The differences, however, are such that the E. faecium polypeptide exhibits an E. faecium biological activity, e.g., the E. faecium polypeptide retains a biological activity of a naturally occurring E. faecium enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the E. faecium polypeptide is a recombinant fusion protein having a first E. faecium polypeptide portion and a second polypeptide portion, e.g., a second polypeptide portion having an amino acid sequence unrelated to E. faecium. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded E. faecium polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the E. faecium encoded polypeptide exhibits a E. faecium biological activity, e.g., the encoded E. faecium enzyme retains a biological activity of a naturally occurring E. faecium.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The E. faecium strain, Mu, from which genomic sequences have been sequenced, has been deposited on Jun. 26, 1997 in the American Type Culture Collection and assigned the ATCC designation # 55985.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to E. faecium polypeptides, especially by antisera to an active site or binding domain of E. faecium polypeptide. The invention also includes fragments, preferably biologically active fragments. These and other polypeptides are also referred to herein as E. faecium polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *E. faecium* nucleic acid will include a transcriptional regulatory sequence, e.g. at least one of a transcriptional promoter or transcriptional enhancer sequence, operably linked to the *E. faecium* gene sequence, e.g., to render the *E. Faecium* gene sequence suitable for expression in a recombinant host cell.

In yet a further preferred embodiment, the nucleic acid which encodes an *E. faecium* polypeptide of the invention, hybridizes under stringent conditions to a nucleic acid probe corresponding to at least 8 consecutive nucleotides of the invention contained in the Sequence Listing; more preferably to at least 12 consecutive nucleotides of the invention contained in the Sequence Listing; more preferably to at least 20 consecutive nucleotides of the invention contained in the Sequence Listing; more preferably to at least 40 consecutive nucleotides of the invention contained in the Sequence Listing.

In another aspect, the invention provides a substantially pure nucleic acid having a nucleotide sequence which encodes an *E. faecium* polypeptide. In preferred embodiments: the encoded polypeptide has biological activity; the encoded polypeptide has an amino acid sequence at least 60%, 70%, 80%, 90%, 95%, 98%, or 99% homologous to an amino acid sequence of the invention contained in the Sequence Listing; the encoded polypeptide has an amino acid sequence essentially the, same as an amino acid sequence of the invention contained in the Sequence Listing; the encoded polypeptide is at least 5, 10, 20, 50, 100, or 150 amino acids in length; the encoded,polypeptide comprises at least 5, preferably at least 10, more preferably at least 20, more preferably at least 50, 100, or 150 contiguous amino acids of the invention contained in the Sequence Listing.

In another aspect, the invention encompasses: a vector including a nucleic acid which encodes an *E. faecium* polypeptide or an *E. faecium* polypeptide variant as described herein; a host cell transfected with the vector, and a method of producing a recombinant *E. faecium* polypeptide or *E. faecium* polypeptide variant; including culturing the cell, e.g., in a cell culture medium, and isolating an *E. faecium* or *E. faecium* polypeptide variant, e.g., from the cell or from the cell culture medium.

In another series of embodiments, the invention provides isolated nucleic acids comprising sequences at least about 8 nucleotides in length, more preferably at least about 12 nucleotides in length, and most preferably at least about 15–20 nucleotides in length, that correspond to a subsequence of any one of SEQ ID NO: 1–SEQ ID NO: 3654 or complements thereof. Alternatively, the nucleic acids comprise sequences contained within any ORF (open reading frame), including a complete protein-coding sequence, of which any of SEQ ID NO: 1–SEQ ID NO: 3654 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least 50%, 60%, 70%, 80%, 90%, 95%, 98%, or 99% homology with a sequence of the invention contained in the Sequence Listing.

In another aspect, the invention features nucleic acids capable of binding mRNA of *E. faecium*. Such nucleic acid is capable of acting as antisense nucleic acid to control the translation of mRNA of *E. faecium*. A further aspect features a nucleic acid which is capable of binding specifically to an *E. faecium* nucleic acid. These nucleic acids are also referred to herein as complements and have utility as probes and as capture reagents.

In another aspect, the invention features an expression system comprising an open reading frame corresponding to *E. faecium* nucleic acid. The nucleic acid further comprises a control sequence compatible with an intended host. The expression system is useful for making polypeptides corresponding to *E. faecium* nucleic acid.

In another aspect, the invention features a cell transformed with the expression system to produce *E. faecium* polypeptides.

In yet another embodiment, the invention encompasses reagents for detecting bacterial infection, including *E. faecium* infection, which comprise at least one *E. faecium*-derived nucleic acid defined by any one of SEQ ID NO: 1–SEQ ID NO: 3654, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1–SEQ ID NO: 3654, or polypeptide sequences contained within any of SEQ ID NO: 3655–SEQ ID NO: 7308, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *E. faecium*-derived immunogenic component, wherein the immunogenic component comprises one or more of the polypeptides encoded by any one of SEQ ID NO: 1–SEQ ID NO: 3654 or sequence-conservative or function-conservative variants thereof; or polypeptides that are contained within any ORFs, including complete protein-coding sequences, of which any of SEQ ID NO: 1–SEQ ID NO: 3654 forms a part; or polypeptide sequences contained within any of SEQ ID NO: 3655–SEQ ID NO: 7308; or polypeptides of which any of SEQ ID NO: 3655–SEQ ID NO: 7308 forms a part. Host animals include any warm blooded animal, including without limitation mammals and birds. Such antibodies have utility as reagents for immunoassays to evaluate the abundance and distribution of *E. faecium*-specific antigens.

In yet another aspect, the invention provides a method for detecting bacterial antigenic components in a sample, which comprises the steps of: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 3654 or sequence-conservative or function-conservative variants thereof, or against a polypeptide sequence contained in any of SEQ ID NO: 3655–SEQ ID NO: 7308 or function-conservative variants thereof.

In yet another aspect, the invention provides a method for detecting antibacterial-specific antibodies in a sample, which comprises: (i) contacting a sample suspected to contain antibacterial-specific antibodies with a *E. faecium* antigenic component, under conditions in which a stable antigen-antibody complex can form between the *E. faecium* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 3654 or sequence-conservative and function-conservative variants thereof, or is a polypeptide sequence contained in any of SEQ ID NO: 3655–SEQ ID NO: 7308 or function-conservative variants thereof.

In another aspect, the invention features a method of generating vaccines for immunizing an individual against *E. faecium*. The method includes: immunizing a subject with an *E. faecium* polypeptide, e.g., a surface or secreted polypeptide, or active portion thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind an *E. faecium* polypeptide. The method includes: contacting the candidate compound with an *E. faecium* polypeptide and determining if the compound binds or otherwise interacts with an *E. faecium* polypeptide. Compounds which bind *E. faecium* are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind an *E. faecium* nucleic acid, e.g., DNA or RNA. The method includes: contacting the candidate compound with an *E. faecium* nucleic acid and determining if the compound binds or otherwise interacts with an *E. faecium* polypeptide. Compounds which bind *E. faecium* are candidates as activators or inhibitors of the bacterial life cycle. These assays can be performed in vitro or in vivo.

A particularly preferred embodiment of the invention is directed to a method of screening test compounds for anti-bacterial activity, which method comprises: selecting as a target a fungal specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, i.e., the *E. faecium* Mu. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteraii, including *E. faecium*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 7308. Use of the terms "SEQ ID NO :1–SEQ ID NO: 3654", "SEQ ID NO: 3655–SEQ ID NO: 7308", "the sequences depicted in Table 2", etc., is intended, for convenience, to refer to each individual SEQ ID NO individually, and is not intended to refer to the genus of these sequences. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "*E. faecium*-derived" nucleic acid or polypeptide sequence may or may not be present in other bacterial species, and may or may not be present in all *E. faecium* strains. This term is intended to refer to the source from which the sequence was originally isolated. Thus, a *E. faecium*-derived polypeptide, as used herein, may be used, e.g., as a target to screen for a broad spectrum antibacterial agent, to search for homologous proteins in other species of bacteria or in eukaryotic organisms such as fungi and humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *E. faecium* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison; is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stingency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.), require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *E. faecium* biological activity if it has one, two and preferably more of the following properties: (1) if when expressed in the course of an *E. faecium* infection, it can promote, or mediate the attachment of *E. faecium* to a cell; (2) it has an enzymatic activity, structural or regulatory function characteristic of an *E. faecium* protein; (3) or the gene which encodes it can rescue a lethal mutation in an *E. faecium* gene. A polypeptide has biological activity if it is an antagonist, agonist, or super-agonist of a polypeptide having one of the above-listed properties.

A biologically active fragment or analog is one having an in vivo or in vitro activity which is characteristic of the *E. faecium* polypeptides of the invention contained in the Sequence Listing, or of other naturally occurring *E. faecium* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary ) cells. Because peptides such as *E. faecium* polypeptides often exhibit a range of physiological properties and because such properties may be attributable to different portions of the molecule, a useful *E. faecium* fragment or *E. faecium* analog is one which exhibits a biological activity in any biological assay for *E. faecium* activity. Most preferably the fragment or analog possesses 10%, preferably 40%, more preferably 60%, 70%, 80% or 90% or greater of the activity of *E. faecium*, in any in vivo or in vitro assay.

Analogs can differ from naturally occurring *E. faecium* polypeptides in amino acid sequence or in ways that do not involve sequence, or both. Non-sequence modifications include changes in acetylation, methylation, phosphorylation, carboxylation, or glycosylation. Preferred analogs include *E. faecium* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *E. faecium* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *E. faecium* analog, will ordinarily be at least about 20 residues, more typically at least about 40 residues, preferably at least about 60 residues in length. Fragments of *E. faecium* polypeptides can be generated by methods known to those skilled in the art. The ability of a candidate fragment to exhibit a biological activity of *E. faecium* polypeptide can be assessed by methods known to those skilled in the art as described herein. Also included are *E. faecium* polypeptides containing residues that are not required for biological activity of the peptide or that result from alternative mRNA splicing or alternative protein processing events.

An "immunogenic component" as used herein is a moiety, such as an *E. faecium* polypeptide, analog or fragment thereof, that is capable of eliciting a humoral and/or cellular immune response in a host animal.

An "antigenic component" as used herein is a moiety, such as an *E. faecium* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *E. faecium* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of decreased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components, whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which arc within the skill of the art. Such techniques are explained fully in the literature. See e.g., Sambrook, Fritsch, and Maniatis, *Molecular Cloning; Laboratory Manual* 2nd ed. (1989); DNA *Cloning,* Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); *PCR-A Practical Approach* (McPherson, Quirke, and Taylor, eds., 1991); *Immunology,* 2d Edition, 1989, Roitt et al., C. V. Mosby Company, and New York; *Advanced Immunology,* 2d Edition, 1991, Male et al., Grower Medical Publishing, New York.; *DNA Cloning: A Practical Approach,* Volumes I and II, 1985 (D. N. Glover ed.); *Oligonucleotide Synthesis,* 1984, (M. L. Gait ed); *Transcription and Translation,* 1984 (Hames and Higgins eds.); *Animal Cell Culture,* 1986 (R. I. Freshney ed.); *Immobilized Cells and Enzymes,* 1986 (IRL Press); Perbal, 1984, *A Practical Guide to Molecular Cloning;* and *Gene Transfer Vectors for Mammalian Cells,* 1987 (J. H. Miller and M. P. Calos eds., Cold Spring Harbor Laboratory); Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

E. faecium Genomic Sequence

This invention provides nucleotide sequences of the genome of *E. faecium* which thus comprises a DNA sequence library of *E. faecium* genomic DNA. The detailed description that follows provides nucleotide sequences of *E. faecium,* and also describes how the sequences were obtained and how ORFs and protein-coding sequences were identified. Also described are methods of using the disclosed *E. faecium* sequences in methods including diagnostic and therapeutic applications. Furthermore, the library can be used as a database for identification and comparison of medically important sequences in this and other strains of *E. faecium.*

To determine the genomic sequence of *E. faecium,* DNA was isolated from a strain of *E. Faecium,* Mu, and mechanically sheared by nebulization to a median size of 2 kb. Following size fractionation by gel electrophoresis, the fragments were blunt-ended, ligated to adapter oligonucleotides, and cloned into each of 20 different pMPX vectors (Rice et al., abstracts of Meeting of Genome Mapping and Sequencing, Cold Spring Harbor, N.Y., 5/11–5/15, 1994, p. 225) and the PUC19 vector to construct a series of "shotgun" subclone libraries.

DNA sequencing was achieved using two sequencing methods. The first method used multiplex sequencing procedures essentially as disclosed in Church et al., 1988, *Science* 240:185; U.S. Pat. Nos. 4,942,124 and 5,149,625). DNA was extracted from pooled cultures and subjected to chemical or enzymatic sequencing. Sequencing reactions were resolved by electrophoresis, and the products were transferred and covalently bound to nylon membranes. Finally, the membranes were sequentially hybridized with a series of labelled oligonucleotides complimentary to "tag" sequences present in the different shotgun cloning vectors. In this manner, a large number of sequences could be obtained from a single set of sequencing reactions. The remainder of the sequencing was performed on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

A variety of approaches are used to order the contigs so as to obtain a continuous sequence representing the entire *E. faecium* genome. Synthetic oligonucleotides are designed that are complementary to sequences at the end of each contig. These oligonucleotides may be hybridized to libaries of *E. faecium* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *E. faecium* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *E. faecium* polypeptide. These ORFs may contain start codons which indicate the initiation of protein synthesis of a naturally-occurring *E. faecium* polypeptide. Such start codons within the ORFs provided herein can be identified by those of ordinary skill in the relevant art, and the resulting ORF and the encoded *E. faecium* polypeptide is within the scope of this invention. For example, within the ORFs a codon such as AUG or GUG (encoding methionine or valine) which is part of the initiation signal for protein synthesis can be identified and the portion of an ORF to corresponding to a naturally-occurring *E. faecium* polypeptide can be recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

E. faecium Nucleic Acids

The present invention provides a library of E. faecium-derived nucleic acid sequences. The libraries provide probes, primers, and markers which can be used as markers in epidemiological studies. The present invention also provides a library of E. faecium-derived nucleic acid sequences which comprise or encode targets for therapeutic drugs.

The nucleic acids of this invention may be obtained directly from the DNA of the above referenced E. faecium strain by using the polymerase chain reaction (PCR). See "PCR, A Practical Approach" (McPherson, Quirke, and Taylor, eds., IRL Press, Oxford, UK, 1991) for details about the PCR. High fidelity PCR can be used to ensure a faithful DNA copy prior to expression. In addition, the authenticity of amplified products can be verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, N.Y.).

It is also possible to obtain nucleic acids encoding E. faecium polypeptides from a cDNA library in accordance with protocols herein described. A cDNA encoding an E. faecium polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding E. faecium polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands. antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect E. faecium. With the sequence information set forth in the present application, sequences of twenty or more nucleotides are identified which provide the desired inclusivity and exclusivity with respect to E. faecium, and extraneous nucleic acids likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Enterococcus species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate E. faecium nucleic acid from the nucleic acid of each other and other organisms. Nucleic acid having twenty or more nucleotides in a sequence of the invention contained in the Sequence Listing can also have utility to separate other Enterococcus species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of E. faecium nucleic acid. These nucleic acids may also have utility as primers for the amplification of nucleic acids in other Enterococcus species. With respect to polymerase chain reaction (PCR) techniques, nucleic acid sequences of $\geq$10–15 nucleotides of the invention contained in the Sequence Listing have utility in conjunction with suitable enzymes and reagents to create copies of E. faecium nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *E. faecium* and/or other Enterococcus species. The copies can also be incorporated into cloning and expression vectors to generate polypeptides corresponding to the nucleic acid synthesized by PCR, as is described in greater detail herein.

The nucleic acids of the present invention find use as templates for the recombinant production of *C. albicans*-derived peptides or polypeptides Antisense Nucleic acid or nucleic acid-hybridizing derivatives isolated or synthesized in accordance with the sequences described herein have utility as antisense agents to prevent the expression of *E. faecium* genes. These sequences also have utility as antisense agents to prevent expression of genes of other Enterococcus species.

In one embodiment, nucleic acid or derivatives corresponding to *E. faecium* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *E. faecium* that are useful as reagents for diagnosis of bacterial infection, components of effective anti-bacterial vaccines, and/or as targets for anti-bacterial drugs, including anti-*E. faecium* drugs.
Expression of *E. faecium* Nucleic Acids Table 2 provides a list of open reading frames (ORFs) in both strands. An ORF is a region of nucleic acid which encodes a polypeptide. This region may represent a portion of a coding sequence or a total sequence and was determined from stop to stop codons. The first column lists the ORF designation. The second and third columns list the SEQ ID numbers for the nucleic acid and amino acid sequences corresponding to each ORF, respectively. The fourth and fifth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of;the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the eighth column. Specifically, the sixth column represents the "score" for the match (a higher score is a better match), and the seventh column represents the "P-value" for the match (the probability that such a match could have occurred by chance; the lower the value, the more likely the match is valid). If a BLASTP2 score of less than 46 was obtained, no value is reported in the table the "P-value". The eighth column provides, where available, the accession number (AC) or the Swissprot accession number (SP), the locus name (LN), Superfamily Classification (CL), the Organism (OR), Source of variant (SR), E.C. number (EC), the gene name (GN), the product name (PN), the Function Description (FN), the Map Position (MP), Left End (LE), Right End (RE), Coding Direction (DI), the Database from which the sequence originates (DB), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 3654 and in Table 2 together with routine cloning and sequencing methods, one of ordinary skill in the art will be able to clone and sequence all the nucleic acid fragments of interest including open reading frames (ORFs) encoding a large variety proteins of *E. faecium*.

Nucleic acid isolated or synthesized in accordance with the sequences described herein have utility to generate polypeptides. The nucleic acid of the invention exemplified in SEQ ID NO: 1–SEQ ID NO: 3654and in Table 2 or fragments of said nucleic acid encoding active portions of *E. faecium* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae,* Methanobacterium strains or other Archaea, and Eubacteria such as *E. coli, B. Subtilis, S. Aureus, S. Pneumonia* or *Pseudomonas putida.* In some cases the expression host will utilize the natural *E. faecium* promoter whereas in others, it will be necessary to drive the gene with a promoter sequence derived from the expressing organism (e.g., an *E. coli* beta-galactosidase promoter for expression in *E. coli*).

To express a gene product using the natural *E. faecium* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. For example, an *E. faecium* polypeptide can be expressed in bacterial cells such as *E. Coli* or *B. subtilis,* insect cells (baculovirus), yeast, or mammalian cells such as Chinese hamster ovary cell (CHO). Other suitable host cells are known to those skilled in the art.

Expression in eucaryotic cells such as mammalian, yeast, or insect cells can lead to partial or complete glycosylation and/or formation of relevant inter- or intra-chain disulfide bonds of a recombinant peptide product. Examples of vectors for expression in yeast *S. cerivisae* include pYepSec1 (Baldari. et al., (1987) *Embo J.* 6:229–234), pMFa (Kurjan and Herskowitz, (1982) *Cell* 30:933–943), pJRY88 (Schultz et al., (1987) *Gene* 54:113–123), and pYES2 (Invitrogen Corporation, San Diego, Calif.). Baculovirus vectors available for expression of proteins in cultured insect cells (SF 9 cells) include the pAc series (Smith et al., (1983) *Mol. Cell Biol.* 3:2156–2165) and the pVL series (Lucklow, V. A., and Summers, M. D., (1989) *Virology* 170:31–39). Generally, COS cells (Gluzman, Y., (1981) Cell 23: 175–182) are used in conjunction with such vectors as pCDM 8 (Aruffo, A. and Seed, B., (1987) *Proc. Natl. Acad. Sci. USA* 84:8573–8577) for transient amplification/expression in mammalian cells, while CHO (dhfr–Chinese Hamster Ovary) cells are used with vectors such as pMT2PC (Kaufman et al. (1987), *EMBO J.* 6:187–195) for stable amplification/expression in mammalian cells. Vector DNA can be introduced into mammalian cells via conventional techniques such as calcium phosphate or calcium chloride co-precipitation, DEAE-dextran-mediated transfection, or electroporation. Suitable methods for transforming host cells can be found in Sambrook et al. (*Molecular Cloning: A Laboratory Manual,* 2nd Edition, Cold Spring Harbor Laboratory press (1989)), and other laboratory textbooks.

Expression in procaryotes is most often carried out in *E. coli* with either fusion or non-fusion inducible expression vectors. Fusion vectors usually add a number of $NH_2$ terminal amino acids to the expressed target gene. These $NH_2$ terminal amino acids often are referred to as a reporter group or an affinity purification group. Such reporter groups usually serve two purposes: 1) to increase the solubility of the target recombinant protein; and 2) to aid in the purification of the target recombinant protein by acting as a ligand in affinity purification. Often, in fusion expression vectors, a proteolytic cleavage site is introduced at the junction of the reporter group and the target recombinant protein to enable separation of the target recombinant protein from the reporter group subsequent to purification of the fusion protein. Such enzymes, and their cognate recognition sequences, include Factor Xa, thrombin and enterokinase. Typical fusion expression vectors include pGEX (Amrad Corp., Melbourne, Australia), pMAL (New England Biolabs, Beverly, Mass.) and pRIT5 (Pharmacia, Piscataway, N.J.) which fuse glutathione S-transferase, maltose E binding protein, or protein A, respectively, to the target recombinant protein. A preferred reporter group is poly(His), which may be fused to the amino or carboxy terminus of the protein and which renders the recombinant fusion protein easily purifiable by metal chelate chromatography.

Inducible non-fusion expression vectors include pTrc (Amann et al., (1988) Gene 69:301–315) and pET11d (Studier et al., *Gene Expression Technology: Methods in Enzymology* 185, Academic Press, San Diego, Calif. (1990) 60–89). While target gene expression relies on host RNA polymerase transcription from the hybrid trp-lac fusion promoter in pTrc, expression of target genes inserted into pET11d relies on transcription from the T7 gn10-lac 0 fusion promoter mediated by coexpressed viral RNA polymerase (T7 gn1). This viral polymerase is supplied by host strains BL21(DE3) or HMS174(DE3) from a resident λ prophage harboring a T7 gn1 under the transcriptional control of the lacUV 5 promoter.

For example, a host cell transfected with a nucleic acid vector directing expression of a nucleotide sequence encoding an *E. faecium* polypeptide can be cultured under appropriate conditions to allow expression of the polypeptide to occur. The polypeptide may be secreted and isolated from a mixture of cells and medium containing the peptide. Alternatively, the polypeptide may be retained cytoplasmically and the cells harvested, lysed and the protein isolated. A cell culture includes host cells, media and other byproducts. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Several different criteria are used for choosing a detergent suitable for solubilizing these complexes. For example, one property considered is the ability of the detergent to solubilize the *E. faecium* protein within the membrane fraction at minimal denaturation of the membrane-associated protein allowing for the activity or functionality of the membrane-associated protein to return upon reconstitution of the protein. Another property considered when selecting the detergent is the critical micelle concentration (CMC) of the detergent in that the detergent of choice preferably has a high CMC value allowing for ease of removal after reconstitution. A third property considered when selecting a detergent is the hydrophobicity of the detergent. Typically, membrane-associated proteins are very hydrophobic and therefore detergents which are also hydrophobic, e.g., the triton series, would be useful for solubilizing the hydrophobic proteins. Another property important to a detergent can be the capability of the detergent to remove the *E. faecium* protein with minimal protein-protein interaction facilitating further purification. A fifth property of the detergent which should be considered is the charge of the detergent. For example, if it is desired to use ion exchange resins in the purification process then preferably detergent should be an uncharged detergent. Chromatographic techniques which can be used in the final purification step are known in the art and include hydrophobic interaction, lectin affinity, ion exchange, dye affinity and immunoaffinity.

One strategy to maximize recombinant *E. faecium* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *E. faecium* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *E. faecium*-derived nucleic acid sequences. The libraries provide probes, primers, and markers which can be used as markers in epidemiological studies. The present invention also provides a library of *E. faecium*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 3654. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 3655–SEQ ID NO: 7308 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

In certain embodiments, the invention encompasses isolated nucleic acid fragments comprising all or part of the individual nucleic acid sequences disclosed herein. The fragments are at least about 8 nucleotides in length, preferably at least about 12 nucleotides in length, and most preferably at least about 15–20 nucleotides in length.

The nucleic acids may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *E. faecium* regulatory sequences, or may be associated with heterologous sequences, including promoters, enhancers, response elements, signal sequences, polyadenylation sequences, introns, 5'- and 3'- noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *E. faecium*-derived sequences or derivatives or fragments thereof. A large number of vectors, including plasmid and fungal vectors, have been described for replication and/or expression in a variety of eukaryotic and prokaryotic hosts, and may be used for gene therapy as well as for simple cloning or protein expression.

The encoded *E. faecium* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *E. faecium* coding sequences may be synthesized by standard methods, isolated from natural sources, or prepared as hybrids, etc. Ligation of the *E. faecium* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, fungal infection, microinjection, microprojectile, or other established methods.

Appropriate host cells include bacteria, archebacteria, fungi, especially yeast, and plant and animal cells, especially mammalian cells. Of particular interest are *E. faecium, E. coli, B. Subtilis, Saccharomyces cerevisiae, Saccharomyces carlsbergensis, Schizosaccharomyces pombi,* SF9 cells, C129 cells, 293 cells, *Neurospora,* and CHO cells, COS cells, HeLa cells, and immortalized mammalian myeloid and lymphoid cell lines. Preferred replication systems include M13, Co1E1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *E. faecium*-derived peptides and polypeptides.

Advantageously, vectors may also include a transcription regulatory element (i.e., a promoter) operably linked to the *E. faecium* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *E. faecium*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *E. faecium*-derived peptides or polypeptides.

Identification and Use of *E. faecium* Nucleic Acid Sequences

The disclosed *E. faecium* polypeptide and nucleic acid sequences, or other sequences that are contained within ORFs, including complete protein-coding sequences, of which any of the disclosed *E. faecium*-specific sequences forms a part, are useful as target components for diagnosis and/or treatment of *E. faecium*-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *E. faecium* DNA as template; this is followed by sequencing the amplified product. The isolated nucleic acid encoding the disclosed sequence, or fragments thereof, can also be hybridized to *E. faecium* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that: are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *E. faecium*

The disclosed *E. faecium* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *E. faecium*. Identification of said immunogenic components involved in the determination of the function of the disclosed sequences, which can be achieved using a variety of approaches. Non-limiting examples of these approaches are described briefly below.

Homology to Known Sequences

Computer-assisted comparison of the disclosed *E. faecium* sequences with previously reported sequences present in publicly available databases is useful for identifying functional *E. faecium* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in an *E. faecium* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *E. faecium* proteins identified as containing putative signal sequences and/or transmembrane domains are useful as immunogenic components of vaccines.

Targets for therapeutic drugs according to the invention include, but are not limited to, polypeptides of the invention, whether unique to *E. faecium* or not, that are essential for growth and/or viability of *E. faecium* under at least one growth condition. Polypeptides essential for growth and/or viability can be determined by examining the effect of deleting and/or disrupting the genes, i.e., by so-called gene "knockout". Alternatively, genetic footprinting can be. used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences

Because of the evolutionary relationship between different *E. faecium* strains, it is believed that the presently disclosed *E. faecium* sequences are useful for identifying, and/or discriminating between, previously known and new *E. faecium* strains. It is believed that other *E. faecium* strains will exhibit at least 70% sequence homology with the presently disclosed sequence. Systematic and routine analyses of DNA sequences derived from samples containing *E. faecium* strains, and comparison with the present sequence allows for the identification of sequences that can be used to discriminate between strains, as well as those that are common to all *E. faecium* strains. In one embodiment, the invention provides nucleic acids, including probes, and peptide and polypeptide sequences that discriminate between different strains of *E. faecium*. Strain-specific components can also be identified functionally by their ability to elicit or react with antibodies that selectively recognize one or more *E. faecium* strains.

In another embodiment, the invention provides nucleic acids, including probes, and peptide and polypeptide sequences that are common to all *E. faecium* strains but are not found in other bacterial species.

*E. faecium* Polypeptides

This invention encompasses isolated *E. faecium* polypeptides encoded by the disclosed *E. faecium* genomic sequences, including the polypeptides of the invention contained in the Sequence Listing. Polypeptides of the invention are preferably at least 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *E. faecium* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *E. faecium* DNA as template; this is followed by sequencing the amplified product.

The polypeptides of the present invention, including function-conservative variants of the disclosed ORFs, may be isolated from wild-type or mutant *E. faecium* cells, or from heterologous organisms or cells (including, but not limited to, bacteria, fungi, insect, plant, and mammalian cells) including *E. faecium* into which a *E. faecium*-derived protein-coding sequence has been introduced and expressed. Furthermore, the polypeptides may be part of recombinant fusion proteins.

*E. faecium* polypeptides of the invention can be chemically synthesized using commercially automated procedures such as those referenced herein , including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

The alpha-amino protecting groups are those known to be useful in the art of stepwise polypeptide synthesis. Included are acyl type protecting groups, e.g., formyl, trifluoroacetyl, acetyl, aromatic urethane type protecting groups, e.g., benzyloxycarbonyl (Cbz), substituted benzyloxycarbonyl and 9-fluorenylmethyloxycarbonyl (Fmoc), aliphatic urethane protecting groups, e.g., t-butyloxycarbonyl (Boc), isopropyloxycarbonyl, cyclohexyloxycarbonyl, and alkyl type protecting groups, e.g., benzyl, triphenylmethyl. The preferred protecting group is Boc. The side-chain protecting groups for Tyr include tetrahydropyranyl, tert-butyl, trityl, benzyl, Cbz, 4-Br-Cbz and 2,6-dichlorobenzyl. The preferred side-chain protecting group for Tyr is 2,6-dichlorobenzyl. The side-chain protecting groups for Asp include benzyl;, 2,6-dichlorobenzyl, methyl, ethyl and cyclohexyl. The preferred side-chain protecting group for Asp is cyclohexyl. The side-chain protecting groups for Thr and Ser include acetyl, benzoyl, trityl, tetrahydropyranyl, benzyl, 2,6-dichlorobenzyl and Cbz. The preferred protecting group for Thr and Ser is benzyl. The side-chain protecting groups for Arg include nitro, Tos, Cbz; adamantyloxycarbonyl and Boc. The preferred protecting group for Arg is Tos. The side-chain amino group of Lys may be protected with Cbz, 2-Cl-Cbz, Tos or Boc. The 2-Cl-Cbz group is the preferred protecting group for Lys.

The side-chain protecting groups selected must remain intact during coupling and not be removed during the deprotection of the amino-terminus protecting group or during coupling conditions. The side-chain protecting groups must also be removable upon the completion of synthesis, using reaction conditions that will not alter the finished polypeptide.

Solid phase synthesis is usually carried out from the carboxy-terminus by coupling the alpha-amino protected (side-chain protected) amino acid to a suitable solid support. An ester linkage is formed when the attachment is made to a chloromethyl or hydroxymethyl resin, and the resulting polypeptide will have a free carboxyl group at the C-terminus. Alternatively, when a benzhydrylamine or p-methylbenzhydrylamine resin is used, an amide bond is formed and the resulting polypeptide will have a carboxamide group at the C-terminus. These resins are commercially available, and their preparation was described by Stewart et al., 1984, *Solid Phase Peptide Synthesis* (2nd Edition), Pierce Chemical Co., Rockford, Ill.

The C-terminal amino acid, protected at the side chain if necessary and at the alpha-amino group, is coupled to the benzhydrylamine resin using various activating agents including dicyclohexylcarbodiimide (DCC), N,N'-diisopropyl-carbodiimide and carbonyldiimidazole. Following the attachment to the resin support, the alpha-amino protecting group is removed using trifluoroacetic acid (TFA) or HCl in dioxane at a temperature between 0 and 25° C. Dimethylsulfide is added to the TFA after the introduction of methionine (Met) to suppress possible S-alkylation. After removal of the alpha-amino protecting group, the remaining protected amino acids are coupled stepwise in the required order to obtain the desired sequence.

Various activating agents can be used for the coupling reactions including DCC, N,N'-diisopropyl-carbodiimide, benzotriazol-1-yl-oxy-tris-(dimethylamino)phosphonium hexa-fluorophosphate (BOP) and DCC-hydroxybenzotriazole (HOBt). Each protected amino acid is used in excess (>2.0 equivalents), and the couplings are usually carried out in N-methylpyrrolidone (NMP) or in DMF. $CH_2Cl_2$ or mixtures thereof. The extent of completion of the coupling reaction is monitored at each stage, e.g., by the ninhydrin reaction as described by Kaiser et al., 1970, *Anal. Biochem.* 34:595. In cases where incomplete coupling is found, the coupling reaction is repeated. The coupling reactions can be performed automatically with commercially available instruments.

After the entire assembly of the desired polypeptide, the polypeptide-resin is cleaved with a reagent such as liquid HF for 1–2 hours at 0° C., which cleaves the polypeptide from the resin and removes all side-chain protecting groups. A scavenger such as anisole is usually used with the liquid HF to prevent cations formed during the cleavage from alkylating the amino acid residues present in the polypeptide. The polypeptide-resin may be deprotected with TFA/dithioethane prior to cleavage if desired.

Side-chain to side-chain cyclization on the solid support requires the use of an orthogonal protection scheme which enables selective cleavage of the side-chain functions of acidic amino acids (e.g., Asp) and the basic amino acids (e.g., Lys). The 9-fluorenylmethyl (Fm) protecting group for the side-chain of Asp and the 9-fluorenylmethyloxycarbonyl (Fmoc) protecting group for the side-chain of Lys can be used for this purpose. In these cases, the side-chain protecting groups of the Boc-protected polypeptide-resin are selectively removed with piperidine in DMF. Cyclization is achieved on the solid support using various activating agents including DCC, DCC/HOBt or BOP. The HF reaction is carried out on the cyclized polypeptide-resin as described above.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *E. faecium* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a *E. faecium* protein or against peptides derived therefrom can be used as purification reagents. Other purification methods are possible.

The present invention also encompasses derivatives and homologues of *E. faecium*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids. The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *E. faecium*-derived polypeptides for use in the present invention, essentially the complete genomic sequence of a virulent, methicillin-resistant isolate of *Enterococcus faecium* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *E. faecium* polypeptide sequences that are contained within the open reading frames (ORFs), including complete protein-coding sequences, of which any of SEQ ID NO: 3655–SEQ ID NO: 7308 forms a part. Table 2, which is appended herewith and which forms part of the present specification, provides a putative identification of the particular function of a polypeptide which is encoded by each ORF. As a result, one skilled in the art can use the polypeptides of the present invention for commercial and industrial purposes consistent with the type of putative identification of the polypeptide.

The present invention provides a library of *E. faecium*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *E. faecium*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *E. faecium* infection, including use as markers in epidemiological studies. Non-limiting examples of such sequences are listed by SEQ ID NO in Table 2, which is appended The present invention also provides a library of *E. faecium*-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example: Determination of Candidate Protein Antigens for Antibody and Vaccine Development The selection of candidate protein antigens for vaccine development can be derived from the nucleic acids encoding *E. faecium* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta*.815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *E. faecium* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *E. faecium* Nucleic Acids and Polypeptides Based on the discovery of the *E. faecium* gene products of the invention provided in the Sequence Listing, one skilled in the art can alter the disclosed structure (of *E. faecium* genes), e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *E. faecium* polypeptides. Such screens are useful for the identification of inhibitors of *E. faecium*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNA's which encode an array of fragments. DNA's which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–14). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc. 3rd Cleveland Sympos. Macromolecules*, ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci.* USA, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *E. faecium* Nucleic Acids and Polypeptides

It is possible to modify the structure of an *E. faecium* polypeptide for such purposes as increasing solubility, enhancing stability (e.g., shelf life ex vivo and resistance to proteolytic degradation in vivo). A modified *E. faecium* protein or peptide can be produced in which the amino acid sequence has been altered, such as by amino acid substitution, deletion, or addition as described herein.

An *E. faecium* peptide can also be modified by substitution of cysteine residues preferably with alanine, serine, threoine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *E. faecium* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *E. faecium* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *E. faecium* proteins include reduction/alkylation (Tarr, *Methods of Protein Microcharacterization,* J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology,* W H Freeman, San Francisco, Calif. (1980), U.S. Pat. No. 4,939,239; or mild formalin treatment (Marsh, (1971) *Int. Arch. of Allergy and Appl. Immunol.* 41: 199–215).

To facilitate purification and potentially increase solubility of an *E. faecium* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology,* 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *E. faecium* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *E. faecium* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described above (as with the other screening methods described herein), can be used to identify polypeptides, e.g., fragments or analogs of a naturally-occurring *E. faecium* polypeptide, e.g., of cellular proteins, or of randomly generated polypeptides which bind to an *E. faecium* protein. (The *E. faecium* domain is used as the bait protein and the library of variants are expressed as prey fusion proteins.) In an analogous fashion, a two hybrid assay (as with the other screening methods described herein), can be used to find polypeptides which bind a *E. faecium* polypeptide.

Display Libraries

In one approach to screening assays, the candidate peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) TIBS 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over 1013 phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages M13, fd., and f1 are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) PNAS 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech,* 9, 1369), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stablely associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) Proc. Natl. Acad. Sci. U.S.A. 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) Proc. Natl. Acad. Sci. U.S.A. 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) J. Med. Chem. 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) J. Med. Chem. 37(9):1233–1251), a molecular DNA library encoding $10^{12}$ decapeptides was constructed and the library expressed in an E. coli S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) Anal. Biochem. 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of E. faecium Polypeptides

The invention also provides for reduction of the protein binding domains of the subject E. faecium polypeptides to generate mimetics, e.g. peptide or non-peptide agents. The peptide mimetics are able to disrupt binding of a polypeptide to its counter ligand, e.g., in the case of an E. faecium polypeptide binding to a naturally occurring ligand. The critical residues of a subject E. faecium polypeptide which are involved in molecular recognition of a polypeptide can be determined and used to generate E. faecium-derived peptidomimetics which competitively or noncompetitively inhibit binding of the E. faecium polypeptide with an interacting polypeptide (see, for example, European patent applications EP-412,762A and EP-B31,080A).

For example, scanning mutagenesis can be used to map the amino acid residues of a particular E. faecium polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an E. faecium polypeptide to an interacting polypeptide and thereby interfere with the function of E. faecium polypeptide. For instance, non-hydrolyzable peptide analogs of such residues can be generated using benzodiazepine (e.g., see Freidinger et al. in Peptides: Chemistry and Biology, G. R. Marshall ed., ESCOM Publisher: Leiden, Netherlands, 1988), azepine (e.g., see Huffman et al. in Peptides: Chemistry and Biology, G. R. Marshall ed., ESCOM Publisher: Leiden, Netherlands, 1988), substituted gama lactam rings (Garvey et al. in Peptides: Chemistry and Biology, G. R. Marshall ed., ESCOM Publisher: Leiden, Netherlands, 1988), keto-methylene pseudopeptides (Ewenson et al. (1986) J Med

*Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *E. faecium* Nucleic Acids and Polypeptides

This invention also features vaccine compositions for protection against infection by *E. faecium* or for treatment of *E. faecium* infection, a gram-negative spiral microaerophilic bacterium. In one embodiment, the vaccine compositions contain one or more immunogenic components such as a surface protein from *E. faecium,* or portion thereof, and a pharmaceutically acceptable carrier. Nucleic acids within the scope of the invention are exemplified by the nucleic acids of the invention contained in the Sequence Listing which encode *E. faecium* surface proteins. Any nucleic acid encoding an immunogenic *E. faecium* protein, or portion thereof, which is capable of expression in a cell, can be used in the present invention. These vaccines have therapeutic and prophylactic utilities.

One aspect of the invention provides a vaccine composition for protection against infection by *E. faecium* which contains at least one immunogenic fragment of an *E. faecium* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *E. faecium* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *E. faecium* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA,* 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *E. faecium* polypeptide or fragment thereof or nucleic acid encoding an *E. faecium* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *E. faecium* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *E. faecium* Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine. (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the E. faecium polypeptide with cholera toxin or its B subunit, procholeragenoid, fungal polysaccharides, including schizophyllan, muramyl dipeptide, muramyl dipeptide derivatives, phorbol esters, labile toxin of E. coli, non-E. faecium bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including E. faecium polypeptide in an insoluble form as fusion proteins. Suitable carriers for the vaccines of the invention are enteric coated capsules and polylactide-glycolide microspheres. Suitable diluents are 0.2 N NaHCO3 and/or saline.

Vaccines of the invention can be administered as a primary prophylactic agent in adults or in children, as a secondary prevention, after successful eradication of E. faecium in an infected host, or as a therapeutic agent in the aim to induce an immune response in a susceptible host to prevent infection by E. faecium. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917–921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, American Gastroenterological Assoc. 888:A-222 (1993)).

In a preferred embodiment, a vaccine composition of the invention can be based on a killed whole E. coli preparation with an immunogenic fragment of an E. faecium protein of the invention expressed on its surface or it can be based on an E. coli lysate, wherein the killed E. coli acts as a carrier or an adjuvant.

It will be apparent to those skilled in the art that some of the vaccine compositions of the invention are useful only for preventing E. faecium infection, some are useful only for treating E. faecium infection, and some are useful for both preventing and treating E. faecium infection. In a preferred embodiment, the vaccine composition of the invention provides protection against E. faecium infection by stimulating humoral and/or cell-mediated immunity against E. faecium. It should be understood that amelioration of any of the symptoms of E. faecium infection is a desirable clinical goal, including a lessening of the dosage of medication used to treat E. faecium-caused disease, or an increase in the production of antibodies in the serum or mucous of patients.

Antibodies Reactive With E. faecium Polypeptides

The invention also includes antibodies specifically reactive with the subject E. faecium polypeptide. Anti-protein/anti-peptide antisera or monoclonal antibodies can be made by standard protocols (See, for example, Antibodies: A Laboratory Manual ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject E. faecium polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the E. faecium polypeptides of the invention, e.g. antigenic determinants of a polypeptide of the invention contained in the Sequence Listing, or a closely related human or non-human mammalian homolog (e.g., 90% homologous, more preferably at least 95% homologous). In yet a further preferred embodiment of the invention, the anti-E. faecium antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with E. faecium polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-E. faecium portion.

Both monoclonal and polyclonal antibodies (Ab) directed against E. faecium polypeptides or E. faecium polypeptide variants, and antibody fragments such as Fab' and F(ab')$_2$, can be used to block the action of E. faecium polypeptide and allow the study of the role of a particular E. faecium polypeptide of the invention in aberrant or unwanted intracellular signaling, as well as the normal cellular function of the *E. faecium* and by microinjection of anti-*E. faecium* polypeptide antibodies of the present invention.

Antibodies which specifically bind *E. faecium* epitopes can also be used in immunohistochemical staining of tissue samples in order to evaluate the abundance and pattern of expression of *E. faecium* antigens. Anti *E. faecium* polypeptide antibodies can be used diagnostically in immunoprecipitation and immuno-blotting to detect and evaluate *E. faecium* levels in tissue or bodily fluid as part of a clinical testing procedure. Likewise, the ability to monitor *E. faecium* polypeptide levels in an individual can allow determination of the efficacy of a given treatment regimen for an individual afflicted with such a disorder. The level of an *E. faecium* polypeptide can be measured in cells found in bodily fluid, such as in urine samples or can be measured in tissue, such as produced by gastric biopsy. Diagnostic assays using anti-*E. faecium* antibodies can include, for example, immunoassays designed to aid in early diagnosis of *E. faecium* infections. The present invention can also be used as a method of detecting antibodies contained in samples from individuals infected by this bacterium using specific *E. faecium* antigens.

Another application of anti-*E. faecium* polypeptide antibodies of the invention is in the immunological screening of cDNA libraries constructed in expression vectors such as lgt11, lgt18–23, IZAP, and IORF8. Messenger libraries of this type, having coding sequences inserted in the correct reading frame and orientation, can produce fusion proteins. For instance, lgt11 will produce fusion proteins whose amino termini consist of β-galactosidase amino acid sequences and whose carboxy termini consist of a foreign polypeptide. Antigenic epitopes of a subject *E. faecium* polypeptide can then be detected with antibodies, as, for example, reacting nitrocellulose filters lifted from infected plates with anti-*E. faecium* polypeptide antibodies. Phage, scored by this assay, can then be isolated from the infected plate. Thus, the presence of *E. faecium* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Drug Screening Assays Using *E. faecium* Polypeptides

By making available purified and recombinant *E. faecium* polypeptides, the present invention provides assays which can be used to screen for drugs which are either agonists or antagonists of the normal cellular function, in this case, of the subject *E. faecium* polypeptides, or of their role in intracellular signaling. Such inhibitors or potentiators may be useful as new therapeutic agents to combat *E. faecium* infections in humans. A variety of assay formats will suffice and, in light of the present inventions, will be comprehended by the skilled artisan.

In many drug screening programs:which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *E. faecium* polypeptide.

Screening assays can be constructed in vitro with a purified *E. faecium* polypeptide or fragment thereof, such as an *E. faecium* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *E. faecium* polypeptide. Some of these active compounds may directly, or with chemical alterations to promote membrane permeability or solubility, also inhibit or potentiate the same activity (e.g., enzymatic activity) in whole, live *E. faecium* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, Embo J. 4:2061–2068; Eilers and Schatz, Nature, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, Nature 340:245–246). The yeast two-hybrid system takes advantage of the properties of the GAL4 protein of the yeast Saccharomyces cerevisiae. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both: domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, Science 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant (s), lubricant(s), plasticizer(s), colorant(s), dosage vehicle (s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,* Dekker, N.Y.; Lieberman et al (eds.), 1990, *Pharmaceutical Dosage Forms: Disperse Systems,* Dekker, N.Y.

The antibacterial agents and compositions of the present invention are useful for preventing or treating *E. faecium* infections. Infection prevention methods incorporate a prophylactically effective amount of an antibacterial agent or composition. A prophylactically effective amount is an amount effective to prevent *E. faecium* infection and will depend upon the specific bacterial strain, the agent, and the host. These amounts can be determined experimentally by methods known in the art and as described above.

*E. faecium* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described: above. Systemic administration includes both oral and parental routes. Parental routes include, without limitation, subcutaneous, intramuscular, intraperitoneal, intravenous, transdermal, inhalation and intranasal administration.

EXEMPLIFICATION

I. Cloning and Sequencing of *E. faecium* DNA

*E. faecium* chromosomal DNA was isolated according to a basic DNA protocol outlined in Schleif R. F. and Wensink P. C., Practical Methods in Molecular Biology, p.98, Springer-Verlag, NY., 1981, with minor modifications. Briefly, cells were pelleted, resuspended in TE (10 mM Tris, 1 mM EDTA, pH 7.6) and GES lysis buffer (5.1 M guanidium thiocyanate, 0.1 M EDTA, pH 8.0, 0.5% N-laurylsarcosine) was added. Suspension was chilled and ammonium acetate (NH4Ac) was added to final concentration of 2.0 M. DNA was extracted, first with chloroform, then with phenol-chloroform, and reextracted with chloroform. DNA was precipitated with isopropanol, washed twice with 70% EtOH, dried and resuspended in TE.

Following isolation whole genomic *E. faecium* DNA was nebulized (Bodenteich et al., Automated DNA Sequencing and Analysis (J. C. Venter, ed.), Academic Press, 1994) to a median size of 2000 bp. After nebulization, the DNA was concentrated and separated on a standard 1% agarose gel. Several fractions, corresponding to approximate sizes 1000–1500 bp, 1500–2000 bp, 2000–2500 bp, 2500–3000bp, were excised from the gel and purified by the GeneClean procedure (Bio101, Inc.).

The purified DNA fragments were then blunt-ended using T4 DNA polymerase. The healed DNA was then ligated to unique BstXI-linker adapters 5'-GTCTTCACCACGGGG-3' (SEQ ID NO: 7309) and 5'-GTGGTGAAGAC-3' (SEQ ID NO: 7310) in 100–1000 fold molar excess. These linkers are complimentary to the BstXI-cut pMPX vectors, while the overhang is not self-complimentary. Therefore the linkers will not concatemerize nor will the cut vector relegate itself easily. The linker-adapted inserts were separated from the unincorporated linkers on a 1% agarose gel and purified using GeneClean®. The linker-adopted inserts were then ligated to each of 20 pMPX vectors to construct a series of "shotgun" subclone libraries. Blunt ended vector was used for cloning into the PUC19 vector. The vectors contain an out-of-frame lacZ gene at the cloning site which becomes in-frame in the event that an adapter-dimer is cloned, allowing these to be avoided by their blue-color.

All subsequent steps were based either on the multiplex DNA sequencing protocols outlined in Church G. M. and Kieffer-Higgins S., Science 240:185–188, 1988 or by ABI377 automated DNA sequencing methods. Only major modifications to the protocols are highlighted. Briefly, each of the 20 vectors was then transformed into DH5a competent cells (Gibco/BRL, DH5a transformation protocol). The libraries were assessed by plating onto antibiotic plates containing ampicillin, methicillin and IPTG/Xgal. The plates were incubated overnight at 37° C. Successful transformants were then used for plating of clones and pooling into the multiplex pools. The clones were picked and pooled into 40 ml growth medium cultures. The cultures were grown overnight at 37° C. DNA was purified using the Qiagen Midi-prep kits and Tip-100 columns (Qiagen, Inc.). In this manner, 100 mg of DNA was obtained per pool.

The purified DNA samples were then sequenced either using the multiplex DNA sequencing based on chemical degradation methods (Church G. M. and Kieffer-Higgins S., *Science* 240:185–188, 1988) or by Sequithrem (Epicenter Technologies) dideoxy sequencing protocols or by ABI dye-terminator chemistry. For the multiplex portion the sequencing reactions were electrophoresed and transferred onto nylon membranes by direct transfer electrophoresis from 40 $cm^2$ gels (Richterich P. and Church G. M., *Methods in Enzymology* 218:187–222, 1993). The DNA was covalently bound to the membranes by exposure to ultraviolet light, and hybridized with labeled oligonucleotides complimentary to tag sequences on the vectors (Church, supra). The membranes were washed to rinse off non-specifically bound probe, and exposed to X-ray film to visualize individual sequence ladders. After autoradiography, the hybridized probe was removed by incubation at 65° C., and the hybridization cycle repeated with another tag sequence until the membrane had been probed 41 times. Thus, each gel produced a large number of films, each containing new sequencing information. Whenever a new blot was processed, it was initially probed for an internal standard sequence added to each of the pools. Digital images of the films were generated using a laser-scanning densitometer (Molecular Dynamics, Sunnyvale, Calif.). The digitized images were processed on computer workstations (VaxStation 4000's) using the program REPLICA™ (Church et al., Automated DNA Sequencing and Analysis (J. C. Venter, ed.), Academic Press, 1994). Image processing included lane straightening, contrast adjustment to smooth out intensity differences, and resolution enhancement by iterative gaussian deconvolution. The sequences were then converted to an SCF format so that processing and assembly could proceed on UNIX machines. The ABI dye terminator sequence reads were run on ABI377 machines and the data was directly transferred to UNIX machines following lane tracking of the gels. All multiplex and ABI reads were assembled using PHRAP (P. Green, Abstracts of DOE Human Genome Program Contractor-Grantee Workshop V, January 1996, p. 157) with default parameters and not using quality scores. The initial assembly was done at 7 fold coverage and yielded 511 contigs. Short read length fragments of 200 bp or less found on the ends of contigs facing in the appropriate direction were used to extend off the end of the contigs. These reads were then resequenced with primers using ABI technology to give sequences with a read length of 500 or more bases. This allowed end extensions to be performed without ordering new primers. In addition, missing mates (sequences from clones that only gave one strand reads) were identified and sequenced with ABI technology to allow the identification of additional overlapping contigs.

End-sequencing of randomly picked genomic lambda was also performed. Sequencing on a both sides was done for all lambda sequences. The lambdalibrary backbone helped to verify the integrity of the assembly and allowed closure of some of the physical gaps.

To identify E. faecium polypeptides the complete genomic sequence of E. faecium were analyzed essentially as follows: First, all possible stop-to- stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

Identification, Cloning and Expression of E. faecium Nucleic Acids

Expression and purification of the E. faecium polypeptides of the invention can be performed essentially as outlined below.

To facilitate the cloning, expression and purification of membrane and secreted proteins from E. faecium, a gene expression system, such as the pET System (Novagen), for cloning and expression of recombinant proteins in E. coli, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO: 3654) for cloning from the Mu strain of E. faecium are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native E. faecium DNA sequence. All reverse primers (specific for the 3' end of any E. faecium ORF) include a EcoRI site at the extreme 5' terminus to permit cloning of each E. faecium sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the Mu strain of E. faecium is used as the source of template DNA for PCR amplification reactions (Current Protocols in Molecular Biology, John Wiley and Sons, Inc., F. Ausubel et al.; eds., 1994). To amplify a DNA sequence containing an E. faecium ORF, genomic DNA (50 nanograms) is introduced into a reaction vial containing 2 mM $MgCl_2$, 1 micromolar synthetic oligonucleotide primers (forward and reverse primers) complementary to and flanking a defined E. faecium ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of E. faecium Nucleic Acids Into an Expression Vector

The pET-28b vector is prepared for cloning by digestion with endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria With Recombinant Plasmids

Competent bacteria, E coli strain BL21 or E. coli strain BL21(DE3), are transformed with recombinant pET expression plasmids carrying the cloned E. faecium sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification Of Recombinant Expression Vectors With E. faecium Nucleic Acids

Individual BL21 clones transformed with recombinant pET-28b E. faecium ORFs are analyzed by PCR amplification of the cloned inserts using the same forward and reverse primers, specific for each E. faecium sequence, that were used in the original PCR amplification cloning reactions.

Successful amplification verifies the integration of the *E. faecium* sequences in the expression vector (Current Protocols in Molecular Biology, John Wiley and Sons, Inc., F. Ausubel et al., eds., 1994).

Isolation and Preparation of Nucleic Acids From Transformants

Individual clones of recombinant pET-28b vectors carrying properly cloned *E. faecium* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression Of Recombinant *E. faecium* Sequences in *E. coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *E. faecium* sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the *E. faecium* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *E. faecium* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Orf | NT Seq ID | AA Seq ID | NT Orf length | AA Orf length | Score | Probability | Description |
|---|---|---|---|---|---|---|---|
| 10000308_f3_74 | 1 | 3655 | 294 | 97 | 159 | 8.30E-12 | [ac:s28487][pn:hypothetical protein 3][or:vibrio cholerae][db:pir] |
| 10008462_c3_33 | 2 | 3656 | 183 | 60 | 70 | 0.022 | [ac:p43438][gn:ntph][or:enterococcus hirae][ec:3.6.1.34][de:translocating atpase subunit h][sp:p43438][db:swissprot] |
| 10009818_c1_13 | 3 | 3657 | 771 | 256 | 1015 | 1.60E-102 | [ac:p50918][gn:tpia:tpi][or:lactococcus lactis][sr:subsplactis:streptococcus lactis][ec:5.3.1.1][de:triosephosphate isomerase, (tim)][sp:p50918][db:swissprot] |
| 10017127_f2_48 | 4 | 3658 | 198 | 65 | 51 | 0.041 | [ln:hsbbovherk][ac:m90779][or:bovine herpesvirus 4][sr:bovine herpesvirus type 4 (strain v.test) dna][db:genpept-vrl][de:bovine herpesvirus type 4, partial cds.][nt:herpesvirus saimiri gene 25 homologue (aa 337 to) ][le:<1][re: |
| 10024063_c3_81 | 5 | 3659 | 285 | 94 | 70 | 0.27 | [ln:cfu19489][acc:u19489][pn:glycoprotein ib][or:canis familiaris][sr:dog][db:genpept-mam][de:canis familiaris glycoprotein ib mrna, complete cds.][le:52][re:1752][di:direct] |
| 10035465_c2_51 | 6 | 3660 | 192 | 63 | 70 | 0.022 | [ln:ehy14328][acc:y14328][pn:3el protein][or:entamoeba histolytica][db genpept-inv][de:entamoeba histolytica mrna for 3el protein.][le:32][re:418][di:direct] |
| 10048410_f3_17 | 7 | 3661 | 1335 | 444 | 1779 | 1.80E-183 | [ac:s65968:a42280][pn:adenylosuccinate synthase,:imp-aspartate ligase][gn:pura][cl:adenylosuccinate synthase][or:bacillus subtilis][ec:6.3.4.4][db:pir] |
| 10049155_f2_12 | 8 | 3662 | 330 | 109 | 64 | 0.092 | [ac:d69309][pn:conserved hypothetical protein af0476][or:archaeoglobus fulgidus][db:pir] |
| 10049155_f3_10 | 9 | 3663 | 330 | 109 | 64 | 0.092 | [ac:d69309][pn:conserved hypothetical protein af0476][or:archaeoglobus fulgidus][db:pir] |
| 10162932_f2_13 | 10 | 3664 | 195 | 64 | 48 | 0.21 | [ln:dmotch6][ac:y10354][pn:notch receptor protein][gn:notch6][or:danio rerio][sr:zebrafish][db:genpept-vrt][de:d.rerio notch6 mrna.][le:<1][re: |
| 10163187_c1_65 | 11 | 3665 | 981 | 326 | 829 | 8.30E-83 | [ln:cccubcde][ac:x88849][gn:ceub][or:campylobacter coli][db:genpept-bct][de:c.coli ccub, ccuc, ccud, ccue, orfa, orfb genes.][nt:ttg start][le:24][re:992][di:direct] |
| 10177177_c3_55 | 12 | 3666 | 855 | 284 | 428 | 2.60E-40 | [ac:q06174][gn:est][or:bacillus stearothermophilus][ec:3.1.1.1][de:carboxylesterase precursor,][sp:q06174][db:swissprot] |
| 10187510_c2_20 | 13 | 3667 | 630 | 209 | 316 | 1.90E-28 | [ln:hau70664][acc:u70664][pn:2-dehydro-3-deoxyphosphogluconate aldolase][or:haloferax alicantei][db:genpept-bct][de:haloferax alicantei 2 dehydro-3-deoxyphosphogluconate aldolase, 2-keto-3-deoxygluconate kinase, beta-d-galactosidase (bgah) genes,comple |
| 10188887_f3_24 | 14 | 3668 | 258 | 85 | 68 | 0.1 | [ln:mplnirdhom][ac:122217][or:mycoplasma-like organism][db:genpept-bct][de:mycoplasma-like organism apple proliferation, strain atnitroreductase like protein gene, complete cds.][nt:this orf is homologous to a 40.0 kd hypothetical][le:1233][re: |
| 10195277_f3_20 | 15 | 3669 | 261 | 86 | 66 | 0.0015 | [ac:p39005][gn:kre9:yj1174w:j0504][or:saccharomyces cerevisiae][sr:baker's yeast][de:cell wall synthesis protein kre9 precursor][sp:p39005][db:swissprot] |
| 10234432_c3_81 | 16 | 3670 | 1053 | 350 | 784 | 4.90E-78 | [ln:af034786][ac:af034786][pn:specificity subunit][gn:hsds][fn:lldi type i restriction modification][or:lactococcus lactis bv. diacetylactis][db:genpept-bct][de:lactococcus lactis bv. diacetylactis, plasmid pnd861, lldi type irestriction subunit (h |

TABLE 2-continued

| Orf | NT Seq ID | AA Seq ID | NT Orf length | AA Orf length | Score | Probability | Description |
|---|---|---|---|---|---|---|---|
| 10234432_f1_14 | 17 | 3671 | 849 | 282 | 358 | 6.70E-33 | [acc:s57909][pn:probable histidine protein kinase sppk][gn:sppk][or:*lactobacillus sake*][dbpir] |
| 10236387_c3_46 | 18 | 3672 | 1410 | 469 | 910 | 2.20E-91 | [n:spu16156][acc:u16156:m17362:m58706][pn:dihydrofolate synthetase][gn:sulb][fn:folate biosynthesis][or:*streptococcus pneumoniae*][db:genpept-bct][de:*streptococcus pneumoniae* dihydropteroate synthase (sula), dihydrofolate synthetase (sulb), guanosine |
| 10238507_f3_113 | 19 | 3673 | 1200 | 399 | 386 | 7.30E-36 | [n:btu22342][acc:u22342][pn:integrase][gn:int][or:bacteriophage t270][db:genpept-vrl][de:bacteriophage t270 integrase (int) gene, complete cds.][nt:excisionase][[e:286][re:1374][di:direct] |
| 10241011_c1_193 | 20 | 3674 | 672 | 223 | 410 | 2.10E-38 | [acc:a69372][pn:ammonium transporter (amt-1) homolog][or:*archaeoglobus fulgidus*][dbpir] |
| 10253143_f2_19 | 21 | 3675 | 696 | 231 | 759 | 2.20E-75 | [acc:p27143][gn:adk][or:*lactococcus lactis*][sr:subsplactis:*streptococcus lactis*][cc:2.7.4.3][de:adenylate kinase, (atp-amp transphosphorylase)][sp:p27143][db:swissprot] |
| 10289012_f3_24 | 22 | 3676 | 273 | 90 | 67 | 0.0094 | [acc:a5713][pn:collagen alpha 2(viii)chain][gn:col8a2][cl:collagen alpha 1(viii) chain:complement clq carboxyl-terminal homology][or:*homo sapiens*][sr:man][db:pir][mp: 1p34.3-1p32.3] |
| 10289713_c2_25 | 23 | 3677 | 1986 | 661 | 2682 | 3.60E-279 | [acc:q54986][gn:uvrb:uvs402][or:*streptococcus pneumoniae*][de:excinuclease abe subunit b][sp:q54986][db:swissprot] |
| 10289812_f3_21 | 24 | 3678 | 1569 | 522 | 76 | 0.027 | [acc:64432][pn:hypothetical protein mj1060][or:*methanococcus jannaschii*][dbpir][mp:for1000459-1002072] |
| 10291418_f1_1 | 25 | 3679 | 1488 | 495 | 373 | 1.70E-34 | [acc:p55504][gn:y4jd][or:rhizobium sp][sr:ngr234.][de:hypothetical 56.7 kd protein y4jd][sp:p55504][db:swissprot] |
| 10320431_f3_36 | 26 | 3680 | 198 | 65 | 76 | 0.078 | [n:spac3 1 f12][acc:z99166][pn:ubiquitin fusion degradation protein][gn:spac3 1 f12.02c][or:*schizosaccharomyces pombe*][sr:fission yeast][db:genpept-pln][de:*s.pombe* chromosome i cosmid c3 1 f1 2.][nt:spac3 1 f12.02c, probable ubiquitin fusion][[e:2724][re |
| 10330291_c3_70 | 27 | 3681 | 270 | 89 | 248 | 5.00E-21 | [acc:p35881][or:*lactococcus lactis*][sr:subsplactis:*streptococcus lactis*][de:transposase for insertion sequence element is905][sp:p35881][db:swissprot] |
| 10343953_c1_122 | 28 | 3682 | 708 | 235 | 230 | 4.60E-23 | [acc:p09915][or:bacteriophage rho-11s][ec:2.1.1.73][de:methyltransferase bsu p114s][sp:p0991 5][db:swissprot] |
| 10392211_f1_3 | 29 | 3683 | 1071 | 356 | 354 | 1.80E-32 | [acc:p44992][gn:hi1028][or:*haemophilus influenzae*][de:hypothetical protein hi1028 precursor][sp:p44992][db:swissprot] |
| 10393837_c1_187 | 30 | 3684 | 1068 | 355 | 903 | 1.20E-90 | [acc:p25887:q46852][gn:ygha][or:*escherichia coli*][ec: 1.—.—.—][de:(ec 1.—.—.—.—)][sp:p25887;q46852][db:swissprot] |
| 10407558_f1_1 | 31 | 3685 | 219 | 72 | 264 | 6.20E-23 | [acc:p27078][gn:int][or:bacteriophage 434][de:integrase][sp:p27078][db:swissprot] |
| 10408888_c3_57 | 32 | 3686 | 273 | 90 | 265 | 4.80E-23 | [acc:p37557][gn:yabo][or:*bacillus subtilis*][de:hypothetical 9.7 kd protein in mfd-divic intergenic region][sp:p37557][db:swissprot] |
| 10414680_f2_5 | 33 | 3687 | 1056 | 351 | 429 | 2.00E-40 | [acc:q27546][gn:iunh][or:*crithidia fasciculata*][ec:3.2.2.1][de:(u-nucleoside hydrolase) (purine nucleosidase)][sp:q27546][db:swissprot] |
| 10423177_c3_70 | 34 | 3688 | 543 | 180 | 55 | 0.94 | [acg07490][gn:cd24a][or:*rattus norvegicus*][sr:rat][de:(nectadrin)][sp:q07490][db:swissprot] |

TABLE 2-continued

| Orf | NT Seq ID | AA Seq ID | NT Orf length | AA Orf length | Score | Probability | Description |
|---|---|---|---|---|---|---|---|
| 10430450_c3_72 | 35 | 3689 | 282 | 93 | 99 | 1.90E-05 | [ac:f69542][pn:conserved hypothetical protein af2342][or:*archaeoglobus fulgidus*][db:pir] |
| 10444207_f3_48 | 36 | 3690 | 237 | 78 | 68 | 0.16 | [ln:cef40f9][ac:z70753][pn:f40f9.1][or:*caenorhabditis elegans*][db:genpept-inv][de:*caenorhabditis elegans* cosmid f40f9, complete sequence][nt:similar to n-methyl-d-aspartate receptor associated][le:2986:3179:3319:3466][re:3129:3273:3409:3605][di: |
| 1048952_f3_37 | 37 | 3691 | 222 | 73 | 59 | 0.05 | [ln:cew06g6][ac:z83129][pn:w06g6.b][or:*caenorhabditis elegans*][db:genpept-inv][de:*caenorhabditis elegans* cosmid w06g6, complete sequence.][nt:protein predicted using genefinder; preliminary][le:29383:29914:30460][re:29661.30412.30638][di:compleme |
| 1053463_c1_34 | 38 | 3692 | 1278 | 425 | 425 | 5.40E-40 | [ac:q06240][gn:vans][or:*enterococcus faecium*][sr:,*streptococcus faecium*][cc:2.7.3.—][de:(vancomycin histidine protein kinase)][sp:q06240][db:swissprot] |
| 1054050_c3_57 | 39 | 3693 | 2268 | 755 | 2325 | 2.50E-241 | [acc:69794][pn:atp-dependent dna helicase homolog yerf][gn:yerf][or:*bacillus subtilis*][db:pir] |
| 1054687_c3_79 | 40 | 3694 | 372 | 123 | 106 | 8.20E-06 | [ac:f69921][pn:conserved hypothetical protein yoqw][gn:yoqw][or:*bacillus subtilis*][db:pir] |
| 1054713_c1_11 | 41 | 3695 | 258 | 85 | 62 | 0.29 | [ln:msgtcwpa][ac:m15467][pn:unknown protein][or:*mycobacterium tuberculosis*][sr:*mycobacterium tuberculosis* (strain erdman) dna][db:genpept-bct][de:m.tuberculosis 65 kda antigen (cell wall protein a) gene.][nt:orf d158; putative][le:1194][re:1670] |
| 1054827_f2_9 | 42 | 3696 | 681 | 226 | 305 | 2.80E-27 | [ac:h69830][pn:conserved hypothetical protein yhfk][gn:yhfk][or:*bacillus subtilis*][db:pir] |
| 1054902_f2_5 | 43 | 3697 | 720 | 239 | 74 | 0.034 | [ln:llphig1e][acx:98106][gn:rorf58][or:bacteriophage phig 1 e][db:genpept-phg][de:*lactobacillus bacteriophage* phig 1 e complete genomic dna.][le:42253:1][re:42259:170][di:complementjoin] |
| 10553593_f2_30 | 44 | 3698 | 300 | 99 | 157 | 1.30E-11 | [ac:s76074][pn:hypothetical protein][or:*synechocystis* sp.][sr:pcc 6803, , pcc 6803.][srp:pcc 6803.][db:pir] |
| 1055442_c1_86 | 45 | 3699 | 525 | 174 | 191 | 3.40E-15 | [ac:p37081][gn:sorb][or:*klebsiella pneumoniae*][cc:2.7.1.69][de:(cc 2.7.1.69) (eiii-b-sor)][sp:p37081][db:swissprot] |
| 1054630_f2_50 | 46 | 3700 | 360 | 119 | 108 | 1.00E-05 | [ln:spbc3d5][ac:95620][pn:unknown][gn:spbc3ds.14c][or:*schizosaccharoinyces pombe*][sr:fission yeast][db:genpept-pln][dcs.pombe chromosome ii cosmid c3d5.][nt:spbc3d5.14c, unknown; partial; serine rich,][le:31398][re: |
| 10556330_c1_115 | 47 | 3701 | 201 | 66 | 53 | 0.64 | [acc:55205][pn:integrase][gn:int][or:*lactococcus lactis*][db:pir] |
| 10557213_c1_58 | 48 | 3702 | 654 | 217 | 69 | 0.98 | [ac:p36958][gn:rpii15][or:*drosophila metanogaster*][sr:fruit fly][ec:2.7.7.6][de:dna-directed ma polymerase ii 15.1 kd polypeptide,][sp:36958][db:swissprot] |
| 10562681_f1_5 | 49 | 3703 | 372 | 123 | 77 | 0.25 | [ac:pc2022][pn:mucin like protein muc2 precursor:apoprotein][gn:muc2][or:*rattus norvegicus*][sr:, norway rat][db:pir][mp:1] |
| 10563452_f1_8 | 50 | 3704 | 240 | 79 | 61 | 0.16 | [ln:rnu35025][ac:u35025][pn:activin receptor-like kinase 7][gn:alk7][or:*rattus norvegicus*][sr: norway rat][db:genpept-rod][de: rattus norvegicus activin receptor-like kinase 7 (alk7) mrna, complete cds.][le:32][re: 1513][di:direct] |

TABLE 2-continued

| Orf | NT Seq ID | AA Seq ID | NT Orf length | AA Orf length | Score | Probability | Description |
|---|---|---|---|---|---|---|---|
| 1056515_c1_121 | 51 | 3705 | 438 | 145 | 539 | 4.50E-52 | [ln:strmtr][ac:129323][pn:methyl transferase][or:streptococcus pneumoniae][sr:transposon tn5252 dna; and streptococcus pneumoniae (strain sp1000][db:genpept-bet][de:streptococcus pneumoniae methyl transferase (mtr) gene cluster,complete cds.][nt:me |
| 1056686_f2_56 | 52 | 3706 | 213 | 70 | 66 | 0.032 | [acs23532][pn:hypothetical protein 482][or:cylindrotheca fusiformis][db:pir] |
| 1056712_c1_10 | 53 | 3707 | 564 | 187 | 104 | 0.0026 | [ac:b45600:s27828][pn:asparagine-rich blood stage antigen (clone pfa55-6)][or:plasmodium falciparum][db:pir] |
| 10570937_c3_48 | 54 | 3708 | 1512 | 503 | 208 | 4.50E-15 | [ln:llpk214][ac:x92946;y10522][pn:hypothetical protein][gn:orf6][or:lactococcus lactis][db:genpept-bet][de:lactobacillus lactis plasmid pk214, complete sequence.][le:2610][re:3554][di:direct] |
| 10572836_f2_23 | 55 | 3709 | 834 | 277 | 782 | 7.90E-78 | [acs69742][pn:hypothetical protein ybaf][gn:ybaf][or:bacillus subtilis][db:pir] |
| 10578125_f3_11 | 56 | 3710 | 870 | 289 | 460 | 1.00E-43 | [acs53879][pn:hypothetical protein 1][or:lactococcus lactis subsp. lactis biovar diacetylactis][db:pir] |
| 10583125_c2_137 | 57 | 3711 | 651 | 216 | 97 | 0.0061 | [ac:p39897][gn:mtr][or:neisseria gonorrhoeae][de:regulatory protein mtr][sp:p39897][db:swissprot] |
| 1058427_c3_57 | 58 | 3712 | 1182 | 393 | 1207 | 7.30E-123 | [ac:p50840][gn:yspc][or:bacillus subtilis][de:hypothetical 43.5 kd protein in cotd-kdud intergenic region precursor][sp:p50840][db:swissprot] |
| 10585010_f3_78 | 59 | 3713 | 669 | 222 | 74 | 0.03 | [ln:hummucac][ac:m55406][pn:mucin][gn:muc-3][or:homo sapiens][sr:human small intestine, cdna to mrna, clone sib 139][db:genpept-pri1][de:human intestinal mucin (muc-3) mrna, partial cds.][le:1][re:259][di:direct] |
| 10585375_f3_19 | 60 | 3714 | 2748 | 915 | 355 | 1.90E-29 | [ln:rmu67998][ac:u67998][pn:cyclic beta-1,2-glucan modification protein][gn:cgma][fn:transfers sn-1 phosphoglycerol substituents to][or:sinorhizobium meliloti][db:genpept-bet][de:sinorhizobium meliloti orf1 and cyclic beta-1,2-glucan modificationpr |
| 1058562_c1_8 | 61 | 3715 | 681 | 226 | 303 | 4.50E-27 | [ac:670045][pn:hypothetical protein yypb][gn:yypb][or:bacillus subtilis][db:pir] |
| 1058562_c3_33 | 62 | 3716 | 3213 | 1070 | 1584 | 8.20E-163 | [ln:bex98455][ac:x98455][gn:snf][or:bacillus cereus][db:genpept-bct][de:b.cereus orf1 and snf2 gene.][le:1471][re:4665][di:direct] |
| 1058593_c2_53 | 63 | 3717 | 1632 | 543 | 709 | 4.30E-70 | [ac:p37555][gn:yabm][or:bacillus subtilis][de:hypothetical 57.4 kd protein in mfd-divic intergenic region][sp:p37555][db:swissprot] |
| 10586391_c1_77 | 64 | 3718 | 204 | 67 | 75 | 0.039 | [ln:af005383][ac:af005383][pn:putative transport protein][gn:xyng][or:caldicellulosiruptor saccharolyticus][db:genpept-bct][de:caldicellulosiruptor saccharolyticus putative transport protein(xyng), putative transport protein (xynh), xylanase (xynf), |
| 10600628_f2_15 | 65 | 3719 | 276 | 91 | 90 | 0.00074 | [ln:mtu19362][ac:u19362][pn:unknown][or:methanobacterium thermoautotrophicum][db:genpept-bet][de:methanobacterium thermoautotrophicummethylene-tetrahydromethanopterin dehydrogenase (mtd),imidazoleglycerol-phosphate dehydrogenase (hisb), and putativef |
| 10625250_c3_8 | 66 | 3720 | 1023 | 340 | 140 | 4.70E-07 | [ac:p27126][gn:rfas][or:escherichia coli][de:lipopolysaccharide core biosynthesis protein rfas][sp:p27126][db:swissprot] |

TABLE 2-continued

| Orf | NT Seq ID | AA Seq ID | NT Orf length | AA Orf length | Score | Probability | Description |
|---|---|---|---|---|---|---|---|
| 10625291_f2_10 | 67 | 3721 | 216 | 71 | 63 | 0.21 | [ac:q10060][gn:spac1f5.05c][or:schizosaccharomyces pombe][sr:fission yeast][de:hypothetical 16.7 kd protein c15.05c in chromosome i][sp:q10060][db:swissprot] |
| 10626637_c1_42 | 68 | 3722 | 363 | 120 | 81 | 0.047 | [ac:q58005][gn:mj0585][or:methanococcus jannaschii][de:hypothetical protein mj0585][sp:q58005][db:swissprot] |
| 10626637_c3_122 | 69 | 3723 | 195 | 64 | 55 | 0.053 | [ac:p23293][gn:sgv1.bur1.ypr161c.p9584.8][or:saccharomyces cerevisiae][sr:baker's yeast][cc:2.7.1.—][de:serine/threonine protein kinase sgv1.][sp:p23293][db:swissprot] |
| 10626637_f3_15 | 70 | 3724 | 360 | 119 | 81 | 0.08 | [ac:p20896][gn:g][or:human respiratory syncytial virus][sr:subgroup b/18537,][de:major surface glycoprotein g (attachment glycoprotein g)][sp:p20896][db:swissprot] |
| 10631562_f2_21 | 71 | 3725 | 312 | 103 | 64 | 0.91 | [ln:adtavl][ac:x03001:v01485:x00207][or:tupaia adenovirus][db:genpept-vrl][de:tupaia adenovirus left end containing eia gene.][nt:open reading frame 1][sp:p06439][le:450][re:863][di:direct] |
| 10632792_c2_31 | 72 | 3726 | 897 | 298 | 690 | 4.40E-68 | [ac:p42400][gn:yckb][or:bacillus subtilis][de:(orf2)][sp:p42400][db:swissprot] |
| 10636557_c3_18 | 73 | 3727 | 426 | 141 | 223 | 1.40E-18 | [ac:p26942][gn:ysxb][or:bacillus subtilis][de:hypothetical 12.3 kd protein in rplu-rpma intergenic region (orfx)][sp:p26942][db:swissprot] |
| 10640925_f3_14 | 74 | 3728 | 186 | 61 | 68 | 0.036 | [ln:hrstcrdg][ac:138399][gn:tcrd][or:equus caballus][sr:equus caballus (clone: d13) cdna to mrna][db:genpept-mam][de:equus caballus (clone d13) t cell receptor delta (tcrd) mrna, vdjregion.][nt:this cds feature is included to show the][le:<150][r |
| 10641043_f3_6 | 75 | 3729 | 390 | 129 | 117 | 2.30E-07 | [ln:ehy14328][ac:y14328][pn:3el protein][or:entamoeba histolytica][db:genpept-inv][de:entamoeba histolytica mrna for 3el protein.][le:32][re:418][di:direct] |
| 1064217_c3_86 | 76 | 3730 | 648 | 215 | 88 | 0.078 | [ac:d69991][pn:conserved hypothetical protein yteu][gn:yteu][or:bacillus subtilis][db:pir] |
| 10649135_f1_2 | 77 | 3731 | 312 | 103 | 48 | 1 | [ln:af003534][ac:af003534][pn:putative small basic protein][or:chilo iridescent virus][db:genpept-vrl][de:chilo iridescent virus partial genomic sequence.][nt:protein 0371][le:18525][re:18698][di:complement] |
| 10657301_f1_2 | 78 | 3732 | 933 | 310 | 359 | 5.30E-33 | [ln:ttu42226][ac:u42226:u12417:x15371][or:transposon tn21][dbgenpept-una][de:integron in2 found in tn21 (shigella flexneri) sulphonamideresistant dihydropteroate synthase (sul 1), istb (istb), ista(ista), tnibdelta1 (tnibdelta1) and tnia (tnia) genes, |
| 10664213_c3_275 | 79 | 3733 | 915 | 304 | 482 | 4.90E-46 | [ln:efgls24b][ac:aj000042][gn:gls24][or:enterococcus faecalis][db:genpept-bct][de:enterococcus faecalis gls24, glsb genes.][le:310][re:852][di:direct] |
| 10664787_c2_62 | 80 | 3734 | 813 | 270 | 932 | 1.00E-93 | [ac:p12047][gn:purb:pure][or:bacillus subtilis][ec:4.3.2.2][de:adenylosuccinate lyase, (adenylosuccinase) (asl)][sp:p12047][db:swissprot] |
| 10672637_f1_3 | 81 | 3735 | 306 | 101 | 55 | 0.58 | [ac:561480][pn:glucose-1-phosphate adenylyltransfera, small chain a:adp-glucose pyrophosphorylase][cl:glucose-1-phosphate adenylyltransferase][or:hordeum vulgare][sr:, barley][ec:2.7.7.27][db:pir] |

TABLE 2-continued

| Orf | NT Seq ID | AA Seq ID | NT Orf length | AA Orf length | Score | Probability | Description |
|---|---|---|---|---|---|---|---|
| 10678942_c2_26 | 82 | 3736 | 255 | 84 | 72 | 0.082 | [ln:af020765][ac:af020765][pn:hypothetical protein][fn:unknown][or:myxococcus xanthus][db:genpept-bct][de:myxococcus xanthus hypothetical protein gene complete cds.][nt:orf1; lies upstream of the pilb,t,c,s,r,a,g,h,i,d][le:160][re:1083][di:dir |
| 1069027_c3_68 | 83 | 3737 | 756 | 251 | 508 | 8.60E-49 | [ac:g70066][pn:capsular polysaccharide biosynthesis homolog ywqd][gn:ywqd][or:bacillus subtilis][db:pir] |
| 1071067_c2_104 | 84 | 3738 | 684 | 227 | 317 | 1.50E-28 | [ac:p08188][gn:manz:ptsm-gptb][or:escherichia coli][de:(eii-m-man)][sp:p08188][db:swissprot] |
| 10718752_c3_17 | 85 | 3739 | 474 | 158 | 393 | 1.30E-36 | [ln:af030359][ac:af030359][pn:dtdp-1-rhamnose synthase][gn:cpso][or:streptococcus pneumoniae][db:genpept-bct][de:streptococcus pneumoniae strain nctc11906 glucose-1-phosphatethymidyl transferase (cpsl) gene, partial cds; anddtdp-4-keto-6-deoxyglucos |
| 10719675_c3_129 | 86 | 3740 | 351 | 116 | 93 | 8.10E-05 | [ln:bbu45421][ac:u45421][gn:rep-][or:borrelia burgdorferi][sr:lyme disease spirochete strain=297][db:genpept-bct][de:borrelia burgdorferi 2.9-1 locus, orf 5-8 orf-a-d, rep+, rep[31 , andlipoprotein (lp) genes, complete cds.][nt:minus strand repeat mo |
| 10720380_f2_22 | 87 | 3741 | 879 | 292 | 874 | 1.40E-87 | [ac:p18255][sp:p06570][gn:thrs:thrsv][or:bacillus subtilis][cc:6.1.1.3][de:(thrrs)][sp:p18255:p06570][db:swissprot] |
| 10722952_c3_25 | 88 | 3742 | 297 | 98 | 109 | 1.80E-06 | [ac:p54433][gn:yxkf][or:bacillus subtilis][de:hypothetical 20.7 kd protein in bltr-spoiic intergenic region][sp:p54433][db:swissprot] |
| 10723763_c3_204 | 89 | 3743 | 1026 | 341 | 1302 | 6.20E-133 | [ac:p43456][gn:ntpc:ntpp][or:enterococcus hirae][cc:3.6.1.34][de:translocating atpase subunit c)][sp:p43456][db:swissprot] |
| 10727187_c3_58 | 90 | 3744 | 459 | 152 | 122 | 6.90E-08 | [ac:p37471][gn:divic:diva][or:bacillus subtilis][de:cell division protein divic][sp:p37471][db:swissprot] |
| 10729700_c3_135 | 91 | 3745 | 507 | 168 | 367 | 7.50E-34 | [ac:e70019][pn:mifu protein homolog yurv][gn:yurv][or:bacillus subtilis][db:pir] |
| 10735930_c3_301 | 92 | 3746 | 816 | 271 | 269 | 1.80E-23 | [ln:eay14603][ac:y14603][pn:repressor of srl operon][gn:srlr][or:erwinia amylovora][db:genpept-bct][de:erwinia amylovora srla, srle, srlb, srld, srlm and srlr genes.][le:3536][re:4303][di:direct] |
| 10739125_f3_16 | 93 | 3747 | 357 | 118 | 59 | 0.32 | [ln:hsu39118][ac:u39118][pn:t cell receptor alpha chain][or:homo sapiens][sr:human][db:genpept-pri2][de:human t cell receptor alpha chain mrna, partial cds.][le:<1][re: |
| 10739667_c1_51 | 94 | 3748 | 507 | 168 | 215 | 1.10E-16 | [ac:p54745][gn:hrsa][or:escherichia coli][cc:2.7.1.69][de:hrsa protein,][sp:p54745][db:swissprot] |
| 10742263_c3_80 | 95 | 3749 | 2004 | 667 | 711 | 2.60E-70 | [ac:f69848][pn:transcriptional antiterminator (bglg famil) homolog yjdc][gn:yjdc][or:bacillus subtilis][db:pir] |
| 10744042_c1_34 | 96 | 3750 | 2298 | 765 | 1943 | 7.40E-201 | [ac:s68603:s45077:s45078][pn:hypothetical protein gamma][gn:gamma][or:streptococcus pyogenes][db:pir] |
| 10745286_f1_5 | 97 | 3751 | 270 | 89 | 86 | 0.00045 | [ac:f69909][pn:thioredoxin homolog yoii][gn:yoii][or:bacillus subtilis][db:pir] |
| 10745682_f2_43 | 98 | 3752 | 999 | 332 | 515 | 1.60E-49 | [ac:a70082][pn:abc transporter (atp-binding protein) homolog yxlf][gn:yxlf][or:bacillus subtilis][db:pir] |
| 10751561_c2_95 | 99 | 3753 | 2808 | 935 | 957 | 2.30E-96 | [ac:p23914][gn:levr][or:bacillus subtilis][de:transcriptional regulatory protein levr][sp:p23914][db:swissprot] |
| 1077_c3_158 | 100 | 3754 | 1128 | 375 | 322 | 4.40E-29 | [ln:lbphig1e][ac:x98106][pn:integrase][gn:int][or:bacteriophage phig1e][db:genpept-phg][de:lactobacillus bacteriophage phig1e complete genomic dna.][le:2948][re:4123][di:direct] |
| 1077_c3_22 | 101 | 3755 | 759 | 252 | 149 | 1.80E-08 | [ac:s67570][pn:hypothetical protein yd1037c:hypothetical protein d2734][or:saccharomyces cerevisiae][db:pir][mp:41] |

TABLE 2-continued

| Orf | NT Seq ID | AA Seq ID | NT Orf length | AA Orf length | Score | Probability | Description |
|---|---|---|---|---|---|---|---|
| 10800307_f1_48 | 102 | 3756 | 228 | 75 | 77 | 0.05 | [ac:p25568][gn:ycl38c][or:*saccharomyces cerevisiae*][sr:baker's yeast][de:hypothetical 58.8 kd protein in glk-1-sro9 intergenic region][sp:p25568][db:swissprot] |
| 10805280_f2_4 | 103 | 3757 | 414 | 137 | 425 | 5.40E-40 | [ac:p71447][or:*lactococcus lactis*][sr:,subsplactis:*streptococcus lactis*][ec:5.4.2.6][de:beta-phosphoglucomutase,][sp:p71447][dbswissprot] |
| 10814188_f1_9 | 104 | 3758 | 1239 | 412 | 89 | 0.15 | [ac:p43557][gn:yft046w][or:*saccharomyces cerevisiae*][sr:baker's yeast][de:hypothetical 24.0 kd protein in cmp47-sec53 intergenic region][sp:p43557][db:swissprot] |
| 10817785_c1_44 | 105 | 3759 | 990 | 329 | 898 | 4.00E-90 | [ac:a69626][pn:methionyl-trna formyltransferase fmt][gn:fmt][or:*bacillus subtilis*][db:pir] |
| 10824012_c1_59 | 106 | 3760 | 1383 | 460 | 882 | 2.00E-88 | [in:bfti61539][ac:u61539:m73530][pn:na+/h+ antiporter][gn:nhac][fn:ph homeostasis; sodium extrusion][or:*bacillus firmus*][db:genpept-bct][de:*bacillus firmus* orfa gene, partial cds, and na+/h+ antiporter(nhac), nahs (nahs), orfb, orfc, and orfd genes, complete cds.][le:292][re:1143][di:direct] |
| 10828140_f3_52 | 107 | 3761 | 807 | 268 | 416 | 4.80E-39 | [ac:a69988][pn:conserved hypothetical protein ytag][gn:ytag][or:*bacillus subtilis*][db:pir] |
| 10828430_c1_6 | 108 | 3762 | 537 | 178 | 106 | 0.0005 | [in:af010134][ac:af010134][pn:putative sporulation protein][fn:unknown][or:*streptomyces aureofaciens*][db:genpept-bct][de:*streptomyces aureofaciens* putative sporulation protein gene, complete cds.][le:292][re:1143][di:direct] |
| 10829218_f3_1 | 109 | 3763 | 519 | 173 | 287 | 2.30E-25 | [ac:a69992][pn:conserved hypothetical protein yffp][gn:yffp][or:*bacillus subtilis*][db:pir] |
| 10829840_c3_57 | 110 | 3764 | 1317 | 438 | 1394 | 1.10E-142 | [ac:p37464][gn:sers][or:*bacillus subtilis*][ec:6.1.1.11][de:seryl-trna synthetase, (serine--trna ligase) (serrs)][sp:p37464][db:swissprot] |
| 10831313_f1_1 | 111 | 3765 | 375 | 124 | 518 | 7.50E-50 | [ac:q47744][gn:vanb][or:*enterococcus faecalis*][sr:,*streptococcus faccalis*][de:regulatory protein vanrb][sp:q47744][db:swissprot] |
| 10831952_f1_11 | 112 | 3766 | 1212 | 403 | 1541 | 2.90E-158 | [ac:p37949][gn:lepa][or:*bacillus subtilis*][de:gtp-binding protein lepa][sp:p37949][db:swissprot] |
| 10839718_c3_72 | 113 | 3767 | 1185 | 394 | 324 | 3.50E-29 | [ac:a69745][pn:hypothetical protein ybbr][gn:ybbr][or:*bacillus subtilis*][db:pir] |
| 10937713_c2_7 | 114 | 3768 | 210 | 69 | 53 | 0.04 | [ac:p32445][gn:rim1.ycr29c-a][or:*saccharomyces cerevisiae*][sr:,baker's yeast][de:mitochondrial single-stranded dna-binding protein rim 1 precursor][sp:p32445][db:swissprot] |
| 10937807_f1_3 | 115 | 3769 | 1083 | 360 | 409 | 2.70E-38 | [ac:a69661][pn:transcriptional regulator msmr][gn:msmr][or:*bacillus subtilis*][db:pir] |
| 10938292_f1_2 | 116 | 3770 | 345 | 114 | 72 | 0.3 | [in:mtrcp][ac:x63508][or:*m.tuberculosis*][de:*m.tuberculosis* gc rich repetitive dna.][nt:predicted orf][le:251][re:703][di:direct] |
| 10940688_c2_223 | 117 | 3771 | 780 | 259 | 148 | 4.50E-09 | [ln:lpatovgns][ac:x94434][pn:plnu][gn:plnu][fn:unknown][or:*lactobacillus plantarum*][db:genpept-bct][de:*l.plantarum* pln[a,b,c,d,e,f,g,h,i,j,k,i,m,n,o,p,r,s,t,u,v]genesand orf1.][nt:putative][le:15253][re:15921][di:direct] |
| 10948376_f1_5 | 118 | 3772 | 324 | 107 | 53 | 0.78 | [in:hssphar][ac:x82554][gn:sphar][or:*homo sapiens*][sr:human][db:genpept-pri2][de:*h.sapiens* sphar gene for cyclin-related protein.][sp:q15513][le:1164][re:1355][di:direct] |
| 10972158_f1_1 | 119 | 3773 | 1050 | 349 | 1206 | 9.30E-123 | [ac:c69785][pn:cellobiose phosphotransferase system enzym homolog ydho][gn:ydho][or:*bacillus subtilis*][db:pir] |

TABLE 2-continued

| Orf | NT Seq ID | AA Seq ID | NT Orf length | AA Orf length | Score | Probability | Description |
|---|---|---|---|---|---|---|---|
| 10989192_c3_9 | 120 | 3774 | 729 | 242 | 539 | 4.50E-52 | [ac:d69588][pn:transcriptional repressor of the arabinose operon arar][gn:arar][or:bacillus subtilis][db:pir] |
| 11016590_c1_102 | 121 | 3775 | 708 | 235 | 476 | 2.10E-45 | [ln:sau73374][ac:u73374][pn:cap8m][or:staphylococcus aureus][db:genpept-bct][de:staphylococcus aureus type 8 capsule genes, cap8a, cap8b, cap8c,cap8d, cap8e, cap8f, cap8g, cap8h, cap8i, cap8j, cap8k, cap8l,cap8m, cap8n, cap8o, cap8p, compl |
| 11017326_f1_5 | 122 | 3776 | 243 | 80 | 68 | 0.056 | [in:hpac000108][ac:ac000108][pn:orf2][or:helicobacter pylori][db:genpept-bct][de:h. pylori chromosomal—fragment 38.5kb, complete sequence.][nt:orf2 - probable transmembrane regions @ aa 18-36;][le:155][re:595][di:complement] |
| 11039067_c3_146 | 123 | 3777 | 1137 | 378 | 635 | 3.00E-62 | [ac:p23861][gn:potd][or:escherichia coli][de:spermidine/ putrescine-binding periplasmic protein precursor (spbp)] [sp:p23861][db:swissprot] |
| 11110682_f2_21 | 124 | 3778 | 243 | 80 | 59 | 0.023 | [ac:s28473][pn:rfbh protein][gn:rfbh][or:vibrio cholerae][db:pir] |
| 11125067_f3_11 | 125 | 3779 | 657 | 219 | 520 | 4.60E-50 | [ac:p39779][gn:cody][or:bacillus subtilis][de:cody protein] [sp:p39779][db:swissprot] |
| 11125132_f3_16 | 126 | 3780 | 990 | 329 | 76 | 0.0074 | [ac:p42377][or:lactoococcus lactis][sr:subsplactis:streptococcus lactis][de:hypothetical 70.0 kd protein in dnak 3'region (orf4)] [sp:p42377][db:swissprot] |
| 11125188_c3_29 | 127 | 3781 | 204 | 67 | 68 | 0.00032 | [ln:mmu93583][ac:u93583][pn:rab22][or:mus musculus][sr:house mouse][db:genpept-rod][de:mus musculus rad51-binding protein rab22 mrna, complete cds.][nt:rad51-binding protein][le:44] [re:1057][di:direct] |
| 11147675_f2_30 | 128 | 3782 | 939 | 312 | 422 | 1.10E-39 | [ln:cftu63997][ac:u63997][or:enterococcus faccium][db: genpept-bct][de:enterococcus faccium insertion sequence is 476 putative transposasegene, complete cds.][nt:putative transposase] [le:140][re:1414][di:direct] |
| 11176665_c2_12 | 129 | 3783 | 1041 | 346 | 873 | 1.80E-87 | [ac:p50989][gn:oppb][or:lactoococcus lactis][sr:subsperemoris: streptococcus cremoris][de:oligopeptide transport system permease protein oppb][sp:p50989][db:swissprot] |
| 11182836_c3_121 | 130 | 3784 | 249 | 82 | 57 | 0.89 | [ln:s79219][ac:s79219][gn:metastasis-associated gene][or:homo sapiens][sr:human highly metastatic lung cell subline anip[937]] [db:genpept-pri2][de:metastasis-associated gene [human, highly metastatic lung cell subline anip[937]], mrna partial, 978 nt] |
| 1198466_c3_56 | 131 | 3785 | 1290 | 429 | 955 | 3.70E-96 | [ac:c69878][pn:dna-binding sun protein homolog ylom][gn:ylom] [or:bacillus subtilis][db:pir] |
| 11203413_c3_78 | 132 | 3786 | 240 | 79 | 66 | 0.12 | [ac:f64714][pn:flagellar basal-body rod protein][or:helicobacter pylori][db:pir] |
| 11206590_c1_20 | 133 | 3787 | 705 | 234 | 113 | 1.30E-05 | [ac:d69163][pn:hypothetical protein mth483][gn:mth483][or: methanobacterium thermoautotropbicum][db:pir] |
| 11223286_c1_11 | 134 | 3788 | 189 | 62 | 104 | 2.70E-05 | [ac:b65048][pn:hypothetical protein b2681][or:escherichia coli] [db:pir] |
| 112882_f2_2 | 135 | 3789 | 480 | 159 | 180 | 4.90E-14 | [ac:p37958][gn:meca][or:bacillus subtilis][de:negative regulator of genetic competence meca][sp:p37958][db:swissprot] |
| 113432_c2_12 | 136 | 3790 | 198 | 65 | 281 | 9.70E-25 | [ac:q06715][or:lactoococcus lactis][sr:subsplactis:streptococcus lactis][ec:3.4.21.—][de:atp-dependent protease,][sp:q06715] [db:swissprot] |

TABLE 2-continued

| Orf | NT Seq ID | AA Seq ID | NT Orf length | AA Orf length | Score | Probability | Description |
|---|---|---|---|---|---|---|---|
| 1377_c2_40 | 137 | 3791 | 1020 | 339 | 590 | 1.80E-57 | [ln:sgu81957][ac:u81957][pn:putative abc transporter subunit comya][gn:comya][or:streptococcus gordonii][db:genpept-bct][de:streptococcus gordonii rna polymerase beta' subunit (rpoc),putative dna binding protein, putative abc transporter subunitcomy |
| 114077_f2_40 | 138 | 3792 | 468 | 155 | 546 | 8.10E-53 | [ac:p50856][gn:ribI][or:actinobacillus pleuropneumoniae][sr:haemophilus pleuropneumoniae][ec:2.5.1.9][de:(lumazine synthase) (riboflavin synthase beta chain)][sp:p50856][dbswissprot] |
| 1411_c3_70 | 139 | 3793 | 885 | 294 | 678 | 8.30E-67 | [ac:f69769][pn:conserved hypothetical protein ydao][gn:ydao][or:bacillus subtilis][db:pir] |
| 114813_f2_32 | 140 | 3794 | 540 | 179 | 353 | 2.30E-32 | [ac:f69744][pn:hypothetical protein ybbk][gn:ybbk][or:bacillus subtilis][db:pir] |
| 171961_f3_45 | 141 | 3795 | 186 | 61 | 61 | 0.47 | [ln:ecotolqra][ac:m 16489][or:escherichia coli][sr:escherichia coli dna][db:genpept-bct][de:escherichia coli tolqra gene cluster dna.] [nt:orf 4; putative][le:627][re:1199][di:complement] |
| 1720053_c3_22 | 142 | 3796 | 1227 | 408 | 1664 | 2.70E-171 | [ac:p26235][gn:napa][or:enterococcus hirae][de:na(+)/h(+) antiporter][sp:p26235][dbswissprot] |
| 1172203_f3_12 | 143 | 3797 | 642 | 213 | 202 | 2.30E-16 | [ac:d64480][pn:hypothetical protein mj1445][or:methanococcus jannaschii][db:pir][mp:for1414333-1414863] |
| 11722285_f1_13 | 144 | 3798 | 279 | 92 | 73 | 0.078 | [ac:p53860][gn:ynl231c.n1 158][or:saccharomyces cerevisiae][sr, baker's yeast][de:hypothetical 40.7 kd protein in sin4-ure2 intergenic region][sp:p53860][dbswissprot] |
| 11728381_f3_5 | 145 | 3799 | 876 | 291 | 371 | 3.40E-34 | [ac:p39272:p76795][gn:yjdh][or:escherichia coli][de:hypothetical 60.6 kd protein in dcub-lysu intergenic region (f543)] [sp:p39272:p76795][dbswissprot] |
| 11743750_c1_71 | 146 | 3800 | 195 | 64 | 59 | 0.28 | [ln:hsenac07][ac:u53841][pn:amiloride-sensitive epithelial sodium channel][gn:scnn1g][or:homo sapiens][sr:human][db:genpept-pri2][de:human amiloride-sensitive epithelial sodium channel gamma subunit(scnn1g) gene, partial exon 4 and intron 4.][nt:e reductase.][le:646][re:1230][di:direct] |
| 1175293_c1_50 | 147 | 3801 | 621 | 206 | 412 | 1.30E-38 | [ln:sadired][ac:z16422][pn:unknown][gn:orf2][or:staphylococcus aureus][db:genpept-bct][de:s.aureus dfrb gene for dihydrofolate |
| 11758465_c3_55 | 148 | 3802 | 225 | 74 | 57 | 0.017 | [ln:nae001124][ac:ac001124:ae000783][pn:conserved hypothetical protein][gn:bb0129][or:borrelia burgdorferi][sr:lyme disease spirochete][db:genpept-bct][de:borrelia burgdorferi (section 10 of 70) of the complete genome.][nt:similar to gb:z19055 sp:p |
| 11761633_c2_18 | 149 | 3803 | 225 | 74 | 53 | 0.76 | [ac:p19046][gn:nd4][or:artemia salina][sr,brine shrimp][ec:1.6.5.3] [de:nadh-ubiquinone oxidoreductase chain 4, (fragment)] [sp:p19046][dbswissprot] |
| 11761633_c3_40 | 150 | 3804 | 225 | 74 | 53 | 0.76 | [ac:p19046][gn:nd4][or:artemia salina][sr,brine shrimp][ec:1.6.5.3] [de:nadh-ubiquinone oxidoreductase chain 4, (fragment)] [sp:p19046][dbswissprot] |
| 11761633_f3_12 | 151 | 3805 | 225 | 74 | 53 | 0.76 | [ac:p19046][gn:nd4][or:artemia salina][sr,brine shrimp][ec:1.6.5.3] [de:nadh-ubiquinone oxidoreductase chain 4, (fragment)] [sp:p19046][dbswissprot] |
| 1176303_c2_54 | 152 | 3806 | 321 | 107 | 100 | 1.50E-05 | [ac:g70070][pn:hypothetical protein ywzb][gn:ywzb][or:bacillus subtilis][db:pir] |
| 1176303_f1_10 | 153 | 3807 | 315 | 104 | 112 | 7.90E-07 | [ac:g70070][pn:hypothetical protein ywzb][gn:ywzb][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 1176533_c2_22 | 154 | 3808 | 741 | 246 | 541 | 2.70E-52 | [ac:g70000][pn:two-component response regulator [ytsb]homolog ytsa][gn:ytsa][or:*bacillus subtilis*][db:pir] |
| 1177312_f2_39 | 155 | 3809 | 1812 | 603 | 1038 | 5.90E-105 | [ac:p54718][pn:yfib][gn:yfib][or:*bacillus subtilis*][de:hypothetical abc transporter atp-binding protein 1 in _glvbc 3'region][sp:p54718][db:swissprot] |
| 11775319_c1_14 | 156 | 3810 | 1196 | 398 | 1562 | 1.80E-160 | [ac:b69620][pn:enolase eno][gn:eno][or:*bacillus subtilis*][db:pir] |
| 1178467_c2_69 | 157 | 3811 | 243 | 80 | 201 | 7.70E-16 | [ac:q69984][pn:endo-1,4-beta-glucanase homolog ysdc][gn:ysdc][or:*bacillus subtilis*][db:pir] |
| 1179062_f2_16 | 158 | 3812 | 591 | 196 | 242 | 1.30E-20 | [ac:f70064][pn:isochorismatase homolog ywoc][gn:ywoc][or:*bacillus subtilis*][db:pir] |
| 1197311_c3_34 | 159 | 3813 | 381 | 126 | 84 | 0.1 | [ac:p47467:q49208][gn:mg225][or:*mycoplasma genitalium*][de:hypothetical protein mg225][sp:p47467:q49208][db:swissprot] |
| 1197880_f3_8 | 160 | 3814 | 429 | 142 | 76 | 0.96 | [ac:p27902][gn:dnaa][or:*streptomyces coelicolor*][de:chromosomal replication initiator protein dnaa][sp:p27902][db:swissprot] |
| 1181265_f1_2 | 161 | 3815 | 306 | 101 | 225 | 8.40E-19 | [ac:q48708][gn:nrdh][or:*lactococcus lactis* sr,subspperemoris:*streptococcus cremoris*][de:glutaredoxin-like protein nrdh][sp:q48708][db:swissprot] |
| 11812750_f2_12 | 162 | 3816 | 222 | 73 | 65 | 0.073 | [ac:p55319:p01271:p10616][or:*locusta migratoria*][sr:,migratory locust][de:chain(app-alpha) (6 kd dimeric peptide a)][sp:p55319:p01271:p10616][db:swissprot] |
| 11816406_c3_154 | 163 | 3817 | 1929 | 642 | 633 | 4.90E-62 | [ac:p30016][gn:kup:trkd][or:*escherichia coli*][de:kup system potassium uptake protein][sp:p30016][db:swissprot] |
| 1181915_f1_1 | 164 | 3818 | 354 | 117 | 89 | 0.00087 | [ac:s65032][pn:h+-transporting atp synthase, chain 6][cl:h+-transporting atp synthase protein 6][or:mitochondrion *trichophyton rubrum*][ec:3.6.1.34][db:pir] |
| 1183187_c1_12 | 165 | 3819 | 1143 | 380 | 489 | 8.90E-47 | [ac:a70019][pn:opine catabolism homolog yurr][gn:yurr][or:*bacillus subtilis*][db:pir] |
| 11835002_c3_88 | 166 | 3820 | 231 | 76 | 64 | 0.092 | [ln:mhaj1670][ac:aj001670][pn:truncated vaa surface lipoprotein adhesin][gn:vvaa][or:*mycoplasma hominis*][db:genpept-bct][de:*mycoplasma hominis* vaa gene, category 2, strain 7357, partial.][nt:premature truncation caused by g to t substitution][le:<1 |
| 11844431_c2_64 | 167 | 3821 | 2358 | 785 | 151 | 1.80E-07 | [ac:a26256][pn:circumsporozoite protein precursor][cl:circumsporozoite protein:thrombospondin type 1 repeat homology][or:*plasmodium vivax*][db:pir] |
| 11850892_c3_30 | 168 | 3822 | 219 | 72 | 63 | 0.13 | [ln:efpad 1 or f][ac:x96977][gn:orfl 1][or:*enterococcus faecalis*][db:genpept-bct][de:*e.faecalis* plasmid pad1, open reading frames.][le:4168][re:4539][di:direct] |
| 11879036_f1_2 | 169 | 3823 | 213 | 70 | 59 | 0.6 | [ln:chkestpesc][ac:d26313][pn:unknown protein; incomplete][or:*gallus gallus*][sr:*gallus gallus* lens fibers cdna to mrna, clone cffest8][db:genpept-vrt][de:chicken mrna for unknown protein, partial cds.][le:<1][re:526][di:direct] |
| 1188577_c2_55 | 170 | 3824 | 870 | 289 | 729 | 3.30E-72 | [ac:p51198][gn:accd][or:*porphyra purpurea*][de:(cc 6.4.1.2)][sp:p51198][db:swissprot] |
| 11898930_f2_78 | 171 | 3825 | 711 | 237 | 797 | 2.00E-79 | [ac:p36880:p75657][gn:yadb][or:*escherichia coli*][de:hypothetical 28.5 kd protein in hpt-pand intergenic region][sp:p36880:p75657][db:swissprot] |
| 11907628_f2_15 | 172 | 3826 | 357 | 118 | 279 | 1.60E-24 | [ac:d69857][pn:conserved hypothetical protein ykla][gn:ykla][or:*bacillus subtilis*][db:pir] |

TABLE 2-continued

| Orf | NT Seq ID | AA Seq ID | NT Orf length | AA Orf length | Score | Probability | Description |
|---|---|---|---|---|---|---|---|
| 11907628_f2_9 | 173 | 3827 | 357 | 118 | 279 | 1.60E-24 | [ac:696957][pn:conserved hypothetical protein ykla[gn:ykla][or:bacillus subtilis]][db:pir] |
| 11909678_f2_11 | 174 | 3828 | 219 | 72 | 56 | 0.22 | [ac:o08318][gn:argc][or:lactobacillus plantarum][ec: 1.2.1.38][de:acetyl-glutamate semialdehyde dehydrogenase) (nagsa dehydrogenase)][sp:o08318][db:swissprot] |
| 11913300_f3_41 | 175 | 3829 | 186 | 61 | 61 | 0.29 | [nt:varcg][ac:122579][or:variola major virus][sr:variola major virus (strain bangtadesh-1975) dna][db:genpept-vrl][de:variola major virus (strain bangladesh-1975) complete genome.][nt:homolog of vaccinia virus cds cl 1r (growth factor).][le:2506][r |
| 11914812_f3_84 | 176 | 3830 | 1455 | 484 | 572 | 1.40E-55 | [ac:64944][pn:hypothetical protein b1828][or:escherichia coli][dbpir] |
| 11915686_c2_25 | 177 | 3831 | 768 | 255 | 363 | 2.00E-33 | [ac:69841][pn:conserved hypothetical protein yitv][gn:yitv][or:bacillus subtilis][db:pir] |
| 11923250_f1_7 | 178 | 3832 | 372 | 123 | 125 | 4.70E-17 | [nt:vfacycloph][ac:132095][pn:cyclophilin][or:vicia faba][sr:vicia faba leaf cdna to mrna][db:genpept-pln][de:vicia faba cyctophilin mrna, complete cds.][le:82][re:828][di:direct] |
| 11925763_f3_76 | 179 | 3833 | 267 | 88 | 68 | 0.31 | [ln:bpu59689][ac:u59689][pn:microfilarial chitinase][or:brugia pahangi][db:genpept-inv][ec:3.2.1.14][de:brugia pahangi microfilarial chitinase mrna, partial cds.][nt:method: conceptual translation supplied by author.][le:<1][re: |
| 11956332_f3_231 | 180 | 3834 | 32 | 106 | 70 | 0.022 | [ac:30503][pn:protein kinase mpk-7,][cl:kinase-related transforming protein:protein kinase homology][or:mus musculus][sr:, house mouse][ec:2.7.1.—][dbpir] |
| 11964667_f2_5 | 181 | 3835 | 360 | 119 | 107 | 2.70E-06 | [ac:76237][pn:hypothetical protein][or:synechocystis sp.][sr:pcc 6803, , pcc 6803][srpcc 6803,][dbpir] |
| 196950_f2_18 | 182 | 3836 | 483 | 160 | 101 | 0.0004t | [ln:sgu61158,][ac:u61158][pn:gdmh][gn:gdmh][or:staphylococcus gallinarum][db:genpept-bct][de:staphylococcus gallinarum tue3928 gdmf(gdmf), putative membraneprotein (gdmh), abc transporter (gdmf), and antibiotic gallidermnprecursor (gdma) genes, com |
| 11975277_c3_45 | 183 | 3837 | 2709 | 902 | 3417 | 0 | [aca:26738][pn:valine-trna ligase,:valyl-trna synthetase][gn:vals][cl:valine-trna ligase][or:bacillus stearothermophilus][ec:6.1.1.9][dbpir] |
| 11978331_c3_78 | 184 | 3838 | 219 | 72 | 68 | 0.0077 | [ln:rric10][ac:x13744][or:avian retrovirus ic10][db:genpept-vrl][de:avian retrovirus ic10 proviral genome,][nt:deleted gag protein (aa 1-645)][le:453][re:2387][di:direct] |
| 1198443_c1_57 | 185 | 3839 | 246 | 81 | 175 | 1.30E-12 | [ac:94531:o05096][gn:abfa][or:bacillus subtilis][ec:3.2.1.55][de:alpha-1-arabino furanosidase ], (arabinosidase)][sp:p94531:o05096][db:swissprot] |
| 11990877_c2_175 | 186 | 3840 | 222 | 73 | 67 | 0.12 | [ac:p15935][gn:uvia][or:clostridium perfringens][de:bacteriocin uvia][sp:p15935][db:swissprot] |
| 11991336_c1_12 | 187 | 3841 | 873 | 290 | 143 | 4.20E-08 | [ln:shu35635][ac:u35635][pn:unknown][or:staphylococcus haemolyticus][sr:staphylococcus haemolyticus strain-y176][db:genpept-bct][de:staphylococcus haemolyticus is 1272 orf1 and orf2 genes, completecds.][nt:orf2][ie:394][re:1083][di:complement] |
| 1203327_f3_19 | 188 | 3842 | 486 | 161 | 204 | 1.40E-16 | [ac:p57951][gn:mj0531][or:methanococcus jannaschii][de:hypothetical protein mj0531][sp:q57951][db:swissprot] |
| 1204716_c1_12 | 189 | 3843 | 684 | 227 | 631 | 7.90E-62 | [ac:p39788][gn:nth:joob][or:bacillus subtilis][ec:4.2.99.18][de:apyrimidinic site) lyase][sp:p39788][db:swissprot] |

TABLE 2-continued

| Orf | NT Seq ID | AA Seq ID | NT Orf length | AA Orf length | Score | Probability | Description |
|---|---|---|---|---|---|---|---|
| 1204777_ci_6 | 190 | 3844 | 303 | 100 | 89 | 0.003 | [ln:chu45963][ac:u45963][pn:lmp1][gn:lmp1][or:cercopithecine herpesvirus 15][sr:rhesus epstein barr virus strain=c18664][db:genpept-vrl][de:cercopithecine herpesvirus 15 latent membrane protein 1 homolog(lmp1) gene, complete cds.][nt:latent membr |
| 1205302_c2_91 | 191 | 3845 | 459 | 152 | 470 | 9.10E-45 | [ac:p42980][gn:mgsa][or:bacillus subtilis][ec:4.2.99.11][de:methylglyoxal synthase,][sp:p42980][dbsswissprol] |
| 1205311_c2_36 | 192 | 3846 | 1557 | 518 | 239 | 2.80E-17 | [ln:af001974][ac:af001974][pn:xylulose kinase][gn:xyib][fn:atp-dependent phosphorylation of xylulose to][or:thermoanaerobacter ethanolicus][db:genpept-bet][de:thermoanaerobacter ethanolicus putative trkg gene, partial cds, and putative trka, xylose |
| 1207576_c1_98 | 193 | 3847 | 2031 | 676 | 198 | 2.00E-15 | [ac:f36891][pn:transfer complex protein trsc][or:staphylococcus aureus][db:pir] |
| 1209531_f2_10 | 194 | 3848 | 183 | 60 | 65 | 0.089 | [ac:b60725][pn:hypothetical protein (mdma 5 region)][or:streptomyces mycarofaciens][dbpir] |
| 1210966_f2_8 | 195 | 3849 | 1038 | 345 | 638 | 1.40E-62 | [ac:p45171][gn:pota:hi1347][or:haemophilus influenzae][de:spermidine/putrescine transport atp-binding protein pota][sp:p45171][dbsswissprol] |
| 12113530_c3_27 | 196 | 3850 | 405 | 134 | 509 | 6.70E-49 | [in:lcaj3194][ac:aj003194][pn:catabolite regulator protein][gn:ccpa][or:lactobacillus casei][db:genpept-bet][de:lactobacillus casei ccpa & tnp genes.][ie:298][re:518][di:direct] |
| 12114637_c2_29 | 197 | 3851 | 222 | 73 | 62 | 0.31 | [ln:ccaj2782][ac:aj002782][pn:orfx][or:escherichia coli][db:genpept-bct][de:escherichia coli dna for the 3 region of the class 2 integron intn7.][nt:an open reading frame borne on an integron cassette.][ie:21][re:518][di:direct] |
| 1211592_c1_20 | 198 | 3852 | 1035 | 344 | 1382 | 2.10E-141 | [in:lsaj1330][ac:aj001330][pn:ornithine transcarbamoylase][gn:arcb][or:lactobacillus sake][db:genpept-bct][ec:2.1.3.3][de:lactobacillus sake dna encoding the arginine-deiminase pathwaygenes.][ie:1503][re:2516][di:direct] |
| 12116083_f2_18 | 199 | 3853 | 471 | 156 | 226 | 6.60E-19 | [ln:cftu09422][ac:u09422][or:enterococcus faecalis][db:genpept bet][de:enterococcus faecalis ds 16 transposon tn916, (tet(m)), (xis-tn), (int-tn) genes, orfs 1-24, complete cds, complete sequence.][nt:orf7][ie:151951][re:15668][di:direct] |
| 1213957_c1_55 | 200 | 3854 | 441 | 146 | 105 | 4.40E-06 | [ln:lbphig1e][ac:x98106][gn:rorfl15][or:bacteriophage phig1e][db:genpept-phg][de:lactobacillus bacteriophage phig1e complete genomic dna.][ie:33364][re:33711][di:complement] |
| 1214057_c3_194 | 201 | 3855 | 3288 | 1095 | 96 | 2.50E-07 | [ac:p17953][gn:asa1][or:enterococcus faecalis][sr:streptococcus faecalis][de:aggregation substance precursor][sp:p17953][dbsswissprol] |
| 1214067_c1_37 | 202 | 3856 | 744 | 247 | 361 | 3.20E-33 | [ac:p54527][gn:yquik][or:bacillus subtilis][de:hypothetical 27.0 kd protein in spoOa-mmga intergenic region][sp:p54527][dbsswissprol] |
| 12149213_f2_19 | 203 | 3857 | 1341 | 446 | 2058 | 4.80E-213 | [ln:ehy13922][ac:y13922:y15222][gn:ftsa][or:enterococcus hirae][db:genpept bet][de:enterococcus hirae mrai, pbp3s, mray, murd, murg, ftsq and ftsagenes, mraw yllc and ftsz partial genes.][ec:8960][re: 10288][di:direct] |
| 12150902_f2_8 | 204 | 3858 | 852 | 283 | 390 | 2.70E-36 | [ln:sgu61158][ac:u61158][pn:gdmh][gn:gdmh][or:staphylococcus gallinarum][db:genpept-bct][de:staphylococcus gallinarum tuc3928 gdmf(gdmf), putative membraneprotein (gdmh), abc transporter (gdmt), and antibiotic gallidermiprecursor (gdma) genes, com |

TABLE 2-continued

| Orf | NT Seq ID | AA Seq ID | NT Orf length | AA Orf length | Score | Probability | Description |
|---|---|---|---|---|---|---|---|
| 12207533_c3_58 | 205 | 3859 | 243 | 80 | 64 | 0.092 | [ac:p47595][gn:mg353][or:*mycoplasma genitalium*][de: hypothetical protein mg353][sp:p47595][db:swissprot] |
| 12270327_c2_83 | 206 | 3860 | 468 | 155 | 111 | 0.00017 | [ln:scyd1057w][ac:z74105:z71256][gn:usol][or:*saccharomyces cerevisiae*][sr:baker's yeast][db:genpept-pln][de:*s.cerevisiae* chromosome iv reading frame orf yd1057w.][nt:orf yd1058w][le:<1][re:3809][di:direct] |
| 12273312_c2_43 | 207 | 3861 | 1500 | 499 | 1349 | 6.50E-138 | [ac:s76896][pn:hypothetical protein][or:*synechocystis* sp.][sr:pcc 6803, , pcc 6803][sr:pcc 6803.][db:pir] |
| 12275257_c3_200 | 208 | 3862 | 2451 | 816 | 3343 | 0 | [ln:cfu09422][ac:u09422][or:*enterococcus faecalis*][db:genpept-bct][de:*enterococcus faecalis* ds16 transposon tn916, (tct(m)),(xis-tn), (int-tn) genes, orfs 1-24, complete cds, complete sequence.][nt:orf16][le:5193][re:7640][di:direct] |
| 12284377_c1_56 | 209 | 3863 | 183 | 60 | 67 | 0.045 | [ln:synd2sv1][ac:m10978][or:artificial sequence][sr:adenovirus type 2/simian virus 40 (ad2-d2) dna][db:genpept-syn][de:ad2/sv40 defective hybrid (ad2-d2), left hand junction.][nt:d2-t antigen][le: <1][re: |
| 12288180_c1_30 | 210 | 3864 | 1128 | 375 | 1765 | 5.40E-182 | [ac:q06893:q57112:q47821][gn:vanbvanb2][or:*enterococcus faccium*][sr:*streptococcus faccium*][ec:6.3.2.—][de:vancomycin b-type resistance protein vanb (vanb ligase).][sp:q06893:q57112: q47821][db:swissprot] |
| 12296887_f1_4 | 211 | 3865 | 1143 | 380 | 348 | 7.70E-32 | [ac:p45579:p77632][gn:yybdh][or:*escherichia coli*][de:hypothetical 39.1 kd protein in esta-ahpe intergenic region][sp:p45579:p77632][db:swissprot] |
| 12304052_c2_7 | 212 | 3866 | 1428 | 475 | 895 | 8.40E-90 | [ac:h69828][pn:abc transporter(atp-binding protein) homolog yheh][gn:yheh][or:*bacillus subtilis*][db:pir] |
| 12322712_c1_7 | 213 | 3867 | 186 | 61 | 74 | 0.093 | [ac:p36795][gn:e2][or:human papillomavirus type 49][de: regulatory protein e2][sp:p36795][db:swissprot] |
| 12344077_c2_119 | 214 | 3868 | 879 | 292 | 811 | 6.70E-81 | [ln:ae001165][ac:ae001165:ae000783][pn:spermidine/putrescine abc transporter,][gn:tbb0642][or:*borrelia burgdorferi*][sr:lyme disease spirochete][db:genpept-bct][de:*borrelia burgdorferi* (section 51 of 70) of the complete genome.][nt:similar to gb:m64 |
| 12344692_c3_62 | 215 | 3869 | 246 | 81 | 187 | 8.90E-15 | [ln:llu89998][acu89998][pn:50s ribosomal protein subunit 132][gn:rpmf][or:*lactococcus lactis cremoris*][db:genpept-bct][de: *lactococcus lactis cremoris* 50s ribosomal protein subunit 132(rpmf), 50s ribosomal protein subunit 133 (rpmg) 5-methyl-cytosin |
| 12350030_f2_21 | 216 | 3870 | 2070 | 689 | 549 | 3.90E-53 | [ac:p39695][gn:comec:come3][or:*bacillus subtilis*][de:come operon protein 3][sp:p39695][db:swissprot] |
| 12398268_c1_62 | 217 | 3871 | 294 | 97 | 71 | 0.037 | [ac:o5966][gn:grp10][or:*brassica napus*][sr:rape][de:glycine-rich-rna-binding protein 10][sp:q05966][db:swissprot] |
| 12500625_c3_18 | 218 | 3872 | 207 | 68 | 66 | 0.38 | [ln:cef.56d5][ac:z69662][pn:f56d5.1][or:*caenorhabditis elegans*][db:genpept-inv][de:*caenorhabditis elegans* cosmid f56d5, complete sequence.][nt:protein pedicted using genefinder; similar to][le: 1653:2027:2576][re.1976:2520:2687][di:complementjoin] |
| 125010_f2_4 | 219 | 3873 | 1143 | 380 | 89 | 0.0058 | [ac:p40475][gn:yil120w][or:*saccharomyces cerevisiae*][sr:baker's yeast][de:hypothetical 61.8 kd protein in kgd1-sim1 intergenic region][sp:p40475][db:swissprot] |
| 12501413_c3_65 | 220 | 3874 | 567 | 188 | 651 | 6.00E-64 | [ac:a69584][pn:alanyl-trna synthetase alas][gn:alas][or:*bacillus subtilis*][db:pir] |

TABLE 2-continued

| Orf | NT Seq ID | AA Seq ID | NT Orf length | AA Orf length | Score | Probability | Description |
|---|---|---|---|---|---|---|---|
| 1250141_c3_61 | 221 | 3875 | 945 | 314 | 291 | 8.50E-26 | [In:bsu87792][acu87792][pn:unknown][or:bacillus subtilis][db:genpept-bct][de:bacillus subtilis trna-ala, phosphatidylglycerophosphate synthase(pgsa) and cina (cina) genes, complete cds, and reca (reca) gene,partial cds.][nt:orf307; hypothetical 34. |
| 12503787_f1_5 | 222 | 3876 | 321 | 106 | 84 | 0.0021 | [acs:49039][pn:hypothetical protein 2][or:legionella pneumophila][dbpir] |
| 12506292_c3_107 | 223 | 3877 | 1146 | 381 | 1319 | 9.90E-135 | [acp:45872][gn:prfa][or:bacillus subtilis][de:peptide chain release factor 1 (rf-1)][sp:p45872][dbswissprot] |
| 12509702_c1_48 | 224 | 3878 | 1206 | 401 | 1141 | 7.20E-116 | [acs35855][gn:dltb][or:lactobacillus casei][de:dltb protein (basic membrane protein) (bmp)][sp:p35855][dbswissprot] |
| 125200_c1_24 | 225 | 3879 | 285 | 94 | 240 | 2.20E-20 | [acs:42932][pn:probable transmembrane protein smpb][gn:smpb][or:staphylococcus hominis][db:pir] |
| 12526452_f2_58 | 226 | 3880 | 825 | 274 | 131 | 8.90E-06 | [In:caap2][acc72495][pn:zp2][gn:zp2][fn:egg membrane protein][or:carassius auratus][sr:goldfish][db:genpept-vrt][de:c.auratus mrna for zp2.][le:<1][re: 1744][di:direct] |
| 12535713_13_13 | 227 | 3881 | 990 | 329 | 342 | 2.50E-43 | [In:aty14325][acy14325][pn:mevalonate diphosphate decarboxylase][gn:mvd1][or:arabidopsis thaliana][sr:thale cress][dbgenpept-pln][ec:41133][de:arabidopsis thaliana mrna for mevalonate diphosphate decarboxylase.][le:118][re:1356][di:direct] |
| 12539202_f3_2 | 228 | 3882 | 384 | 127 | 423 | 8.70E-40 | [acca70006][pn:epidermal surface antigen homolog yuag][gn:yuag][or:bacillus subtilis][db:pir] |
| 12541283_c1_30 | 229 | 3883 | 186 | 61 | 53 | 0.76 | [acs55638][pn:minor capsid protein][cl:varicella-zoster virus gene 54 protein][or:equine herpesvirus 2][dbpir] |
| 12541283_c2_27 | 230 | 3884 | 186 | 61 | 53 | 0.76 | [acs55638][pn:minor capsid protein][cl:varicella-zoster virus gene 54 protein][or:equine herpesvirus 2][dbpir] |
| 12551567_f3_31 | 231 | 3885 | 246 | 81 | 64 | 0.25 | [acp04753][gn:dhfr][or:mesocricetus auratus][sr:golden hamster][ec.1.5.1.3][de:dihydrofolate reductase,][sp:p04753][dbswissprot] |
| 12554838_c3_24 | 232 | 3886 | 636 | 211 | 111 | 0.00013 | [acp31676][gn:envr][or:escherichia coli][de:potential acref/envcd operon repressor][sp:p31676][dbswissprot] |
| 1258412_c3_40 | 233 | 3887 | 393 | 130 | 132 | 6.00E-09 | [acc69798][pn:conserved hypothetical protein yeth][gn:yeth][or:bacillus subtilis][db:pir] |
| 12598187_c3_27 | 234 | 3888 | 462 | 153 | 334 | 2.40E-30 | [acp11742][gn:dat:dat1][or:bacillus subtilis][sp:p11742][dbswissprot][ec:2.1.1.63][de:alkyltransferase] |
| 12598562_f3_3 | 235 | 3889 | 735 | 244 | 533 | 1.90E-51 | [acb53309][pn:probable pheromone binding protein pxgz: pheromone responsive gene z protein][gn:prgz][or:enterococcus faecalis][db:pir] |
| 12625093_f3_28 | 236 | 3890 | 231 | 76 | 81 | 0.0015 | [acs04714][pn:hypothetical protein end][or:sulfolobus acidocaldarius][db:pir] |
| 12625387_c1_3 | 237 | 3891 | 252 | 83 | 61 | 0.51 | [acp33883][gn:lasi][or:pseudomonas aeruginosa][de:autoinducer synthesis protein lasi][sp:p33883][dbswissprot] |
| 12625826_f1_19 | 238 | 3892 | 369 | 122 | 114 | 7.90E-08 | [acp:q0479:s24620][pn:pistil extensin-like protein (clone pmg14)][or:nicotiana tabacum][sr:, common tobacco][db:pir] |
| 12636087_c2_59 | 239 | 3893 | 1047 | 348 | 753 | 9.40E-75 | [acp46853][gn:yhhx][or:escherichia coli][de:hypothetical 38.8 kd protein in gntr-ggt intergenic region (f345)][sp:p46853][dbswissprot] |
| 1267216_f2_31 | 240 | 3894 | 795 | 264 | 462 | 6.40E-44 | [acc69797][pn:conserved hypothetical protein yest][gn:yest][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 12682202_c1_54 | 241 | 3895 | 546 | 181 | 694 | 1.70E-68 | [ac:b69722][pn:trna-guanine transglycosylase tgt][gn:tgt][or:bacillus subtilis][db:pir] |
| 12687578_c2_119 | 242 | 3896 | 687 | 228 | 428 | 2.60E-40 | [ln:lbphig1e][ac:x98106][gn:rorf242][or:bacteriophage phig1e][db:genpept-phg][de:lactobacillus bacteriophage phig1e complete genomic dna.][le:37600][re:38328][di:complement] |
| 12687578_c2_66 | 243 | 3897 | 693 | 230 | 414 | 7.80E-39 | [ln:lbphig1e][ac:x98106][gn:rorf242][or:bacteriophage phig1e][db:genpept-phg][de:lactobacillus bacteriophage phig1e complete genomic dna.][le:37600][re:38328][di:complement] |
| 12688955_c1_36 | 244 | 3898 | 588 | 195 | 83 | 0.07 | [ln:ae001126][ac:ac001126;ae000783][pn:b. burgdorferi predicted coding region bb0156][gn:bb0156][or:borretia burgdorferi][sr:lyme disease spirochete][db:genpept-bct][de:borrelia burgdorferi (section 12 of 70) of the complete genome.][nt:hypothetic |
| 12691037_c3_15 | 245 | 3899 | 381 | 126 | 240 | 2.80E-20 | [ac:p35880][or:lactobacillus helveticus][de:transposase for insertion sequence element is1201][sp:p35880][db:swissprot] |
| 12691037_f3_56 | 246 | 3900 | 672 | 223 | 515 | 1.60E-49 | [ac:s37549;s67927][pn:transposase][or:streptococcus thermophilus][db:pir] |
| 12696068_c2_16 | 247 | 3901 | 540 | 179 | 224 | 4.00E-26 | [ln:bru38906][ac:u38906][pn:dutpase][or:bacteriophage rlt][db:genpept-phg][de:bacteriophage rlt integrase, repressor protein (rro), dutpase,holin and lysin genes, complete cds.][nt:orf20][le:11058][re:11477][di:direct] |
| 12698577_c3_161 | 248 | 3902 | 1896 | 631 | 1010 | 1.10E-135 | [ac:p26207][gn:arb][or:erwinia chrysanthemi][ec:2.7.1.69][de:enzyme ii, abc component). (cii-bgl)][sp:p26207][db:swissprot] |
| 12704541_f1_2 | 249 | 3903 | 279 | 92 | 80 | 0.00064 | [ln:hsu89355][ac:u89355][pn:creb-binding protein][or:homo sapiens][sr:human][db:genpept pri2][de:homo sapiens clone crt16 creb-binding protein mrna, partial cds.][nt:cbp; crebbp][le:<1][re:2800][di:direct] |
| 12709455_c3_93 | 250 | 3904 | 1140 | 379 | 388 | 1.30E-47 | [ac:p28008][gn:mtla][or:staphylococcus carnosus][ec:2.7.1.69][de:(ec 2.7.1.69) (cii-mtl)][sp:p28008][db:swissprot] |
| 12712802_c2_49 | 251 | 3905 | 699 | 232 | 68 | 0.14 | [ac:g69034][pn:hypothetical protein mth1255][gn:mth1255][or:methanobacterium thermoautotrophicum][db:pir] |
| 12760452_c1_88 | 252 | 3906 | 234 | 77 | 65 | 0.073 | [ln:vhlux1][ac:v01422;j01850][pn:luciferase][gn:luxa][or:vibrio harveyi][db:genpept-bct][de:vibrio harveyi gene probe segment m13mp7.][ie:<1][re: |
| 12760561_f1_61 | 253 | 3907 | 219 | 72 | 66 | 0.098 | [ln:bbaf000270][ac:af000270][pn:lipoprotein][gn:lp][or:borrelia burgdurferi][sr:lyme disease spirochete][db:genpept-bct][de:borrelia burgdorferi strain b31 2.9-like locus, orfc, orfd, rev(rev), lipoprotein (lp), and 36 kda-like orf2 genes, complete |
| 12765875_c2_100 | 254 | 3908 | 588 | 195 | 183 | 2.40E-14 | [ln:llu82105][ac:u82105][pn:gerca][gn:gerca][fn:isoprene biosynthesis][or:lactococcus lactis cremoris][db:genpept-bct][de:lactococcus lactis cremoris putative gene operon: gerca (gerca) andgercc (gercc) genes, partial cds.][nr:putative component o |
| 12771055_c2_56 | 255 | 3909 | 336 | 111 | 69 | 0.97 | [ln:sacr1pra][ac:z25485][pn:acr1-protein][fn:regulator of acetyl-coa synthetase activity][or:saccharomyces cerevisiae][sr:baker's yeast][db:genpept-pln][des cerevisiae acr1-protein gene, complete cds.][sp:p33303][le:923][re:1888][di:direct] |
| 12773907_c3_190 | 256 | 3910 | 1728 | 575 | 1077 | 4.30E-109 | [ln:bpha3gp3][ac:x97563][gn:orf5][fn:unknown][or:lactobacillus casei bacteriophage a2][db:genpept-vrl][de:bacteriophage a2 gp3 gene and 4 open reading frames.][le:1718][re:3409][di:direct] |

TABLE 2-continued

| Orf | NT Seq ID | AA Seq ID | NT Orf length | AA Orf length | Score | Probability | Description |
|---|---|---|---|---|---|---|---|
| 1283430_c3_137 | 257 | 3911 | 660 | 219 | 602 | 9.40E-59 | [ac:p54154][gn:yppp][or:bacillus subtilis][de:reductase][sp:p54154][db:swissprot] |
| 1288166_f1_10 | 258 | 3912 | 969 | 322 | 615 | 3.90E-60 | [ac:p03865][or:staphylococcus aureus][de:rlx protein][sp:p03865][db:swissprot] |
| 1890943_c1_5 | 259 | 3913 | 1227 | 408 | 168 | 7.50E-10 | [ac:c55205][pn:integrase][gn:int][or:lactococcus lactis][db:pir] |
| 1891652_c2_54 | 260 | 3914 | 1050 | 349 | 237 | 4.50E-20 | [ac:p22560][or:mus musculus][sr:mouse][de:ifn-response binding factor 1 (irebf-1)][sp:p22560][db:swissprot] |
| 1289209_c2_42 | 261 | 3915 | 1346 | 448 | 298 | 3.90E-25 | [ln:scmalrefg][ac:y07706][pn:putative maltose-binding protein] [gn:male][or:streptomyces coelicolor][db:genpept-bct][de:s.coelicolor malr, male, malf and malg genes.][le:1620][re:2891][di:direct] |
| 12900705_c1_23 | 262 | 3916 | 696 | 231 | 93 | 0.038 | [ln:cef37h8][ac:z81534][pn:f37h8.5][or:caenorhabditis elegans][db:genpept-inv][de:caenorhabditis elegans cosmid f37h8, complete sequence.][nt:protein predicted using genefinder;cdna est][le:15038:15301:15734:16007][re:15234:15681:15812:16183][di:direct] |
| 12908501_f2_18 | 263 | 3917 | 192 | 63 | 64 | 0.52 | [ac:f33282:i51196][pn:dna-binding protein (clone xlcgf48.2)][or:xenopus laevis][sr:, african clawed frog][db:pir] |
| 12908567_f2_19 | 264 | 3918 | 264 | 88 | 65 | 0.073 | [ln:siaary10][ac:d44491][pn:arylphorin (partial)][or:samia cynthia][sr:samia cynthia (sub_species:pryeri, strain:tokyo) fifth (final)] [db:genpept-inv][samia cynthia fifth (final) instar larvae posterior silkgland dnafor arylphorin, exon 3 and 4.] |
| 12922042_c2_155 | 265 | 3919 | 1917 | 638 | 977 | 1.70E-98 | [ln:cdiiorf][ac:x98606][or:clostridium difficile][db:genpept-bct][de:c.difficile transposon group ii intron with potential coding region.][nt:potential coding region][le:742][re:2571][di:direct] |
| 12922203_c3_92 | 266 | 3920 | 342 | 113 | 56 | 0.54 | [ln:pbu42580][ac:u42580:u17055:u32570][gn:a3461][or:paramecium bursaria chlorella virus 1][db:genpept-vrl][de:paramecium bursaria chlorella virus 1, complete genome.][le:172252][re:172479][di:complement] |
| 12923467_f3_14 | 267 | 3921 | 447 | 148 | 61 | 0.31 | [ac:p14587][or:plasmodium falciparum][sr:,isolate fcm17/senegal][de:hypothetical protein 5' to asp-rich and his-rich proteins (fragment)][sp:p14587][db:swissprot] |
| 12923887_c3_16 | 268 | 3922 | 225 | 74 | 100 | 1.50E-05 | [ac:p39394][gn:y,jiw][or:escherichia coli][de:hypothetical 14.6 kd protein in mcrb-hsds intergenic region (f132)][sp:p39394][db:swissprot] |
| 12925307_f3_18 | 269 | 3923 | 372 | 123 | 110 | 1.30E-06 | [ln:mtv038][ac:ca1021933][pn:putative regulatory protein][gn:mtv038.18][or:mycobacterium tuberculosis][db:genpept][de:mycobacterium tuberculosis sequence v038.][nt:mtv038.18, len:140. probable transcriptional][le:16105][re:16527][di:direct] |
| 12930205_f2_3 | 270 | 3924 | 195 | 64 | 104 | 5.60E-06 | [ac:s74780][pn:hypothetical protein ss11766][or:synechocystis sp.][srpcc 6803, , pcc 6803][srpcc 6803, ][db:pir] |
| 129817_c2_18 | 271 | 3925 | 927 | 308 | 1032 | 2.50E-104 | [ac:p37887][gn:cysk][or:bacillus subtilis][cc:4.2.99.8][de:(o-acetylserine (thiol)-lyase) (csase)][sp:p37887][db:swissprot] |
| 12990933_f1_23 | 272 | 3926 | 195 | 64 | 82 | 0.031 | [ac:hsu88154][pn:proline and glutamic acid rich nuclear protein][or:homo sapiens][sr:human][db:genpept-pri2][de:human proline and glutamic acid rich nuclear protein isoform mrna, complete cds.][nt:p160.2][le:205][re:3156][di:direct] |
| 13017916_c2_64 | 273 | 3927 | 213 | 70 | 81 | 0.0043 | [ln:pfasantz][ac:m97214][pn:s-antigen][or:plasmodium falciparum][db:genpept-inv][dc:plasmodium falciparum s-antigen gene, complete cds.][le:195][re:809][di:direct] |

TABLE 2-continued

| Orf | NT Seq ID | AA Seq ID | NT Orf length | AA Orf length | Score | Probability | Description |
|---|---|---|---|---|---|---|---|
| 1304076_f2_15 | 274 | 3928 | 222 | 73 | 70 | 0.028 | [n:cet06c4][ac:z70756][pn:t06c4.9][or:caenorhabditis elegans][db:genpept-inv][de:caenorhabditis elegans cosmid t06e4, complete sequence.][le:4626:4787][re:4726:5327][di:direct|join] |
| 13067090_f2_15 | 275 | 3929 | 777 | 258 | 338 | 8.90E-31 | [ac:jc5359][pn:regulator protein yfiK][gn:yfiK][el:response regulator homology][or:bacillus subtilis][db:pir] |
| 13070292_c1_8 | 276 | 3930 | 2091 | 696 | 1292 | 7.20E-132 | [ac:h69980][pn:single-strand dna-specific exonuclease homolog yrvE][gn:yrvE][or:bacillus subtilis][db:pir] |
| 13080332_f1_4 | 277 | 3931 | 222 | 73 | 60 | 0.072 | [n:af009330][ac:aam09330][pn:enhancer-of-split and hairy-related protein 2][gn:sharp-2][or:rattus norvegicus][sr:norway rat][db:genpept-rod][de:rattus norvegicus enhancer-of-split and hairy-related protein 2(sharp-2) mrna, complete cds.][nt:conta |
| 13082817_c2_61 | 278 | 3932 | 294 | 97 | 73 | 0.11 | [ac:a43782][pn:keratin, type ii][c1:cytoskeletal keratin][or:notophthalmus viridescens:triturus viridescens][sr:, eastern newt][db:pir] |
| 13103186_c3_85 | 279 | 3933 | 285 | 94 | 115 | 3.80E-07 | [ac:a70048][pn:amino acid abc transporter (atp-binding pr) homolog yvrO][gn:yvrO][or:bacillus subtilis][db:pir] |
| 13104762_f2_3 | 280 | 3934 | 561 | 186 | 619 | 1.50E-60 | [ac:q06795][pn:nusG][or:bacillus subtilis][de:transcription antitermination protein nusg][sp:q06795][db:swissprot] |
| 13128341_c1_10 | 281 | 3935 | 666 | 221 | 506 | 1.40E-48 | [ac:f69879][pn:phosphoglycerate dehydrogenase homolog ylow][gn:ylow][or:bacillus subtilis][db:pir] |
| 13128437_f3_9 | 282 | 3936 | 774 | 257 | 693 | 2.10E-68 | [ac:q11047][gn:mtcy50.10][or:mycobacterium tuberculosis][de:hypothetical abc transporter atp-binding protein cy50.10][sp:q11047][db:swissprot] |
| 13132043_f3_11 | 283 | 3937 | 1092 | 363 | 538 | 5.70E-52 | [n:lpyrc][ac:x78999][gn:unknown][or:lactobacillus leichmannii][db:genpept-bct][de:l.leichmannii pyrc gene.][le:1827][re: |
| 13147061_c3_152 | 284 | 3938 | 408 | 135 | 54 | 0.87 | [ac:15137][pn:thioredoxin h2][c1:thioredoxin:thioredoxin homology][or:spinacia oleracca][sr:, spinach][db:pir] |
| 131563_f3_40 | 285 | 3939 | 201 | 66 | 65 | 0.22 | [ac:40709][pn:ecdysone receptor isoform a][gn:ecr][or:drosophila melanogaster][db:pir] |
| 13158336_c3_6 | 286 | 3940 | 552 | 183 | 693 | 2.10E-68 | [ac:p00380][or:enterococcus faecium][sr:streptococcus faecium][cc:1.5.1.3][de:dihydrofolate reductase,][sp:p00380][db:swissprot] |
| 13164000_c1_48 | 287 | 3941 | 393 | 130 | 52 | 0.96 | [n:asporfgen][ac:x95645][pn:molybdo-pterin binding protein][gn:mop][or:anabaena sp.][db:genpept-bct][de: anabaena sp. mop gene and 5 orfs.][le:252][re:461 [di:complement |
| 132202_c1_4 | 288 | 3942 | 207 | 68 | 138 | 2.70E-09 | [n:streomaa][acm36180:115190][pn:transposase][or:streptococcus pneumoniae][sr:streptococcus pneumoniae (strain rx1) dna][db:genpept-bct][de:streptococcus pneumoniae transposase, (coma and comb) and sicarsynthetase (purc) genes, complete cds.][nt |
| 132702_c1_53 | 289 | 3943 | 192 | 63 | 62 | 0.66 | [ac:p45351][or:cryptococcus neoformans][sr:filobasidiella neoformans][ec:2.1.1.45][de:thymidylate synthase, (ts)][sp:p45351][db:swissprot] |
| 132843_c3_83 | 290 | 3944 | 3591 | 1196 | 2491 | 6.30E-259 | [ac:g69708][pn:chromosome segregation smc protein homolg smc][gn:smc][or:bacillus subtilis][db:pir] |
| 1344180_c2_69 | 291 | 3945 | 480 | 159 | 228 | 4.00E-19 | [n:bs43kbdna][acaj223978][pn:putative abc transporter, yvrO][gn:yvrO][or:bacillus subtilis][db:genpept-bct][de:bacillus subtilis 42.7kb dna fragment from yvsa to yvqa.][le:14186][re:14875][di:direct] |
| 1345377_f1_1 | 292 | 3946 | 513 | 170 | 352 | 2.90E-32 | [ac:p05054][gn:rbsK][or:escherichia coli][cc:2.7.1.15][de:ribokinase,][sp:p05054][db:swissprot] |

TABLE 2-continued

| Orf | NT Seq ID | AA Seq ID | NT Orf length | AA Orf length | Score | Probability | Description |
|---|---|---|---|---|---|---|---|
| 135301_c1_47 | 293 | 3947 | 213 | 70 | 60 | 0.14 | [ac:b69450][pn:anthranilate synthase component i (trpe) homolog][or:archaeoglobus fulgidus][db:pir] |
| 1353582_f2_11 | 294 | 3948 | 678 | 226 | 108 | 0.0042 | [ln:scaogenes][ac:x89715][gn:aof1001][or:saccharomyces cerevisiae][sr:baker's yeast][db:genpept-pln][de:s.cerevisiae aof567, aof1001, aoe110, aoe264 and aoe130 genes,][le:4218][re:7223][di:complement] |
| 1353958_f2_48 | 295 | 3949 | 189 | 62 | 66 | 0.38 | [ln:cef56d5][ac:z69662][pn:f56d5.1][or:caenorhabditis elegans][dbgenpept-inv][dc:caenorhabditis elegans cosmid f56d5, complete sequence][nt:protein predicted using genefinder; similar to][le:1653:2027:2576][re:1976:2520:2687][di:complementjoin] |
| 1367202_c3_95 | 296 | 3950 | 867 | 288 | 133 | 2.80E-05 | [ac:a47297:a55441][pn:myosin heavy chain form b, nonmuscle][cl:myosin heavy chain:myosin head homology][or:xenopus laevis sr:, african clawed frog][db:pir] |
| 13672326_f1_12 | 297 | 3951 | 255 | 84 | 63 | 0.21 | [ac:p18382][gn:k7r][or:vaccinia virus:vaccinia virus][sr:wr; copenhagen,][de:protein k7r][sp:p18382][db:swissprot] |
| 13672876_f2_15 | 298 | 3952 | 1335 | 444 | 696 | 1.00E-68 | [ac:p37710][or:enterococcus faecalis][sr:streptococcus faecalis ec:3.5.1.28][de:autolysin, (n-acetylmuramoyl-1-alanine amidase)][sp:p37710][db:swissprot] |
| 1367628_f2_9 | 299 | 3953 | 210 | 69 | 58 | 0.088 | [ac:p26812][or:lactococcus lactis bacteriophage f4-1][de:hypothetical protein in mcp 3' region (fragment)][sp:p26812][db:swissprot] |
| 13682187_f1_1 | 300 | 3954 | 1890 | 629 | 92 | 0.031 | [ln:ghlea29][ac:x13203][pn:d-29 protein][or:gossypium hirsutum sr:upland cotton][db:genpept-pln][de:cotton set 5a lea gene for seed protein d-29,][le:1484][re:1921][di:direct] |
| 1369013_f1_16 | 301 | 3955 | 1482 | 493 | 130 | 3.00E-05 | [ac:s43609][pn:rofa protein][or:streptococcus pyogenes][db:pir] |
| 1369062_c1_47 | 302 | 3956 | 549 | 182 | 403 | 1.10E-37 | [ac:p39157][gn:ywlg:ipc-33d][or:bacillus subtilis][de:hypothetical 19.4 kd protein in spoiir-glyc intergenic region][sp:p39157][db:swissprot] |
| 1369466_f2_5 | 303 | 3957 | 657 | 218 | 106 | 0.0033 | [ac:a02951][pn:keratin, type ii cytoskeletal:67-kda type ii keratin ct:cytoskeletal keratin][or:musculus][sr:, house mouse][db:pir] |
| 1370305_c3_17 | 304 | 3958 | 333 | 110 | 69 | 0.7 | [ln:u92962][acu92962][pn:nadh dehydrogenase subunit 4][gn:nd4][or:mitochondrion pygathrix roxellana][sr:pygathrix roxellana][db:genpept-pri2][de:pygathrix roxellana nadh dehydrogenase subunit 3 (nd3) gene,partial cds, trna-arg gene, complete seque |
| 13703150_c3_89 | 305 | 3959 | 3666 | 1221 | 192 | 1.30E-11 | [ln:pyu36927][ac:u36927][pn:rhoptry protein][fn:erythrocyte invasion and possible binding][or:plasmodium yoelii][db:genpept-inv][de:plasmodium yoelii rhoptry protein gene, partial cds,][le:<1][re:7206][di:direct] |
| 1370317_c2_71 | 306 | 3960 | 537 | 178 | 139 | 3.30E-09 | [ac:f69456][pn:signal sequence peptidase homolog][or:archaeoglobus fulgidus][db:pir] |
| 1370383_f2_27 | 307 | 3961 | 1566 | 521 | 927 | 3.40E-93 | [ac:p54718][gn:yfib][or:bacillus subtilis][de:hypothetical abc transporter atp-binding protein 1 in glvbe 3'region][sp:p54718][db:swissprot] |
| 13706308_c1_12 | 308 | 3962 | 1347 | 448 | 1564 | 1.10E-160 | [ac:b69795][pn:amidase homolog yerm][gn:yerm][or:bacillus subtilis][db:pir] |
| 13706343_f2_2 | 309 | 3963 | 195 | 64 | 99 | 1.90E-05 | [ac:s58640:s58594][pn:hypothetical protein 137][or:chloroplast zea mays][sr:, maize][db:pir][mp:ir(b)] |
| 13707877_c3_33 | 310 | 3964 | 732 | 243 | 274 | 5.40E-24 | [ac:p32436][gn:degv][or:bacillus subtilis][de:degv protein][sp:p32436][db:swissprot] |

TABLE 2-continued

| Orf | NT Seq ID | AA Seq ID | NT Orf length | AA Orf length | Score | Probability | Description |
|---|---|---|---|---|---|---|---|
| 13709806_f2_16 | 311 | 3965 | 324 | 107 | 93 | 0.00051 | [ln:cel][ac:u39999][gn:f41g3.10][or:caenorhabditis elegans][sr:caenorhabditis elegans strain=bristol n2][db:genpept-inv][de:caenorhabditis elegans cosmid f41g3.][re:8805:9028:9373][re:8983:9186:9426][di:complementjoin] |
| 1371093__f1_1 | 312 | 3966 | 816 | 271 | 394 | 1.00E-36 | [ac:d69044][pn:diaminopimelate epimerase][gn:mth1334][or:methanobacterium thermoautotrophicum][db:pir] |
| 13712660_c3_36 | 313 | 3967 | 858 | 285 | 405 | 7.10E-38 | [ac:h69800][pn:hypothetical protein yfhg][gn:yfhg][or:bacillus subtilis][db:pir] |
| 13714202_f3_9 | 314 | 3968 | 1377 | 458 | 1625 | 3.70E-167 | [ac:a69632][pn:glucose-inhibited division protein gid][gn:gid][or:bacillus subtilis][db:pir] |
| 13720262_f1_2 | 315 | 3969 | 343 | 115 | 57 | 0.89 | [ln:rccspc][ac:108190][pri:sugar carrier protein][gn:rcs1b][fn:sugar transport][or:ricinus communis][sr:ricinus communis (strain carmencita) cdna to mrna][db:genpept-pln][de:ricinus communis (clone pdg16) sugar carrier protein (rcstb) mrna,partial |
| 13723507_c1_20 | 316 | 3970 | 2190 | 729 | 1174 | 2.30E-119 | [ac:q57986][gn:mj0566][or:methanococcus jannaschii][de:ferrous iron transport protein b homolog][sp:q57986][db:swisspont] |
| 13730312_c2_249 | 317 | 3971 | 744 | 247 | 503 | 2.90F-48 | [ln:ae001166][ac:ae000783][pn:conserved hypothetical protein][gn:bb0644][ac:001166:ae000783][pn:conserved hypothetical spirochete.][db:genpept-bct][de:borrelia burgdorferi][sr:lyme disease spirochete.][db:genpept-bct][de:borrelia burgdorferi (section 52 of 70) of the complete genome.][nt:similar to gp:1573101 per |
| 13751251_c1_75 | 318 | 3972 | 648 | 215 | 260 | 5.20E-22 | [ac:p96704][gn:ydgt][or:bacillus subtilis][de:hypothetical transport protein in cxpz-dinb intergenic region][sp:p96704][db:swissprot] |
| 13751251_c2_9 | 319 | 3973 | 183 | 60 | 59 | 0.037 | [ln:xlorxr206][ac:y08352][pn:olfactory receptor][or:xenopus laevis][sr:africanclawed frog][db:genpept-vrt][de:x.lacvis gene encoding olfactory receptor, partial, clone xr206.][le:<1][re: |
| 13751251_c3_21 | 320 | 3974 | 306 | 101 | 178 | 5.40E-13 | [ac:p46349,q94473][gn:gabp][or:bacillus subtilis][de:permease]][sp:p46349,p94473][dbswissprol] |
| 1376378_c1_19 | 321 | 3975 | 183 | 60 | 153 | 2.30E-10 | [ac:c69881][pn:conserved hypothetical protein yluc][gn:yluc][or:bacillus subtilis][db:pir] |
| 13792581_f3_73 | 322 | 3976 | 246 | 81 | 159 | 8.30E-12 | [ac:jc5008][pn:hypothetical 6.5k protein (insertion sequence is1297)][or:lactococcus lactis][db:pir] |
| 13792813_f1_2 | 323 | 3977 | 477 | 158 | 100 | 0.0039 | [ln:ccec33d9][ac:z68159][pn:c33d9.5][or:caenorhabditis elegans][db:genpept-inv][de:caenorhabditis elegans cosmid c33d9, complete sequence.][nt:similarity to yeast dna repair protein rad50][re:6331:6989:7433][re:6527:7345:7957][di:complementjoin] |
| 13800781_f3_40 | 324 | 3978 | 411 | 136 | 222 | 1.70E-18 | [ac:c69780][pn:hypothetical protein ydfe][gn:ydfe][or:bacillus subtilis][db:pir] |
| 13804665_c1_38 | 325 | 3979 | 516 | 171 | 278 | 2.90E-24 | [ln:efu63997][ac:u63997][or:enterococcus faecium][db:genpept-bct][de:enterococcus faecium insertion sequence 151476 putative transposasegene, complete cds.][nt:putative transposase][le:140][re:144][di:direct] |
| 13805293_f1_2 | 326 | 3980 | 330 | 109 | 51 | 0.93 | [ac:p39434][gn:slt][or:salmonella typhimurium][cc:3.2.1.—][de:soluble lytic murein transglycosylase, (fragment)][sp:p39434][db:swissprol] |
| 13806427_c2_43 | 327 | 3981 | 1641 | 546 | 1029 | 5.30E-104 | [ac:q11046][gn:mtcy50.09][or:mycobacterium tuberculosis][de:hypothetical abc transporter atp-binding protein cy50.09][sp:q11046][dbswisspront] |
| 13808206_c1_15 | 328 | 3982 | 246 | 81 | 162 | 4.00E-12 | [ac:5008][pn:hypothetical 6.5k protein (insertion sequence is 1297)][or:lactococcus lactis][db:pir] |

TABLE 2-continued

| Orf | NT Seq ID | AA Seq ID | NT Orf length | AA Orf length | Score | Probability | Description |
|---|---|---|---|---|---|---|---|
| 13808206_c1_31 | 329 | 3983 | 246 | 81 | 162 | 4.00E-12 | [ac:jc5008][pn:hypothetical 6.5k protein (insertion sequence is 1297)][or:lactococcus lactis][db:pir] |
| 13808206_c2_35 | 330 | 3984 | 246 | 81 | 162 | 4.00E-12 | [ac:jc5008][pn:hypothetical 6.5k protein (insertion sequence is 1297)][or:lactococcus lactis][db:pir] |
| 13808206_c2_58 | 331 | 3985 | 246 | 81 | 162 | 4.00E-12 | [ac:jc5008][pn:hypothetical 6.5k protein (insertion sequence is 1297)][or:lactococcus lactis][db:pir] |
| 13808206_f1_8 | 332 | 3986 | 246 | 81 | 159 | 8.30E-12 | [ac:jc5008][pn:hypothetical 6.5k protein (insertion sequence is 1297)][or:lactococcus lactis][db:pir] |
| 3808206_f1_9 | 333 | 3987 | 246 | 81 | 162 | 4.00E-12 | [ac:jc5008][pn:hypothetical 6.5k protein (insertion sequence is 1297)][or:lactococcus lactis][db:pir] |
| 13808206_f2_53 | 334 | 3988 | 246 | 81 | 162 | 4.00E-12 | [ac:jc5008][pn:hypothetical 6.5k protein (insertion sequence is 1297)][or:lactococcus lactis][db:pir] |
| 13808206_f2_6 | 335 | 3989 | 246 | 81 | 162 | 4.00E-12 | [ac:jc5008][pn:hypothetical 6.5k protein (insertion sequence is 1297)][or:lactococcus lactis][db:pir] |
| 13808206_fd_8 | 336 | 3990 | 246 | 81 | 162 | 4.00E-12 | [ac:jc5008][pn:hypothetical 6.5k protein (insertion sequence is 1297)][or:lactococcus lactis][db:pir] |
| 13828375_f1_2 | 337 | 3991 | 201 | 66 | 54 | 0.13 | [ac:jq1512:s30089][pn:hypothetical 26.2k protein (atp6 5' region)][or:mitochondrion brassica napus][sr, rape][db:pir] |
| 13829077_c2_86 | 338 | 3992 | 954 | 317 | 1207 | 7.30E-123 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_c3_27 | 339 | 3993 | 954 | 317 | 1201 | 3.10E-122 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_f1_12 | 340 | 3994 | 954 | 317 | 1212 | 2.10E-123 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_f1_3 | 341 | 3995 | 768 | 255 | 954 | 4.70E-96 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_f1_8 | 342 | 3996 | 954 | 317 | 1212 | 2.10E-123 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_f2_21 | 343 | 3997 | 954 | 317 | 1212 | 2.10E-123 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |
| 13829077_f2_24 | 344 | 3998 | 954 | 317 | 1212 | 2.10E-123 | [ln:ph4coinjn][ac:138972][de:plasmid phkk701][dbgenpept-bct][pn:transposase][or:plasmid phkk701 (cointegrate junctional region) orfx, is 1252 transposase, and is 1216v1 transposase genes, complete cds.][int:is 1252 transposase][pn:transposase][or:plasmid phkk701 is6770 homolog; putative] |

TABLE 2-continued

| Orf | NT Seq ID | AA Seq ID | NT Orf length | AA Orf length | Score | Probability | Description |
|---|---|---|---|---|---|---|---|
| 13829077_f3_25 | 345 | 3999 | 954 | 317 | 1207 | 7.30E-123 | [ln:ph4coinjn][ac:I38972][pn:transposase][or:plasmid phkk701][db:genpept-bct][de:plasmid phkk701 (cointegrate junctional region) orfx, is 1252 transposase, and is 1216v1 transposase genes, complete cds.][nt:is 1252 transposase; is6770 homolog; putative] |
| 13829077_f3_3 | 346 | 4000 | 402 | 133 | 443 | 6.60E-42 | [ln:ph4coinjn][ac:I38972][pn:transposase][or:plasmid phkk701][db:genpept-bct][de:plasmid phkk701 (cointegrate junctional region) orfx, is 1252 transposase, and is 1216v1 transposase genes, complete cds.][nt:is 1252 transposase; is6770 homolog; putative] |
| 13829688_c3_9 | 347 | 4001 | 1254 | 417 | 835 | 1.90E-83 | [ac:b69855][pn:amino acid permease homolog ykba][gn:ykba][or:bacillus subtilis][db:pir] |
| 13829693_c3_78 | 348 | 4002 | 777 | 258 | 441 | 1.10E-41 | [ln:bru38906][ac:u38906][or:bacteriophage rlt][db:genpept-phg][de:bacteriophage rlt integrase, repressor protein (rro), dutpase, holin and lysin genes, complete cds.][nt:orf5][je:3241][re:4038][di:direct] |
| 13835887_f1_1 | 349 | 4003 | 201 | 66 | 81 | 0.12 | [ln:cru62943][ac:u62943][pn:unknown][or:chloroplast chlamydomonas reinhardtii][sr:chlamydomonas reinhardtii][db:genpept-pln][de:chlamydomonas reinhardtii orf2971 unknown protein gene, chloroplastigene encoding chloroplast protein, complete cds.][nt: |
| 13837813_c2_98 | 350 | 4004 | 1071 | 356 | 970 | 9.50E-98 | [ac:p46919][gn:gpsa:glyc][or:bacillus subtilis][ec:1.1.1.94][de:dependent dihydroxyacetone-phosphate reductase)][sp:p46919][db:swissprot] |
| 13837837_c3_156 | 351 | 4005 | 873 | 290 | 515 | 1.60E-49 | [ac:p13243][gn:fbaa:fba:fba1:tsr][or:bacillus subtilis][ec:4.1.2.13][de:probable fructose-bisphosphate aldolase 1,1 [sp:p13243][db:swissprot] |
| 13843931_f1_4 | 352 | 4006 | 1263 | 420 | 179 | 3.20E-11 | [ac:s44207][pn:hypothetical protein 337][cl:bicyclomycin resistance protein][or:coxiella burnetii][db:pir] |
| 13848338_c3_22 | 353 | 4007 | 564 | 188 | 623 | 5.60E-61 | [ac:p39615][gn:ung:ipa-57d][or:bacillus subtilis][ec:3.2.2.—][de:uracil-dna glycosylase,][sp:p39615][db:swissprot] |
| 13860131_c2_43 | 354 | 4008 | 915 | 304 | 550 | 3.00E-53 | [ac:a70016][pn:hypothetical protein yunf][gn:yunf][or:bacillus subtilis][db:pir] |
| 13864818_c2_42 | 355 | 4009 | 711 | 236 | 646 | 2.00E-63 | [ac:a69627][pn:fructose 1-phosphate kinase frub][gn:frub][or:bacillus subtilis][db:pir] |
| 13865751_f2_8 | 356 | 4010 | 1455 | 484 | 827 | 1.30E-82 | [ac:p96613][gn:murf][or:bacillus subtilis][ec:6.3.2.15][de:(d-alanyl-d-alanine-adding enzyme)][sp:p96613][db:swissprot] |
| 13865817_f2_16 | 357 | 4011 | 534 | 177 | 230 | 2.50E-19 | [ac:p33355][gn:yehs][or:escherichia coli][de:hypothetical 18.0 kd protein in molr-bglx intergenic region][sp:p33355][db:swissprot] |
| 13866075_f1_3 | 358 | 4012 | 516 | 171 | 522 | 2.80E-50 | [ac:p21335][gn:yaaj][or:bacillus subtilis][de:hypothetical 17.8 kd protein in sers-dnah intergenic region][sp:p21335][db:swissprot] |
| 13867202_c2_30 | 359 | 4013 | 828 | 275 | 709 | 4.30E-70 | [ac:p52996][gn:panb][or:bacillus subtilis][ec:2.1.2.1 1][de:(ketopantoate hydroxymethyltransferase)][sp:p52996][db:swissprot] |
| 13867802_c2_227 | 360 | 4014 | 552 | 183 | 153 | 3.60E-11 | [ac:g69518][pn:isochorismatase (entb) homolog][or:archaeoglobus fulgidus][db:pir] |
| 13877202_f1_3 | 361 | 4015 | 579 | 192 | 118 | 4.00E-05 | [ac:p46330][gn:yxat:c3a][or:bacillus subtilis][de:hypothetical 44.3 kd protein in gntr-thpg intergenic region][sp:p46330][db:swissprot] |
| 13878215_f2_11 | 362 | 4016 | 282 | 93 | 218 | 4.60E-18 | [ac:h70026][pn:nad(p)h dehydrogenase (quinone) homolog yvab][gn:yvab][or:bacillus subtilis][db:pir] |
| 13881937_c2_37 | 363 | 4017 | 366 | 121 | 69 | 0.8 | [ac:c69979][pn:conserved hypothetical protein yrri][gn:yrri][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 13910010_f2_7 | 364 | 4018 | 237 | 78 | 67 | 0.25 | [ac:p02926][gn:rbsb:rbsp][or:salmonella typhimurium][de:d-ribose-binding-periplasmic protein precursor][sp:p02926][db:swissprot] |
| 13911387_c1_47 | 365 | 4019 | 1362 | 453 | 1323 | 3.70E-135 | [ac:a69581][pn:acetyl-coa carboxylase (biotin carboxylase subunit) accc][gn:accc][or:bacillus subtilis][db:pir] |
| 13915882_c2_28 | 366 | 4020 | 978 | 325 | 1237 | 4.80E-126 | [ac:q06115][gn:cbi:bsh][or:lactobacillus plantarum][ec:3.5.1.24] [de: hydrolase) (cbah) (bile salt hydrolase)][sp:q06115][db:swissprot] |
| 13943917_c1_14 | 367 | 4021 | 2874 | 957 | 1669 | 8.00E-172 | [ac:p23914][gn:levr][or:bacillus subtilis][de:transcriptional regulatory protein levr][sp:p23914][db:swissprot] |
| 14064838_c3_83 | 368 | 4022 | 1401 | 466 | 154 | 7.40E-19 | [ac:60358][gn:mj0050][or:methanococcus jannaschii][de: hypothetical protein mj0050][sp:q60358][db:swissprot] |
| 14070186_c3_41 | 369 | 4023 | 243 | 80 | 93 | 0.00034 | [ln:accpsxm][ac:x81320][gn:epsx][or:acinetobacter calcoaceticus] [db:genpept-bct][de:a.calcoaceticus cpsx and epsm genes.][le:291] [re:1088][di:direct] |
| 14074077_c1_65 | 370 | 4024 | 294 | 97 | 84 | 2.70E-06 | [ac:q04501][gn:ym1090w][or:saccharomyces cervisiae][sr:baker's yeast][de:very hypothetical 15.0 kd protein in rpm2-tub1 intergenic region][sp:q04501][db:swissprot] |
| 14075631_c2_149 | 371 | 4025 | 765 | 254 | 309 | 1.10E-27 | [ac:s32217][pn:hypothetical protein 2][or:bacillus megaterium] [db:pir] |
| 14081599_c1_20 | 372 | 4026 | 424 | 141 | 465 | 3.10E-44 | [ln:instranspo][ac:13467S][pn:transposase][or:insertion sequence is1251][sr:insertion sequence is1251 dna][db:genpept-bct][de: insertion sequence is1251 from enterococcus faccium transposasegene, complete cds.][nt:putative][le: 128][re:1417][di:di direct] |
| 14082652_c2_62 | 373 | 4027 | 204 | 67 | 66 | 0.12 | [ln:euptec11x][ac:10359][or:euplotes crassus][sr:euplotes crassus dna][db:genpept-inv][de:euplotes crassus transposon-like element tee1-1 orf 1-3 genes,complete cds.][nt:orf3][le:4076][re:4570] [di:direct] |
| 1408437_c3_85 | 374 | 4028 | 1416 | 471 | 639 | 1.10E-62 | [ac:p37189:p76411][gn:gate][or:escherichia coli][de:permease iic component) (phosphotransferase enzyme ii, c component)][sp: p37189;p76411][db:swissprot] |
| 14093787_c3_19 | 375 | 4029 | 435 | 144 | 278 | 2.00E-24 | [ac:69219][pn:conserved hypothetical protein mth894][gn: mth894][or:methanobacterium thermoautotrophicum][db:pir] |
| 14094830_c3_42 | 376 | 4030 | 1266 | 421 | 988 | 1.20E-99 | [ac:69814][pn:metabolite transporter homolog yfna][gn:yfna][or: bacillus subtilis][db:pir] |
| 14096057_c1_183 | 377 | 4031 | 465 | 154 | 65 | 0.14 | [ln:hscmz97vh][ac:y12031][pn:immunoglobulin heavy chain][gn: emz97vh3][or:homo sapiens][sr:human][db:genpept-pri2][de: h.sapiens emz97vh3 gene, partial.][le:<1][re: |
| 14101068_c3_26 | 378 | 4032 | 714 | 237 | 560 | 2.70E-54 | [ac:69750][pn:glucosamine-6-phosphate isomerase homolog ybft] [gn:yhfi][or:bacillus subtilis][db:pir] |
| 14101593_c1_21 | 379 | 4033 | 1020 | 339 | 1071 | 1.90E-108 | [ln:lsaj1330][ac:aj001330][pn:carbamate kinase][gn:arcc][or: lactobacillus sake][db:genpept-bct][ec:2.7.2.2][de:lactobacillus sake dna encoding the arginine-deiminase pathwaygenes.][le:2615] [re:3559][di:direct] |
| 14102312_f3_18 | 380 | 4034 | 594 | 197 | 304 | 3.60E-27 | [ln:liscadnp][ac:128104][pn:resolvase][gn:tnpr][fn:resolution of the cointegrat][sr:transposon tn5422][sr:listeria monocytogenes (individual_isolate lm74) dna; transposo][db:genpept-bct][de: listeria monocytogenes atpase (cada) gene; accessory pro |
| 14103437_c1_83 | 381 | 4035 | 501 | 166 | 230 | 2.50E-19 | [ac:p37081][gn:sorb][or:klebsiella pneumoniae][ec:2.7.1.69][de: (cc 2.7.1.69) (ciii-b-sor)][sp:p37081][db:swissprot] |

TABLE 2-continued

| Orf | NT Seq ID | AA Seq ID | NT Orf length | AA Orf length | Score | Probability | Description |
|---|---|---|---|---|---|---|---|
| 14109428_f1_2 | 382 | 4036 | 186 | 61 | 59 | 0.52 | [ac:q45479][gn:lspa:lsp][or:*bacillus subtilis*][ec:3.4.23.36][de: peptidase) (signal peptidase ii) (spase ii)][sp:q45479][dbs:swissprot] |
| 14109686_f1_15 | 383 | 4037 | 236 | 79 | 60 | 0.047 | [ln:mbhrded][ac:y09870][pn:*heterodisulfide reductase*][gn:hdre] [or:*methanosarcina harkeri*][db:genpept-bct][dcm.barkeri hdre & hdrd genes, orf1, orf2, orf3 & orf4.][le:1658][re:2449][di:direct] |
| 14110641_c1_202 | 384 | 4038 | 288 | 95 | 71 | 0.24 | [ac:p07379][gn:pckl][or:*rattus norvegicus*][sr:;rat][ec:4.1.1.32][de: (phosphoenolpyruvate carboxylase) (pepck-c)][sp:p07379] [dbs:swissprot] |
| 14114061_f1_7 | 385 | 4039 | 480 | 159 | 92 | 0.00076 | [ac:p22853][gn:merr][or:*bacillus* sp][sr:rc607,][de:mercuric resistance operon regulatory protein][sp:p22853][dbs:swissprot] |
| 14140681_c2_63 | 386 | 4040 | 312 | 103 | 228 | 1.60E-18 | [ln:ab007844][ac:ab007844][gn:uvra][or:*enterococcus faecalis*] [sr:*enterococcus faecalis* plasmid:pad 1 dna][db:genpept-bct][de: *enterococcus faecalis* plasmid pad 1 gene.][nt:structural gene for ultraviolet resistance][le:1284][re:2612][di:direct] |
| 14142077_c1_176 | 387 | 4041 | 1002 | 333 | 138 | 5.60E-07 | [ln:ecoadvkis][ac:d90259][pn:lipase like enzyme][or:*escherichia coli*][sr:e.coli (strain k12 ca274) dna, clones 12h5 and 4b10][db: genpept-bct][de:c.coli adk, visa genes and orfs.][nt:orf282][le: 1636][re:2478][di:complement] |
| 14142188_f2_65 | 388 | 4042 | 198 | 66 | 145 | 7.80E-10 | [ln:fibril][ac:af007112][pn:fibrillarin][gn:fib][or:*plasmodium falciparum*][sr:*malaria parasite*][db:genpept-inv][de:*plasmodium falciparum fibrillarin* (fib) gene, partial cds.][nt:nucleotar protein] [le:<1][re:906][di:direct] |
| 14117327_c2_73 | 389 | 4043 | 438 | 145 | 68 | 0.056 | [ln:af015193][ac:af015193][pn:nadh dehydrogenase subunit 41] [or:*mitochondrion onchocerca volvulus*][sr:*onchocerca volvulus*] [db:genpept-inv][de:*onchocerca volvulus* mitochondrion, complete genome.][le:7132][re:7374][di:direct] |
| 14175000_c1_21 | 390 | 4044 | 183 | 60 | 65 | 0.073 | [ln:rrtrt48a5][ac:x62330:s52759][pn:t cell receptor v-alpha j-alpha] [gn:rvalphat48a5][or:*rattus rattus*][sr:black rat][db:genpept-rod] [de:*rattus* tcrvalphat48a5 mrna for t cell receptor v-alpha j-alpha.] [nt:t48alpha5 cdna is incomplete at the 5'en |
| 14179752_c3_51 | 391 | 4045 | 1263 | 420 | 602 | 1.40E-64 | [ln:af038816][ac:af038816:u82331][pn:putative atp-binding protein][gn:wzl][or:*serratia marcoscens*][db:genpept-bct][de:*serratia marcescens* putative dtdp-4-dehydrorhamnose 3,5 epimerase(rmlc), putative dtdp-l-rhamnose synthase (rmld), putativerhamnosy |
| 14223437_c1_57 | 392 | 4046 | 1281 | 426 | 1312 | 5.40E-134 | [ac:p22326][gn:tyrs][or:*bacillus subtilis*][ec:6.1.1.1][de:(tyrrs)][sp: p22326][dbs:swissprot] |
| 14223580_c2_6 | 393 | 4047 | 822 | 273 | 612 | 8.20E-60 | [ac:f69813][pn:multidrug-efflux transporter homolog yfmo][gn: yfmo][or:*bacillus subtilis*][db:pir] |
| 14252175_f1_10 | 394 | 4048 | 414 | 137 | 73 | 0.95 | [ac:p75394][gn:lpla][or:*mycoplasma pneumoniae*][ec:6.—.—.—] [de:probable lipoate-protein ligase a,][sp:p75394][dbs:swissprot] |
| 14254800_f3_125 | 395 | 4049 | 330 | 109 | 122 | 6.90E-08 | [ac:p39302][gn:sgab][or:*escherichia coli*][ec:2.7.1.69][de:(cc 2.7.1.69)][sp:p39302][dbs:swissprot] |
| 14258300_f1_5 | 396 | 4050 | 897 | 299 | 1423 | 9.40E-146 | [ac:p26593][gn:lacd][or:*lactococcus lactis*][cc:4.1.—.—][de:lagatose 1,6-diphosphate aldolase,][sp:p26593][dbs:swissprot] *streptococcus lactis,*][sr:,subsplactis: |
| 1428402_c3_64 | 397 | 4051 | 513 | 170 | 83 | 0.57 | [ln:ac001117][ac:ae001117:ac000783][pn:dna topoisomerase iv (parc)][gn:bb0035][or:*borrelia burgdorferi*][sr:lyme disease spirochete][db:genpept-bct][de:*borrelia burgdorferi* (section 3 of 70) of the complete genome.][nt:similar to gp:1405462 percent |

TABLE 2-continued

| Orf | NT Seq ID | AA Seq ID | NT Orf length | AA Orf length | Score | Probability | Description |
|---|---|---|---|---|---|---|---|
| 1429552_f2_2 | 398 | 4052 | 549 | 182 | 341 | 4.30E-31 | [acc:69770][pn:hypothetical protein ydat][gn:ydat][or:*bacillus subtilis*][db:pir] |
| 14297132_c1_46 | 399 | 4053 | 219 | 72 | 66 | 0.29 | [acc:p47488][gn:mg246][or:*mycoplasma genitalium*][de:hypothetical protein mg246][sp:p47488][db:swissprot] |
| 1431265_f1_18 | 400 | 4054 | 351 | 116 | 63 | 0.12 | [acc:s74883][pn:hypothetical protein ssr2087][or:*synechocysti sp.*][sr:pcc 6803, , pcc 6803][sr:pcc 6803,][db:pir] |
| 1432778_f3_15 | 401 | 4055 | 555 | 184 | 398 | 3.90E-37 | [acc:f70019][pn:nifs protein homolog yurw][gn:yurw][or:*bacillus subtilis*][db:pir] |
| 14336718_c3_199 | 402 | 4056 | 516 | 171 | 536 | 9.30E-52 | [ln:efu09422][acc:u09422][or:*enterococcus faecalis*][db:genpept-bct][de:*enterococcus faecalis* ds16 transposon tn916, (tet(m)). (xis-tn), (int-tn) genes, orfs 1-24, complete cds, complete sequence.][nt:orf18][le:4231][re:4728][di:direct] |
| 1434510_f1_1 | 403 | 4057 | 849 | 282 | 1020 | 4.80E-103 | [ln:ldgappgk][acc:aj000339][pn:glyceraldehyde-3-phosphate dehydrogenase][gn:gap][or:*lactobacillus delbrueckii*][db:genpept-bct][cc:1.2.1.12][de:*lactobacillus delbrueckii* ygap, gap, pgk, tpi, and yese genes.][le:1256][re:2272][di:direct] |
| 1444650_c3_42 | 404 | 4058 | 447 | 148 | 72 | 0.96 | [ln:spac10f6][acc:aj009197][pn:hypothetical protein][gn:vip1][or:*schizosaccharomyces pombe*][sr:fission yeast][db:genpept-pln][de:s.pombe chromosome i cosmid c10f6.][nt:spac10f6.06, vip1; unknown, len:257aa, identical to][le:13937][re:14710][di:d |
| 14459762_f1_24 | 405 | 4059 | 198 | 65 | 47 | 0.12 | [acc:pq0636][pn:zinc finger protein czf:cerebellar zinc finger protein][or:*homo sapiens*][sr:, man][db:pir] |
| 1460311_f1_1 | 406 | 4060 | 699 | 232 | 405 | 7.10E-38 | [acc:69864][pn:myo-inositol-1(or 4)-monophosphatase homolog yktc][gn:yktc][or:*bacillus subtilis*][db:pir] |
| 1447182_f1_3 | 407 | 4061 | 867 | 288 | 69 | 0.86 | [ln:celt24h7][acc:u28940][gn:t24h7.4][or:*caenorhabditis elegans*][sr:*caenorhabditis elegans* strain=bristol n2][db:genpept-inv][de:*caenorhabditis elegans* cosmid t24h7.][le:13352:13463:3710][re:13414:13663:13766][di:directjoin] |
| 14475257_f2_14 | 408 | 4062 | 201 | 67 | 50 | 0.09 | [ln:scaj0867][acc:aj000867][pn:histidine kinase][gn:comd][fn:receptor of competence stimulating peptide][or:*streptococcus anginosus*][db:genpept bct][de:*streptococcus constellatus* come, comd genes, strain nctc 11325.][le:346][rc:1668][di:direct] |
| 14485910_c2_52 | 409 | 4063 | 267 | 88 | 146 | 2.00E-10 | [acc:g69865][pn:hypothetical protein ykuj][gn:ykuj][or:*bacillus subtilis*][db:pir] |
| 14489086_c3_181 | 410 | 4064 | 303 | 100 | 269 | 1.80E-23 | [acc:a69982][pn:hypothetical protein yrzb][gn:yrzb][or:*bacillus subtilis*][db:pir] |
| 1449062_f2_12 | 411 | 4065 | 645 | 214 | 476 | 2.10E-45 | [acc:70063][pn:hypothetical protein ywnb][gn:ywnb][or:*bacillus subtilis*][db:pir] |
| 14491062_c1_46 | 412 | 4066 | 774 | 257 | 438 | 2.20E-41 | [acc:69049][pn:abc transporter(atp-binding protein)][gn:mth1370][or:*methanobacterium thermoautotrophicum*][db:pir] |
| 14492143_f2_15 | 413 | 4067 | 633 | 210 | 562 | 1.60E-54 | [ac:h70090][pn:conserved hypothetical protein yyda][gn:yyda][or:*bacillus subtilis*][db:pir] |
| 14492177_c3_81 | 414 | 4068 | 1152 | 383 | 972 | 5.80E-98 | [ln:ab007844][acc:ab007844][gn:uvra][or:*enterococcus faecalis*][sr:*enterococcus faecalis* plasmid:pad1 dna][db:genpept-bct][de:*enterococcus faecalis* plasmid pad1 gene.][nt:structural gene for ultraviolet resistance][le:1284][re:2612][di:direct] |

TABLE 2-continued

| Orf | NT Seq ID | AA Seq ID | NT Orf length | AA Orf length | Score | Probability | Description |
|---|---|---|---|---|---|---|---|
| 14500000_f1_30 | 415 | 4069 | 279 | 92 | 97 | 0.00013 | [ln:mtpacg][ac:x55026:m30937:m61734][or:mitochondrion podospora anserina][sr:podospora anserina][db:genpept-pln][de: p.anserina complete mitochondrial genome.][nt:orf16; no atg start codon; author-given protein][le:44740][re:45549][di:complement] |
| 14502203_c2_17 | 416 | 4070 | 1683 | 560 | 1502 | 4.00E-154 | [ac:c69879][pn:conserved hypothetical protein ylov][gn:ylov][or: bacillus subtilis][dbpir] |
| 14507805_c2_12 | 417 | 4071 | 1323 | 440 | 1194 | 1.70E-121 | [ln:llu78036][ac:u78036][pn:dipeptidase][or:lactococcus lactis] [db:genpept-bct][de:lactococcus lactis dipeptidase gene, complete cds.][le:79][re:1497][di:direct] |
| 14511592_c1_92 | 418 | 4072 | 771 | 256 | 106 | 0.0042 | [ac:s52348][pn:hypothetical protein 2][or:lactobacillus leichmannii] [dbpir] |
| 14531515_f3_82 | 419 | 4073 | 426 | 141 | 120 | 2.20E-07 | [ac:c28551][pn:hypothetical protein 3][or:streptococcus mutans] [dbpir] |
| 14531900_f2_16 | 420 | 4074 | 480 | 159 | 183 | 2.40E-14 | [ln:csgtsggp][ac:x85757][pn:unknown][gn:internal orf g1669][or: saccharomyces cerevisiae][sr:baker's yeast][db:genpept-pln][de: s.cerevisiae g1651, g1654, trna-lys1, sua5, pmr1, g1667, & g1669 genes.][le:6964][re:7365][di:direct] |
| 14532637_c2_68 | 421 | 4075 | 1305 | 434 | 580 | 2.00E-56 | [ac:p39578][gn:dltd:ipa-2r][or:bacillus subtilis][de:protein dltd precursor][sp:p39578][db:swissprot] |
| 1453532_f2_24 | 422 | 4076 | 216 | 71 | 54 | 0.15 | [ac:p31911][gn:hoxq][or:alcaligenes eutrophus][de:hydrogenase expression/formation protein hoxq][sp:p31911][db:swissprot] |
| 14536500_c3_81 | 423 | 4077 | 189 | 62 | 66 | 0.19 | [ln:bbu45425][ac:u45425][gn:rep+][or:borrelia burgdorferi][sr:lyme disease spirochete strain-297][db:genpept-bct][de:borrelia burgdorferi 2.9-5 locus, orf-a-d, rep+, rep-, and lipoprotein (lp) genes, complete cds.][nt:repeat motif-containing gene] |
| 14538182_c1_116 | 424 | 4078 | 435 | 144 | 91 | 0.0064 | [ac:p44189][gn:hi1418][or:haemophilus influenzae][de:hypothetical protein hi1418][sp:p44189][db:swissprot] |
| 4539650_c2_33 | 425 | 4079 | 426 | 141 | 162 | 4.00E-12 | [ac:c69884][pn:conserved hypothetical protein ymca][gn:ymca] [or:bacillus subtilis][dbpir] |
| 14544181_c1_98 | 426 | 4080 | 228 | 75 | 64 | 0.26 | [ln:mbcchisynd][ac:128073][pn:chitin synthase][or:malbranchea gypsea][sr:malbranchea gypsea (individual_isolate uamh 1841) mycelial dna][db:genpept-pln][de:malbranchea gypsea chitin synthase gene, partial cds.][nt:putative][le:<1][re: |
| 14548812_f3_14 | 427 | 4081 | 1488 | 495 | 2029 | 5.70E-210 | [ac:p50099][gn:guab][or:streptococcus pyogenes][ec:1.1.1.205] [de:dehydrogenase) (impdb) (impd)][sp:p50099][db:swissprot] |
| 14553767_c2_32 | 428 | 4082 | 258 | 85 | 10 | 3.00E-07 | [ln:ml1581][ac:z96801][pn:putative oxidoreductase][gn: mlc1581.18c][or:mycobacterium leprae][db:genpept-bct][de: mycobacterium leprae cosmid 1581.][nt:mlc1581.18c, possible oxidoreductase, len: 306 aa;][le:222246][re:23166][di:complement] |
| 14558577_c3_27 | 429 | 4083 | 771 | 256 | 562 | 1.60E-54 | [ac:q46267][gn:act][or:clostridium pasteurianum][cc:1.97.1.4][de: pyruvate formate-lyase activating enzyme,][sp:q46267][db: swissprot] |
| 14562811_f1_1 | 430 | 4084 | 297 | 98 | 77 | 0.24 | [ln:celk06a9][ac:u80846][gn:k06a9.1][or:caenorhabditis elegans] [sr:caenorhabditis elegans strain=bristol n2][db:genpept-inv][de: caenorhabditis elegans cosmid k06a9.][nt:partial cds; coded for by c. elegans cdna yk50c7.5.][le:27212:27374:27536:27666 |

TABLE 2-continued

| Orf | NT Seq ID | AA Seq ID | NT Orf length | AA Orf length | Score | Probability | Description |
|---|---|---|---|---|---|---|---|
| 14573428_f2_15 | 431 | 4085 | 1503 | 500 | 438 | 2.20E-41 | [ln:rru65510][ac:u65510:u43789:m90421:s41762:u20508][pn:unknown][or:*rhodospirillum rubrum*][db:genpept-bct][de:*rhodospirillum rubrum* co-induced hydrogenase operon (coom, cook,cool,coox,coou,cooh) genes, iron sulfur protein (coof) gene, carbon monoxi |
| 14578162_f2_8 | 432 | 4086 | 726 | 241 | 608 | 2.20E-59 | [acs:38639][pn:replication protein a:repa protein:repa protein][or:*pediococcus halophilus*][sr:atcc 33315, , atcc 33315][sr:atcc 33315.][db:pir] |
| 14585967_c3_48 | 433 | 4087 | 633 | 210 | 527 | 8.30E-51 | [ac:p54460][gn:yqet][or:*bacillus subtilis*][cc:2.1.1.—][de:probable methyltransferase.][sp:p54460][db:swissprot] |
| 14587505_c3_12 | 434 | 4088 | 1161 | 386 | 900 | 2.50E-90 | [ac:p71040][gn:ywne][or:*bacillus subtilis*][de:hypothetical 55.8 kd protein in spoiiq-mta intergenic region][sp:p71040][db:swissprot] |
| 14589405_f3_15 | 435 | 4089 | 417 | 138 | 440 | 1.40E-41 | [ac:p16680][gn:phna][or:*escherichia coli*][de:phna protein][sp:p16680][db:swissprot] |
| 1461636_f1_7 | 436 | 4090 | 678 | 225 | 180 | 4.90E-14 | [ac:p37467][gn:xpac][or:*bacillus subtilis*][de:xpac protein][sp:p37467][db:swissprot] |
| 14626317_f1_2 | 437 | 4091 | 879 | 292 | 695 | 1.30E-68 | [ln:spadca][ac:z71552][or:*streptococcus pneumonia*][pn:hydrophobic membrane protein][gn:adcb][or:*streptococcus pneumonia*][db:genpept-bct][de:*streptococcus pneumonia* adccba operon.][le:714][re:1517][di:direct] |
| 14626562_c2_230 | 438 | 4092 | 990 | 329 | 835 | 1.90E-83 | [ac:p54448][gn:yqec) [or:*bacillus subtilis*][de:hypothetical 32.8 kd protein in nucb-arod intergenic region][sp:p54448][db:swissprot] |
| 14631530_c3_20 | 439 | 4093 | 201 | 66 | 63 | 0.12 | [ac:149496][pn:amyloid a][cl:amyloid protein][or:*mus musculus* sr:,house mouse][db:pir] |
| 14642751_f3_25 | 440 | 4094 | 1263 | 420 | 1072 | 1.50E-108 | [ln:chy13922][ac:y13922:y15222][gn:ftsq][or:*enterococcus hirae*][db:genpept-bct][de:*enterococcus hirae* mrar, pbp3s, mray, murd, murg, ftsq and ftsagenes, mraw, ylle and ftsz partial genes.][le:7799][re:8806][di:direct] |
| 14644442_f2_28 | 441 | 4095 | 2403 | 800 | 2327 | 1.50E-241 | [ac:p13252][gn:pola][or:*streptococcus pneumoniae*][ec:2.7.7.7][de:dna polymerase i. (pol i)][sp:p13252][db:swissprot] |
| 14644705_c2_26 | 442 | 4096 | 663 | 220 | 639 | 1.10E-62 | [ln:cfu63997][ac:u63997][or:*enterococcus faecium*][db:genpept-bct][de:*enterococcus faecium* insertion sequence is 1476 putative transposasegene, complete cds.][nt:putative transposase][le:140][re:414][di:direct] |
| 14645077_c3_187 | 443 | 4097 | 363 | 120 | 81 | 0.063 | [ln:ddu66366][ac:u66366][or:*dictyostelium discoideum*][db:genpept-inv][de:*dictyostelium discoideum* orfveg 109 mrna, partial cds.][nt:orfveg109][le:<1][re:721][di:direct] |
| 14645843_f2_45 | 444 | 4098 | 1353 | 450 | 160 | 4.50E-1 | [ac:a40215][pn:tcd antigen][or:*trypanosoma cruzi*][db:pir] |
| 14647752_c2_35 | 445 | 4099 | 2145 | 714 | 1145 | 2.70E-116 | [ac:p14160][gn:hexb][or:*streptococcus pneumoniae*][de:dna mismatch repair protein hexb][sp:p14160][db:swissprot] |
| 4648338_f3_72 | 446 | 4100 | 201 | 66 | 63 | 0.22 | [ln:hytorfac][ac:14157][or:banana bunchy top virus][sr:banana bunchy top virus dna][db:genpept-vrl][de:banana bunchy top virus gene, complete cds.][nt:orf; putative][le:281][re:745][di:direct] |
| 14648387_f1_1 | 447 | 4101 | 435 | 144 | 391 | 2.10E-36 | [ac:q02009][or:*lactococcus lactis*][sr:,subsplactis.*streptococcus lactis*][de:hypothetical 13.3 kd protein in trpe 5′region][sp:q02009][dbswissprot] |
| 14648400_c3_282 | 448 | 4102 | 675 | 224 | 448 | 2.00E-42 | [ac:c69188][pn:ammonium transporter][gn:mth663][or:*methanobacterium thermoautotrophicum*][db:pir] |

TABLE 2-continued

| Orf | NT Seq ID | AA Seq ID | NT Orf length | AA Orf length | Score | Probability | Description |
|---|---|---|---|---|---|---|---|
| 14648452_c2_19 | 449 | 4103 | 468 | 155 | 458 | 1.70E-43 | [ac:p34038][gn:pyk][or:*lactobacillus delbrueckii*][sr: subspbulgaricus][ec:2.7.1.40][de:pyruvate kinase,][sp:p34038][dbsswissprot] |
| 14650258_f3_33 | 450 | 4104 | 993 | 330 | 713 | 1.60E-70 | [ac:d69981][pn:conserved hypothetical protein yrvn][gn:yrvn][or:*bacillus subtilis*][db:pir] |
| 14650311_c3_43 | 451 | 4105 | 678 | 225 | 96 | 0.014 | [ac:p407660][gn:ypmr][or:*bacillus subtilis*][de:hypothetical 28.9 kd protein in ilva 3'region][sp:p40766][db:swissprot] |
| 14650313_c3_101 | 452 | 4106 | 489 | 162 | 209 | 4.20E-17 | [ac:p20298][or:*pyrococcus woesei*][de:hypothetical protein in gapdh 3'region (orfx) (fragment)][sp:p20298][db:swissprot] |
| 14650450_f1_1 | 453 | 4107 | 333 | 110 | 216 | 7.50E-18 | [ac:q56741][or:*vibrio vulnificus*][de:hypothetical 22.5 kd protein in vvpd 3'region (orfx)][sp:q56741][db:swissprot] |
| 14656542_c2_34 | 454 | 4108 | 681 | 226 | 740 | 2.20E-73 | [ac:p13242][gn:ctra][or:*bacillus subtilis*][ec:6.3.4.2][de:ctp synthase, (utp--ammonia ligase) (ctp synthetase)][sp:p13242][dbsswissprot] |
| 14657875_f2_3 | 455 | 4109 | 573 | 190 | 336 | 1.40E-30 | [ac:p39667][gn:yrxa][or:*bacillus subtilis*][de:hypothetical 19.7 kd protein in phea-nifs intergenic region (orf1)][sp:p39667][dbsswissprot] |
| 14664077_f3_10 | 456 | 4110 | 732 | 243 | 340 | 5.40E-31 | [ac:d70042][pn:conserved hypothetical protein yvja][gn:yvja][or:*bacillus subtilis*][db:pir] |
| 14664077_f3_17 | 457 | 4111 | 732 | 243 | 340 | 5.40E-31 | [ac:d70042][pn:conserved hypothetical protein yvja][gn:yvja][or:*bacillus subtilis*][db:pir] |
| 14664213_f1_2 | 458 | 4112 | 411 | 136 | 292 | 6.60E-26 | [ac:p04982][gn:rbsd][or:*escherichia coli*][de:high aminity ribose transport protein rbsd][sp:p04982][db:swissprot] |
| 14665911_c1_14 | 459 | 4113 | 228 | 75 | 92 | 0.00081 | [nt:ceeg11g6][acc:70204][pn:c11g6.3][or:*caenorhabditis elegans*][db:genpept-inv][de:*caenorhabditis elegans* cosmid c11g6, complete sequence.][nt:cdna est ceesg55f comes from this gene][le: 19230:19333:20803:22572][re:19263:19616:20996:23063][di:direc |
| 14666007_c1_76 | 460 | 4114 | 1029 | 342 | 732 | 1.60E-72 | [ac:p39153][gn:ywlc:ipc-29d][or:*bacillus subtilis*][de:hypothetical 37.0 kd protein in spoiir-glyc intergenic region][sp:p39153][dbsswissprot] |
| 14667142_c1_71 | 461 | 4115 | 522 | 173 | 182 | 8.20E-14 | [nt:tsu54556][ac:u54556][pn:microfilarial sheath protein shp3][gn:shp3][or:*litomosoides siginodontis*][db:genpept-inv][de:*litomosoides sigmodontis* microfilarial sheath proteins shp3a (shp3a) and shp3 (shp3) genes, complete cds.][nt:structural protein; |
| 14667187_c1_17 | 462 | 4116 | 1143 | 380 | 1059 | 3.50E-107 | [ac:p05651][gn:recf][or:*bacillus subtilis*][de:recf protein][sp:p05651][db:swissprot] |
| 14667801_f2_42 | 463 | 4117 | 915 | 304 | 93 | 0.098 | [ac:b69689][pn:response regulator aspartate phosphatase rapg][gn:rapg][or:*bacillus subtilis*][db:pir] |
| 14709818_f3_21 | 464 | 4118 | 966 | 321 | 187 | 1.20E-107 | [ac:p39582][gn:ywab:ipa-6d][or:*bacillus subtilis*][de:hypothetical 33.8 kd protein in dae-tyrz intergenic region][sp:p39582][db:swissprot] |
| 14712599_c1_37 | 465 | 4119 | 739 | 246 | 498 | 9.80E-48 | [ac:p42953][gn:tagg][or:*bacillus subtilis*][de:teichoic acid translocation permease protein tagg][sp:p42953][dbsswissprot] |
| 14713217_f1_19 | 466 | 4120 | 303 | 100 | 85 | 0.00057 | [ac:s73440][pn:hypothetical protein b01_orf103b][or:*mycoplasma pneumoniae*][sr:atcc 29342, , atcc 29342][sr:atcc 29342,][db:pir] |
| 14714842_c1_32 | 467 | 4121 | 972 | 323 | 964 | 4.10E-97 | [ac:170009][pn:conserved hypothetical protein yufq][gn:yufq][or:*bacillus subtilis*][db:pir] |

TABLE 2-continued

| Orf | NT Seq ID | AA Seq ID | NT Orf length | AA Orf length | Score | Probability | Description |
|---|---|---|---|---|---|---|---|
| 14724182_c1_28 | 468 | 4122 | 525 | 174 | 902 | 1.50E-90 | [ac:q47746][gn:vanyb][or:*enterococcus faecalis*][sr:*streptococcus faecalis*][ec:3.4.16.4][de:(dd-carboxypeptidase)][sp:q47746][db:swissprot] |
| 14725287_c3_33 | 469 | 4123 | 1452 | 483 | 953 | 6.00E-96 | [ln:bfu61539][ac:u61539:m73530][pn:na+/h+ antiporter][gn:nhac][fn:ph homeostasis; sodium extrusion][or:*bacillus firmus*][db:genpept-bct][de:*bacillus firmus* antiporter(nhac), nahs (nahs), orfb, orfc, and orfd genes, [ln:ae001158][ac:ac001158:ac000783][pn:conserved hypothetical integral membrane][gn:bh0574][or:*borrelia burgdorferi*][sr:lyme disease spirochete][db:genpept-bct][de:*borrelia burgdorferi* (section 44 of 70) of the complete genome.][nt:similar to pir: |
| 14735343_c1_16 | 470 | 4124 | 294 | 97 | 77 | 0.021 | |
| 14735817_f1_1 | 471 | 4125 | 789 | 262 | 425 | 5.40E-40 | [ac:f64149][pn:hypothetical protein hi0355][cl:hypothetical protein b0934][or:*haemophilus influenzae*][db:pir] |
| 14741253_c3_136 | 472 | 4126 | 1758 | 585 | 572 | 1.40E-55 | [ac:p23545][gn:phor][or:*bacillus subtilis*][ec:2.7.3.—][de:alkaline phosphatase synthesis sensor protein phor,][sp:p23545][db:swissprot] |
| 14746052_c2_128 | 473 | 4127 | 624 | 207 | 76 | 0.73 | [ln:cet02g6][ac:z81583][pn:t02g6.f][or:*caenorhabditis elegans*][db:genpept-inv][de:*caenorhabditis elegans* cosmid t02g6, complete sequence.][nt:protein predicted using genefinder; preliminary][le:16324:18378:20397:20733][re:16380:18418:20685:20903] |
| 14845635_f3_35 | 474 | 4128 | 291 | 96 | 230 | 2.50E-19 | [ln:bsz75208][ac:z75208][pn:hypothetical protein][gn:ysoc][or:*bacillus subtilis*][db:genpept-bct][de:*b.subtilis* genomic sequence 89009bp.][nt:unknown function putative][le:80592][re:81206][di:complement] |
| 14851586_c2_96 | 475 | 4129 | 966 | 321 | 428 | 2.60E-40 | [ln:kpu56096][ac:u56096][pn:mdcg][gn:mdcg][fn:unknown][or:*klebsiella pneumoniae*][db:genpept-bct][de:*klebsiella pneumoniae* mdca, mdcb, mdcc, mdcd, mdce, mdcf, and mdcg.genes, complete cds.][nt:similar to malonyl coa-acyl carrier protein][le:6354] |
| 14875002_c3_69 | 476 | 4130 | 261 | 86 | 390 | 2.70E-36 | [ln:efentijo][ac:y16413][gn:orf3][or:*enterococcus faecium*][db:genpept-bct][de:*enterococcus faecium* enti and entj genes and two open readingframes.][le:969][re:1271][di:direct] |
| 14875655_c1_49 | 477 | 4131 | 213 | 70 | 51 | 0.11 | [ac:p13831][gn:resa][or:*plasmodium falciparum*][sr:isolate nf7/ghana][de:ring-infected erythrocyte surface antigen (fragment)][sp:p13831][db:swissprot] |
| 14876082_c1_32 | 478 | 4132 | 387 | 128 | 99 | 6.80E-05 | [ac:f64648][pn:alternative transcription initiation factor, sigma-f][or:*helicobacter pylori*][db:pir] |
| 14876580_c1_49 | 479 | 4133 | 654 | 217 | 391 | 2.10E-36 | [ln:secsirr][ac:x99128][pn:putative iron dependant repressor][gn:sirr][or:*staphylococcus epidermidis*][db:genpept-bct][de:*s.epidermidis* sirr gene.][le:14][re:658][di:direct] |
| 14876712_c3_68 | 480 | 4134 | 594 | 197 | 401 | 1.90E-37 | [ac:p00380][or:*enterococcus faecium*][sr:*streptococcus faecium*][ec:1513][de:dihydrofolate reductase,][sp:p00380][db:swissprot] |
| 14877313_c3_34 | 481 | 4135 | 741 | 246 | 966 | 2.50E-97 | [ac:p37478][gn:yycf][or:*bacillus subtilis*][de:intergenic region][sp:p37478][db:swissprot] |
| 14878802_c2_23 | 482 | 4136 | 1635 | 544 | 1451 | 1.40E-170 | [ln:ssu35633][ac:u35633][pn:dextran glucosidase dexs][gn:dexs][or:*streptococcus suis*][db:genpept-bct][de:*streptococcus suis* dextran glucosidase dexs (dexs) gene completecds.][le:372][re:2000][di:direct] |
| 14881900_c3_105 | 483 | 4137 | 774 | 257 | 72 | 0.063 | [ac:p19281][or:*thermoproteus tenax* virus 1][sr:kra1,ttv1][de:hypothetical 8.9 kd protein][sp:p19281][db:swissprot] |

TABLE 2-continued

| Orf | NT Seq ID | AA Seq ID | NT Orf length | AA Orf length | Score | Probability | Description |
|---|---|---|---|---|---|---|---|
| 14882678_f3_24 | 484 | 4138 | 966 | 321 | 1303 | 4.90E-133 | [ln:cfplsep1g][ac:x96976][pn:transposase][gn:tnp1062][or:enterococcus faecalis][db:genpept-bct][de:e.faccalis plasmid dna sep1 gene, 4068bp.][le:2496][re:3455][di:complement] |
| 14884712_c3_55 | 485 | 4139 | 1071 | 356 | 358 | 6.70E-33 | [ac:s75550][pn:dtdp-glucose 4-6-dehydratase:protein s1r0809: protein slr0809][gn:rfbb][or:synechocystis sp.][sr:pcc 6803, , pcc 6803,][dbpir] |
| 14886088_c1_9 | 486 | 4140 | 528 | 175 | 491 | 5.40E-47 | [ac:p37455][gn:ssb][or:bacillus subtilis][de:single-strand binding protein (ssb) (helix-destabilizing protein)][sp:p37455] [dbswissprot] |
| 14898400_f2_5 | 487 | 4141 | 279 | 92 | 251 | 2.20E-21 | [ac:p35881][or:lactococcus lactis][sr:,subsplactis:streptococcus lactis][de:transposase for insertion sequence element is905][sp: p35881][dbswissprot] |
| 14902087_f1_5 | 488 | 4142 | 186 | 61 | 50 | 0.39 | [ac:p34669][gn:zk686.3][or:caenorhabditis elegans][de: hypothetical 37.7 kd protein zk686.3 in chromosome iii] [sp:p34669][dbswissprot] |
| 14926253_f3_28 | 489 | 4143 | 1077 | 358 | 54 | 1 | [ac:q04535][gn:per][or:drosophila mediostriata][sr:,fruit fly][de: period clock protein (fragment)][sp:q04535][dbswissprot] |
| 14959452_c1_119 | 490 | 4144 | 354 | 117 | 489 | 8.901E-47 | [ln:cftu09422][ac:u09422][or:enterococcus faecalis][db:genpept-bct] [de:enterococcus faecalis ds16 transposon tn916, (tet(m)), (xis-tn), (int-tn) genes, orfs 1-24, complete cds, complete sequence.][nt: orf21][le:1081][re:2466][di:direct] |
| 14970418_f3_6 | 491 | 4145 | 651 | 216 | 353 | 2.30E-32 | [ac:p39145][gn:comfa:comfl][or:bacillus subtilis][de:comf operon protein 1][sp:p39145][dbswissprot] |
| 15016875_f2_29 | 492 | 4146 | 186 | 61 | 58 | 0.24 | [ac:p39709][gn:sco1:ya1067c][or:saccharomyces cerevisiae][sr: baker's yeast][de:sco1 protein][sp:p39709][dbswissprot] |
| 15017013_f2_5 | 493 | 4147 | 876 | 291 | 752 | 1.20E-74 | [ac:p42361][or:streptococcus gordonii challis][de:29 kd membrane protein in psaa 5'region (orf1)][sp:p42361][dbswissprot] |
| 15017562_c2_26 | 494 | 4148 | 216 | 71 | 218 | 4.60E-18 | [ln:ac001132][ac:ac001132:ae00783][pn:phosphate abc transporter, atp-binding protein][gn:bb0218][or:borrelia burgdorferi][sr:lyme disease spirochete][db:genpept-bct] [de:borrelia burgdorferi (section 18 of 70) of the complete genome.][nt:similar t |
| 15025277_c3_96 | 495 | 4149 | 1572 | 523 | 996 | 1.70E-100 | [ln:af040720][ac:af040720][pn:xylosidase/arabinosidase][gn:xsa] [or:selenomas ruminantium][db:genpept-bct][de:selenomonas ruminantirim xylosidase/ardbinosidase (xsa) gene,complete cds.] [le:110][re:1726][di:direct] |
| 15025463_c3_19 | 496 | 4150 | 306 | 101 | 383 | 1.50E-35 | [ac:p05657][gn:rpma][or:bacillus subtilis][de:50s ribosomal protein 127 (b130) (b124)][sp:p05657][dbswissprot] |
| 15026462_c2_82 | 497 | 4151 | 678 | 225 | 342 | 1.70E-30 | [ac:p00550][gn:mtla][or:escherichia coli][cc:2.7.1.69][de: component], (eii-mtl)][sp:p00550][dbswissprot] |
| 15032885_c3_20 | 498 | 4152 | 483 | 160 | 501 | 4.70E-48 | [ac:b69816][pn:transcriptional regulator (fur family) homolog ygag][gn:ygag][or:bacillus subtilis][dbpir] |
| 15039038_c3_100 | 499 | 4153 | 813 | 270 | 678 | 8.30E-67 | [ac:p46536][or:bacillus caldolyticus][de:hypothetical 27.6 kd protein in pyrab-pyrd intergenic region (orf2)][sp:p46536] [dbswissprot] |
| 15041078_f1_1 | 500 | 4154 | 1366 | 456 | 293 | 8.90E-26 | [ac:p14491][or:staphylococcus aureus][de:tfx protein][sp:p14491] [dbswissprot] |
| 15055437_c1_53 | 501 | 4155 | 744 | 247 | 750 | 1.90E-74 | [ac:p12046][gn:pure][or:bacillus subtilis][ec:6.3.2.6][de:(saicar synthetase)][sp:p12046][dbswissprot] |

TABLE 2-continued

| Orf | NT Seq ID | AA Seq ID | NT Orf length | AA Orf length | Score | Probability | Description |
|---|---|---|---|---|---|---|---|
| 15056577_c2_79 | 502 | 4156 | 1533 | 510 | 189 | 1.10E-11 | [acc:69989][pn:acetate-coa ligase homolog ytcI][gn:ytcI][or:bacillus subtilis][db:pir] |
| 15057813_c2_60 | 503 | 4157 | 303 | 100 | 75 | 0.0066 | [acc:p39302][gn:sgaB][or:escherichia coli][ec:2.7.1.69][de:(cc 2.7.1.69)][sp:p39302][db:swissprot] |
| 15078400_f2_25 | 504 | 4158 | 372 | 123 | 87 | 0.023 | [ln:muskrox24][acc:m19643;j03803][or:mus musculus][sr:mouse (strain nih swiss) 3t3 cell, cdna to mrna, clones d[2,26]][db:genpept-rod][de:mouse krox-24 protein mrna, 3' end.][nt:krox-24 protein][le:<1][re:1456][di:direct] |
| 15078412_c1_97 | 505 | 4159 | 1188 | 395 | 71 | 0.14 | [ln:tcu32572][acu32572][pn:mucin][gn:muc.ca-1][or:try panosoma cruzi][db:genpept-inv][de:trypanosoma cruzi putative mucin (muc.ca-1) gene, partial cds.][nt:putative mucin backbone gene][le:<1][re: |
| 15083501_c3_45 | 506 | 4160 | 189 | 62 | 61 | 0.18 | [acc:72314][pn:hypothetical protein yhr004c-a][or:saccharomyces cerevisiae][db:pir][mp:8r] |
| 15083501_f1_1 | 507 | 4161 | 402 | 133 | 81 | 0.18 | [ln:af005370][acc:af005370][pn:orf27][or:alcelaphine herpesvirus 1][sr:wildebeest herpesvirus][db:genpept-vrl][de:alcelaphine herpesvirus 11-dna, complete sequence.][nt:similar to ebv bdlf2][le:50745][re:51623][di:direct] |
| 15083501_f2_7 | 508 | 4162 | 222 | 73 | 60 | 0.023 | [acc:q99828:o00735:o00693:q99971][or:homo sapiens][sr:,human][de:protein cib) (kip)][sp:q99828:o00735:o00693:q99971][db:swissprot] |
| 15086717_c3_66 | 509 | 4163 | 2091 | 696 | 851 | 3.90E-85 | [acc:70040][pn:conserved hypothetical protein yvgp][gn:yvgp][or:bacillus subtilis][db:pir] |
| 15089663_f1_1 | 510 | 4164 | 1491 | 496 | 271 | 8.60E-41 | [acc:69796][pn:two-component response regulator [yesm]homolog yesn][gn:yesn][or:bacillus subtilis][db:pir] |
| 15095277_f1_4 | 511 | 4165 | 669 | 222 | 617 | 2.40E-60 | [acc:q01328][gn:pcp][or:streptococcus pyogenes][ec:3.4.19.3][de:peptidase) (pyroglutamyl-peptidase i)][sp:q01328][db:swissprot] |
| 15100908_f2_38 | 512 | 4166 | 231 | 76 | 64 | 0.49 | [acc:40061][gn:yer093c][or:saccharomyces cerevisiae][sr:baker's yeast][de:hypothetical 164.4 kd protein in met6-pup3 intergenic region][sp:p40061][db:swissprot] |
| 15103437_f3_24 | 513 | 4167 | 189 | 62 | 47 | 0.1 | [acc:95708][gn:mtnd3:nadb3][or:hylobates lar][sr:,common gibbon][ec:1.6.5.3][de:nadh-ubiquinone oxidoreductase chain 3,][sp:q95708][db:swissprot] |
| 15115642_f3_25 | 514 | 4168 | 1320 | 439 | 149 | 6.20E-07 | [acc:70027][pn:conserved hypothetical protein yvac][gn:yvac][or:bacillus subtilis][db:pir] |
| 15117217_c3_10 | 515 | 4169 | 747 | 248 | 500 | 6.00E-48 | [acc:p31217][gn:gpma:gpm][or:escherichia coli][ec:5.4.2.1][de:(pgam 1) (bpg-dependent pgam 1)][sp:p31217][db:swissprot] |
| 15117762_f1_2 | 516 | 4170 | 189 | 62 | 54 | 0.28 | [ln:tfu66069][acu66069][pn:cdc20][or:tritrichomonas foetus][db:genpept-inv][de:tritrichomonas foetus putative 4-nitrophenylphosphatase andputative cdc20 genes, complete cds.][nt:putative cell division control protein][le:1523][re:2797][di:direct |
| 15118812_c2_49 | 517 | 4171 | 1419 | 472 | 77 | 0.007 | [ln:llu93364][acu93364][pn:cpsI][gn:epsI][or:lactococcus lactis cremoris][db:genpept-bct][de:lactococcus lactis cremoris plasmid pnz4000 insertion sequenceis982 putative transposase gene and eps gene cluster(epsrxabcdefghijkl), complete cds.][nt:s |

TABLE 2-continued

| Orf | NT Seq ID | AA Seq ID | NT Orf length | AA Orf length | Score | Probability | Description |
|---|---|---|---|---|---|---|---|
| 15120937_c3_42 | 518 | 4172 | 726 | 241 | 119 | 0.00042 | [ac:s70633:s77694][pn:serine/threonine-specific protein kinase, rho-associated:rho-associated protein kinase][cl:unassigned ser/thr or tyr-specific protein kinases;protein kinase homology][or:bos primigenius taurus][sr:, cattle][ec:2.7.1.—][dbpir] |
| 15134517_c2_15 | 519 | 4173 | 1326 | 441 | 263 | 7.60E-21 | [ac:q57753][pn:mj0305][or:methanococcus jannaschii][de:hypothetical protein mj0305][sp:q57753][db:swissprot] |
| 15628125_f1_3 | 520 | 4174 | 2544 | 847 | 295 | 8.50E-48 | [ac:p38050][gn:pbpf;pona][or:bacillus subtilis][de:penicillin-binding protein 1a (pbp-1a)][sp:p38050][db:swissprot] |
| 15630206_c2_25 | 521 | 4175 | 723 | 240 | 612 | 8.20E-60 | [ac:p38493][gn:cmk;jofc][or:bacillus subtilis][ec:2.7.4.14][de:kinase] (cmp kinase)[sp:p38493][db:swissprot] |
| 15645633_f1_1 | 522 | 4176 | 705 | 234 | 291 | 8.50E-26 | [ac:e69787][pn:hypothetical protein ydil][gn:ydil][or:bacillus subtilis][db:pir] |
| 15663402_c1_20 | 523 | 4177 | 810 | 269 | 583 | 9.70E-57 | [ac:c69881][pn:conserved hypothetical protein yluc][gn:yluc][or:bacillus subtilis][db:pir] |
| 156650_f1_2 | 524 | 4178 | 393 | 130 | 85 | 0.27 | [ln:hsu63139][ac:u63139][pn:rad50][gn:rad50][or:homo sapiens][sr:human][db:genpept-pri2][de:human rad50 (rad50) mma, complete cds.][nt:5'-end of mrna is not verified by primer extension][e:389][re:4327][di:direct] |
| 15666066_c1_94 | 525 | 4179 | 246 | 81 | 60 | 0.14 | [ln:spac23c11][ac:z98559][pn:hypothetical protein][gn:spac23c11.15][or:schizosaccharomyces pombe][sr:fission yeast][db:genpept-pln][de:s.pombe chromosome i cosmid c23c11.][nt:spac23c11.15, unknown, len:1041aa, some similarity][e:27350:27427:2768] |
| 15666591_c1_5 | 526 | 4180 | 225 | 74 | 137 | 1.10E-08 | [ac:f69813][pn:multidrug-efflux transporter homolog yfmo][gn:yfmo][or:bacillus subtilis][db:pir] |
| 15666717_c3_34 | 527 | 4181 | 3011 | 99 | 95 | 5.00E-05 | [ln:sccxv106k][ac:x95258][pn:unknown protein][gn:smfl][or:saccharomyces cerevisiae][sr:baker's yeast][db:genpept-pln][de:s.cerevisiae 10.6kbp fragment from chromosome xv.][nt:internal to smfl][e:3530][re:3901][di:direct] |
| 15680438_c3_69 | 528 | 4182 | 309 | 102 | 68 | 0.83 | [ac:p53862][gn:yn1228w:n1249][or:saccharomyces cerevisiae][sr:baker's yeast][de:precursor][sp:p53862][db:swissprot] |
| 15683443_c1_28 | 529 | 4183 | 546 | 181 | 299 | 1.20E-26 | [ac:f69815][pn:hypothetical protein ygac][gn:ygac][or:bacillus subtilis][db:pir] |
| 15701_f1_9 | 530 | 4184 | 216 | 71 | 66 | 0.37 | [ac:p55780][gn:nd2][or:gadus morhua][sr:atlantic cod][ec:1.6.5.3][de:nadh-ubiquinone oxidoreductase chain 2,][sp:55780][db:swissprot] |
| 15703430_f2_33 | 531 | 4185 | 933 | 310 | 273 | 6.90E-24 | [ac:p37499][gn:yybe][or:bacillus subtilis][de:hypothetical transcriptional regulator in cotf-tctb intergenic region][sp:p37499][db:swissprot] |
| 15703562_c1_56 | 532 | 4186 | 225 | 74 | 56 | 0.49 | [ac:ph1240][pn:ig heavy chain v region (clone c119)][cl:immunoglobulin v region immunoglobulin homology][or:homo sapiens][sr:, man][db:pir] |
| 15703562_c1_8 | 533 | 4187 | 225 | 74 | 56 | 0.49 | [ac:ph1240][pn:ig heavy chain v region (clone c119)][cl:immunoglobulin v region immunoglobulin homology][or:homo sapiens][sr:, man][db:pir] |
| 15703562_c3_24 | 534 | 4188 | 225 | 74 | 56 | 0.49 | [ac:ph1240][pn:ig heavy chain v region (clone t119)][cl:immunoglobulin v region immunoglobulin homology][or:homo sapiens][sr:, man][db:pir] |

TABLE 2-continued

| Orf | NT Seq ID | AA Seq ID | NT Orf length | AA Orf length | Score | Probability | Description |
|---|---|---|---|---|---|---|---|
| 15703562_c3_31 | 535 | 4189 | 225 | 74 | 56 | 0.49 | [ac:ph1240][pn:ig heavy chain v region (clone c119)][cl: immunoglobulin v region immunoglobulin homology][or:homo sapiens][sr:_man][db:pir] |
| 15703562_f3_34 | 536 | 4190 | 225 | 74 | 56 | 0.49 | [ac:ph1240][pn:ig heavy chain v region (clone c119)][cl: immunoglobulin v region immunoglobulin homology][or:homo sapiens][sr:_man][db:pir] |
| 15704807_f3_66 | 537 | 4191 | 2487 | 828 | 3332 | 0 | [ac:cd69650][pn:leucyl-trna synthetase leus][gn:leus][or:bacillus subtilis][db:pir] |
| 15704833_f2_10 | 538 | 4192 | 333 | 110 | 86 | 0.0039 | [ac:b69200][pn:hypothetical protein mth749][gn:mth749][or:methanobacterium thermoautotrophicum][db:pir] |
| 15706663_c1_34 | 539 | 4193 | 834 | 277 | 735 | 7.60E-73 | [ac:49938][gn:fhuc][or:bacillus subtilis][de:ferrichrome transport atp-binding protein fhuc][sp:p49938][db:swissprot] |
| 15709508_f2_9 | 540 | 4194 | 222 | 73 | 61 | 0.25 | [ac:p90921][gn:k07a12.3][or:caenorhabditis elegans][ec:3.6.1.34][de:putative atp synthase g chain, mitochondrial 2,][sp:p90921][db:swissprot] |
| 15719390_f1_10 | 541 | 4195 | 195 | 64 | 66 | 0.55 | [ac:p25201][or:acinetobacter calcoaceticus][ec:2.1.1.72][de: methyltransferase acci) (m.acci)][sp:p25201][db:swissprot] |
| 15720716_f3_22 | 542 | 4196 | 894 | 297 | 175 | 4.80E-12 | [ac:d69789][pn:hypothetical protein ydjh][gn:ydjh][or:bacillus subtilis][db:pir] |
| 15728800_c1_16 | 543 | 4197 | 1281 | 426 | 1193 | 2.20E-121 | [ac:p05648][gn:dnaa:dnah][or:bacillus subtilis][de:chromosomal replication initiator protein dnaa][sp:p05648][db:swissprot] |
| 15729692_f3_18 | 544 | 4198 | 207 | 68 | 52 | 0.23 | [ln:celk12d9][ac:cu80030][gn:k12d9.5][or:caenorhabditis elegans][sr:caenorhabditis elegans strain=bristol n2][db:genpept-inv][de: caenorhabditis elegans cosmid k12d9.][le:7044:7153:7342][re: 7103:7294:7565][di:complementjoin) |
| 15729808_c3_14 | 545 | 4199 | 624 | 207 | 91 | 0.0021 | [ln:tau32310][acu32310][pn:single-stranded nucleic acid binding protein) [gn:whgrp-1][or:triticum aestivum][sr:wheat][db: genpept-pln][de:triticum aestivum single-stranded nucleic acid binding protein(whgrp-t) gene, complete cds.][nt:similar to gly |
| 157717_c2_46 | 546 | 4200 | 1422 | 473 | 477 | 1.70E-45 | [ln:d64177][ac:d64177][pn:polypeptide][or:erysipelothrix rhusiopathiae][sr:erysipelothrix rhusiopathiae (strain:fujisawa, specific_host:su][db:genpept-bct][de:erysipetothrix rhusiopathiae dna for polypeptide, complete cds.][nt:associated with capsu |
| 15791087_f1_12 | 547 | 4201 | 2574 | 857 | 1152 | 4.90E-117 | [ac:o08365][gn:mtcy21c12.02][or:mycobacterium tuberculosis][ec: 3.6.1.—][de:putative cation-transporting atpase cy21c12.02,][sp:o08365][db:swissprot] |
| 15792212_c2_13 | 548 | 4202 | 717 | 238 | 763 | 8.20E-76 | [ac:p43440][gn:ntp][or:enterococcus hirae][ec:3.6.1.34][de: translocating atpase subunit j)][sp:p43440][db:swissprot] |
| 157952_c2_106 | 549 | 4203 | 525 | 174 | 258 | 2.70E-22 | [ln:mtv037][ac:al021932][pn:hypothetical protein mtv037.07][gn: mtv037.07][or:mycobacterium tuberculosis][db:genpept][de: mycobacterium tuberculosis sequence v037.][nt:mtv037.07, len: 171. unknown. alternative start][le:7109][re:7624][di:direct] |
| 15817330_c2_13 | 550 | 4204 | 258 | 85 | 98 | 6.10E-05 | [ac:p41083][gn:glnp][or:rickettsia prowazekii][de:putative glutamine transport system permease protein glnp][sp:p41083][db: swissprot] |
| 15819827_f2_77 | 551 | 4205 | 876 | 291 | 1106 | 3.70E-112 | [ac:p36879][gn:yadg][or:escherichia coli][de:intergenic region][sp:p36879][db:swissprot] |
| 15820942_f1_22 | 552 | 4206 | 882 | 293 | 112 | 0.00036 | [ac:b70082][pn:hypothetical protein yxlg][gn:yxlg][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 15823431_c3_143 | 553 | 4207 | 603 | 200 | 986 | 1.90E-99 | [ac:p19775] [gn:tnp][or:*staphylococcus aureus*][de:transposase for insertion sequence element is256 in transposon tn4001][sp:p19775][db:swissprot] |
| 15828501_ct_135 | 554 | 4208 | 771 | 256 | 452 | 7.40E-43 | [ac:g69192][pn:abc transporter (glutamine transport atp-binding protein)][gn:mth696][or:*methanobacterium thermoautotrophicum*][db:pir] |
| 15836693_c1_199 | 555 | 4209 | 1176 | 391 | 1231 | 2.10E-125 | [ac:q47866][gn:ftsw][or:*enterococcus hirae*][de:probable cell division protein ftsw][sp:q47866][db:swissprot] |
| 15852250_f2_8 | 556 | 4210 | 582 | 193 | 655 | 2.30E-64 | [ac:d69981][pn:conserved hypothetical protein yrvn][gn:yrvn][or:*bacillus subtilis*][db:pir] |
| 15843_c2_50 | 557 | 4211 | 1059 | 352 | 395 | 2.00E-39 | [ln:llu81485][ac:u81485][pn:histidine kinase][gn:llkinb][or:*lactococcus lactis cremoris*][db:genpept-bct][de:*lactococcus lactis* subsp. *cremoris* mg1363 histidine kinase (llkinb)gene, complete cds.][le:1][re:1554][di:direct] |
| 15861530_c2_116 | 558 | 4212 | 933 | 310 | 987 | 1.50E-99 | [acc:64880][pn:hypothetical protein b1314][or:*escherichia coli*][db:pir] |
| 15890928_c1_3 | 559 | 4213 | 222 | 73 | 78 | 0.01 | [ln:ypu73144][ac:u73144][pn:high molecular weight protein 1][gn:irp1][or:*yersinia pestis*][db:genpept-bct][de:*yersinia pestis* high molecular weight protein 1 (irp1) gene,partial sequence.][nt:hmwp1; probable irp1 coding region, similar to][le:<1][] |
| 15890928_c1_44 | 560 | 4214 | 519 | 172 | 71 | 0.33 | [ln:af045249][ac:af045249][pn:acidic ribosomal protein p1][or:*leishmania peruviana*][db:genpept][de:*leishmania peruviana* acidic ribosomal protein p1 mrna, completecds.][nt:pl-protein][le:26][re:349][di:direct] |
| 15892805_f2_2 | 561 | 4215 | 918 | 305 | 521 | 2.30E-52 | [ln:af045552][ac:af045552][pn:d-xylose proton-symporter][gn:xylt][or:*lactobacillus brevis*][db:genpept][de:*lactobacillus brevis* xyl operon and xylose isomerase (xyla),xylulokinase (xylb), and d-xylose proton-symporter (xylt) genes,complete cds.][le: |
| 15895263_c1_15 | 562 | 4216 | 705 | 234 | 125 | 9.00E-10 | [de:q50292][or:*mycoplasma pneumoniae*][de:hypothetical protein mg181 homolog (gt9__orf434)][sp:q50292][db:swissprot] |
| 15895291_f3_106 | 563 | 4217 | 1698 | 565 | 239 | 1.20E-16 | [ln:hsu89293][ac:u89293][pn:msh4][gn:hmsh4][or:*homo sapiens*][sr:human][db:genpept-pri2][de:human msh4 (hmsh4) mrna, complete cds.][nt:muts homolog][le:41][re:2852][di:direct] |
| 15898428_c1_184 | 564 | 4218 | 477 | 158 | 153 | 1.20E-10 | [ac:a30286:s06431:a64943][pn:phosphotransferase system enzyme ii., mannose-specific, factor iii:mannose permease, factor iii:phosphotransferase system enzyme ii-a, mannose-specific: phosphotransferase system enzyme iii, mannose-specific: protein-npi-phosph |
| 15899050_f3_23 | 565 | 4219 | 2148 | 715 | 1658 | 1.20E-170 | [acc:69810][pn:anion-binding protein homolog yfle][gn:yfle][or:*bacillus subtilis*][db:pir] |
| 15899217_c1_28 | 566 | 4220 | 648 | 215 | 90 | 0.53 | [acs:51869][pn:probable membrane protein yd14][or:*saccharomyces cerevisiae*][db:pir][mp:4r] protein yd9302.17c][or:*saccharomyces cerevisiae*][db:pir][mp:4r] |
| 15901552_c2_61 | 567 | 4221 | 201 | 66 | 67 | 0.071 | [ac:p35706][gn:sti2][or:*streptomyces longisporus*][db:swissprot][de:trypsin inhibitor sti2 precursor][sp:p35706][db:swissprot] |
| 15909808_c3_4 | 568 | 4222 | 519 | 172 | 143 | 2.90E-09 | [ac:69271][pn:hypothetical protein af0170][or:*archaeoglobus fulgidus*][db:pir] |

TABLE 2-continued

| Orf | NT Seq ID | AA Seq ID | NT Orf length | AA Orf length | Score | Probability | Description |
|---|---|---|---|---|---|---|---|
| 15914077_f2_10 | 569 | 4223 | 531 | 177 | 179 | 6.30E-14 | [ln:rcu23145][ac:u23145][pn:cbby][gn:cbby][or:*rhodobacter capsulatus*][db:genpept-bct][de:*rhodobacter capsulatus* calvin cycle carbon dioxide fixation operon:fructose-1,6-/sedoheptulose-1,7-bisphosphate aldolase (cbba) gene,partial cds, form ii ribulo |
| 15916311_f1_1 | 570 | 4224 | 267 | 88 | 215 | 9.60E-18 | [ln:seu40259][ac:u40259][pn:orf127][or:*staphylococcus epidermidis*][sr:*staphyloccocus epidermidis* strain=sk398][db:genpept-bct][de:*staphyloccocus epidermidis* trimethoprim resistance plasmid psk639,][nt:orf127][le:381][re:764][di:direct] |
| 159641_f2_7 | 571 | 4225 | 918 | 305 | 144 | 1.10E-07 | [ac:p49330][gn:rgg][or:*streptococcus gordonii challis*][de:rgg protein][sp:p49330][db:swissprot] |
| 16008_f1_10 | 572 | 4226 | 342 | 113 | 86 | 0.00045 | [ac:o69376][pn:hypothetical protein af1013][or:*archaeoglobus fulgidus*][db:pir] |
| 16015640_c2_68 | 573 | 4227 | 333 | 110 | 70 | 0.87 | [ln:ddu66524][ac:u66524][or:*dictyostelium discoideum*][db:genpept-inv][de:*dictyostelium discoideum* orfveg158 mrna, partial cds,][nt:orfveg158][le:<1][re:860][di:direct] |
| 16025015_c3_176 | 574 | 4228 | 183 | 60 | 70 | 0.1 | [ln:scvalsfp][ac:y13070][pn:valyl-trna synthetase][gn:vals][or:*streptomyces coelicolor*][db:genpept-bct][de:*s. coelicolor* vais, fpgs, ndk genes,][le:<1][re:779][di:direct] |
| 16048162_c3_23 | 575 | 4229 | 204 | 67 | 62 | 0.073 | [ln:cezk971][ac:z49074][pn:zk970.1][or:*caenorhabditis elegans*][db:genpept-inv][de:*caenorhabditis elegans* cosmid zk971, complete sequence,][nt:similar to neprilysin zinc protease][le:5110:5265:5464][re:5209:5420:5702][di:complementjoin] |
| 16055141_c2_4 | 576 | 4230 | 666 | 221 | 83 | 0.45 | [ln:spbc3d5][ac:z95620][pn:unknown][gn:spbc3d5.14c][or:*schizosaccharomyces pombe*][sr:fission yeast][db:genpept-pin][de:*s.pombe* chromosome ii cosmid c3d5.][nt:spbc3d5.14c; unknown; partial; serine rich,][le:31398][re: |
| 16056341_c1_86 | 577 | 4231 | 1095 | 364 | 134 | 4.50E-06 | [ac:a70015][pn:nadh dehydrogenase homolog yumb][gn:yumb][or:*bacillus subtilis*][db:pir] |
| 16072318_c1_33 | 578 | 4232 | 351 | 116 | 87 | 0.013 | [ac:q92349][gn:spdc6g9.04][or:*schizusaccharomyces pombe*][sr:, fission yeast][de:hypothetical 150.9 kd protein c6g9.04 in chromosome i.][sp:q92349][db:swissprot] |
| 161000_c2_46 | 579 | 4233 | 648 | 215 | 638 | 1.40E-62 | [ac:c69638][pn:gmp synthetase guaa][gn:guaa][or:*bacillus subtilis*][db:pir] |
| 161040_c2_54 | 580 | 4234 | 1545 | 514 | 364 | 6.70E-43 | [ac:p37563][gn:yaca][or:*bacillus subtilis*][de:hypothetical 55.1 kd protein in spoiie-hpt intergenic region][sp:p37563][db:swissprot] |
| 16141300_f2_3 | 581 | 4235 | 333 | 110 | 87 | 0.0017 | [ac:s60743][pn:secreted antigen p36/p34 precursor][or:*mycobacterium bovis*][db:pir] |
| 16187501_f2_3 | 582 | 4236 | 1065 | 354 | 354 | 1.80E-32 | [ln:lllvsfpcp][ac:x99710][pn:transcription factor][or:*lactococcus lactis*][db:genpept-bct][dc:*l.lactis* orf, genes homologous to vsf-1 and pepf2 and gene encodingprotein homologous to methyl-transferase.][nt:weak homology with vsf-1 gene (x73635)][le: |
| 16197587_c3_198 | 583 | 4237 | 273 | 90 | 296 | 2.50E-26 | [ln:efu09422][ac:u09422][or:*enterococcus faecalis*][db:genpept bct][de:*enterococcus faecalis* ds16 transposon tn916, (tet(m)), (xis-tn), (int-tn) genes, orfs 1-24, complete cds, complete sequence,][nt:orf19][le:3893][re:4114][di:direct] |
| 16210375_c2_122 | 584 | 4238 | 1011 | 336 | 330 | 6.30E-30 | [ac:d69588][pn:transcriptional repressor of the arabinose operon arar][gn:arar][or:*bacillus subtilis*][db:pir] |
| 16214088_f2_20 | 585 | 4239 | 1686 | 561 | 1683 | 2.60E-173 | [ac:p50976][gn:lace][or:*streptoococcus mutans*][ec:2.7.1.69][de:(ec 2.7.1.69)(cii-lac)][sp:p50976][db:swissprot] |

TABLE 2-continued

| Orf | NT Seq ID | AA Seq ID | NT Orf length | AA Orf length | Score | Probability | Description |
|---|---|---|---|---|---|---|---|
| 162818_f1_6 | 586 | 4240 | 468 | 155 | 371 | 2.80E-34 | [ac:f70002][pn:conserved hypothetical protein ytwi][gn:ytwi][or:bacillus subtilis][db:pir] |
| 16285_c1_112 | 587 | 4241 | 423 | 140 | 249 | 2.40E-21 | [ln:efu38590][ac:u38590][pn:prgn][gn:prgn][fn:involved in negative control of conjugation and][or:enterococcus faecalis][sr:enterococcus faecalis strain-sp7][db:genpept-bct][de:enterococcus faecalis plasmid pcf10 prgn, prgo, and prgp genes,complet |
| 16306508_c3_30 | 588 | 4242 | 216 | 71 | 61 | 0.18 | [ac:i55690][pn:gene dlx-7 protein][gn:dlx-7][cl:unassigned homeobox proteins:homeobox homolog][or:mus sp.][sr:,mouse][db:pir] |
| 16308467_c2_71 | 589 | 4243 | 330 | 109 | 96 | 3.90E-05 | [ln:seu40259][ac:u40259][pn:orf127][or:staphylococcus epidermidis][sr:staphylococcus epidermidis strain=sk398][db:genpept-bct][de:staphylococcus epidermidis trimethoprim resistance plasmid psk639_][nt:orf127][le:381][re:764][di:direct] |
| 16406288_c3_49 | 590 | 4244 | 879 | 292 | 1050 | 3.20E-106 | [ac:jc5336][pn:caseinolytic proteinase, regulatory chain:class iii heat-shock protein][gn:clpx][or:bacillus subtilis][cc:3.4.—.—][db:pir] |
| 16406327_c2_163 | 591 | 4245 | 1071 | 356 | 208 | 1.30E-14 | [ac:q50735][gn:mtcy9c4.05c][or:mycobacterium tuberculosis][de:hypothetical 40.2 kd protein cy9c4.05c][sp:q50735][db:swissprot] |
| 16407892_c2_235 | 592 | 4246 | 597 | 198 | 91 | 0.0003 | [ac:p04102][gn:prm1:prm-1][or:ovis aries:capra hircus][sr:,sheep:goat][de:sperm protamine p1 (cysteine-rich protamine)][sp:p04102][db:swissprot] |
| 16410200_c2_57 | 593 | 4247 | 885 | 294 | 664 | 2.50E-65 | [ac:d69759][pn:hypothetical protein ycgq][gn:ycgq][or:bacillus subtilis][db:pir] |
| 16411604_c1_26 | 594 | 4248 | 315 | 104 | 536 | 9.30E-52 | [ac:p19775][gn:tnp][or:staphylococcus aureus][de:transposase for insertion sequence element is256 in transposon tn4001][sp:p19775][db:swissprot] |
| 16417811_c1_11 | 595 | 4249 | 243 | 80 | 60 | 0.23 | [ln:mgu02238][ac:u02238][or:mycoplasma genitalium][db:genpept-bct][de:mycoplasma genitalium random genomic clone xd3, partial cds.][nt:homology to methionyl-trna formyltransferase][le:1][re:349][di:complement] |
| 164193_c3_16 | 596 | 4250 | 633 | 210 | 289 | 1.40E-25 | [ac:q58206][gn:mj0796][or:methanococcus jannaschii][de:hypothetical abc transporter atp-binding protein mj0796][sp:q58206][db:swissprot] |
| 16431510_c2_40 | 597 | 4251 | 423 | 140 | 82 | 0.1 | [ln:middmcox2][ac:x81884][gn:cox1/2][or:mitochondrion dictyostelium discoideum][sr:dictyostelium discoideum][db:genpept-inv][de:d.discoideum mitochondrial cox1 gene and cox2 gene.][nt:cox1/2 intron 3 orf][le:3402][re:4049][di:direct] |
| 16444437_f3_66 | 598 | 4252 | 285 | 94 | 59 | 0.28 | [ac:p48267][gn:rps7][or:chlamydomonas reinhardtii][de:chloroplast 30s ribosomal protein 57 (fragment)][sp:p48267][db:swissprot] |
| 16448437_c1_26 | 599 | 4253 | 705 | 234 | 1198 | 6.50E-122 | [ln:llpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_c1_42 | 600 | 4254 | 705 | 234 | 1204 | 1.50E-122 | [ln:llpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_c3_23 | 601 | 4255 | 705 | 234 | 1198 | 6.50E-122 | [ln:llpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |

TABLE 2-continued

| Orf | NT Seq ID | AA Seq ID | NT Orf length | AA Orf length | Score | Probability | Description |
|---|---|---|---|---|---|---|---|
| 16448437_c3_63 | 602 | 4256 | 705 | 234 | 1184 | 2.00E-120 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f1_29 | 603 | 4257 | 390 | 129 | 616 | 3.10E-60 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f1_3 | 604 | 4258 | 705 | 234 | 1198 | 6.50E-122 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f2_16 | 605 | 4259 | 189 | 62 | 221 | 2.20E-18 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f2_4 | 606 | 4260 | 705 | 234 | 1204 | 1.50E-122 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f1_23 | 607 | 4261 | 705 | 234 | 1198 | 6.50E-122 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448437_f3_37 | 608 | 4262 | 705 | 234 | 1199 | 5.10E-122 | [n:l]lpk214][ac:x92946;y10522][pn:transposase][gn:tnpa][or:lactococcus lactis][db:genpept-bct][de:lactobacillus lactis plasmid pk214, complete sequence.][le:29084][re:29770][di:direct] |
| 16448581_c3_30 | 609 | 4263 | 711 | 236 | 75 | 0.1 | [ac:g69535][pn:carotenoid biosynthetic protein erwerts homolog][or:archaeoglobus fulgidus][db:pir] |
| 16454002_13_59 | 610 | 4264 | 330 | 109 | 60 | 0.23 | [n:af004340][ac:am04340][pn:atpase 6/8][or:mitochondrion homo sapiens][sr:human][db:genpept-pri2][de:homo sapiens atpase 618 gene, mitochondrial gene encoding mitochondrial protein, partial cds.][le:<1][re: |
| 16463952_f2_16 | 611 | 4265 | 396 | 131 | 199 | 4.80E-16 | [ac:d69874][pn:conserved hypothetical protein ylbg][gn:ylbg][or:bacillus subtilis][db:pir] |
| 6485305_c1_12 | 612 | 4266 | 213 | 70 | 53 | 0.55 | [n:ac000785][ac:ae000785][pn:conserved hypothetical protein][gn:bbe21][or:borrelia burgdorferi][sr:lyme disease spirochete][db:genpept-bct][de:borrelia burgdorferi plasmid lp25, complete plasmid sequence.][nt:similar to pid: 1174341 pid: 1174349 pe |
| 6485892_c1_43 | 613 | 4267 | 2742 | 913 | 2974 | 0 | [ac:p49022][gn:pip][or:lactococcus lactis][sr:subsplactis:streptococcus lactis][de:phage infection protein][sp:p49022][dbsswissprot] |
| 6492338_f3_21 | 614 | 4268 | 1038 | 345 | 713 | 1.60E-70 | [ac:d69856][pn:conserved hypothetical protein ykgb][gn:ykgb][or:bacillus subtilis][db:pir] |
| 6511067_c1_52 | 615 | 4269 | 492 | 163 | 139 | 2.30E-08 | [ac:h69877][pn:calcium-transporting atpase homolog ylob][gn:ylob][or:bacillus subtilis][db:pir] |
| 6517208_f3_36 | 616 | 4270 | 186 | 61 | 45 | 0.075 | [n:musvi][ac:d50805][pn:vimentin][gn:vim][or:mus musculus][sr:mus musculus (strain:balb/c) dna, clone_lib:embl-3 clonesp6/t7][db:genpept-rod][de:mouse vim gene for vimentin, promoter region and partial cds.][le:3333][re: |
| 6517552_f2_33 | 617 | 4271 | 996 | 331 | 1128 | 1.70t-1.14 | [ac:q54431:p96469][gn:ffh][or:streptococcus mutans][de:signal recognition particle protein (fifty-four homolog)][sp:q54431:p96469][dbsswissprot] |
| 6525317_c3_153 | 618 | 4272 | 567 | 188 | 89 | 0.075 | [ac:f64491][pn:hypothetical protein mj1535][or:methanococcus jannaschii][db:pir][mp:for1512872-1513771] |

TABLE 2-continued

| Orf | NT Seq ID | AA Seq ID | NT Orf length | AA Orf length | Score | Probability | Description |
|---|---|---|---|---|---|---|---|
| 6526562_f2_43 | 619 | 4273 | 705 | 234 | 1181 | 4.10E-120 | [ln:llpk214][ac:x92946;y10522][pn:transposase][gn:tnpa][or:*lactococcus lactis*][db:genpept-bct][de:*lactobacillus lactis* plasmid pk214, complete sequence.][ie:29084][re:29770][di:direct] |
| 16532202_f1_13 | 620 | 4274 | 924 | 307 | 1197 | 8.40E-122 | [ac:p00343][gn:ldh][or:*lactobacillus casei*][ec:1.1.1.27][de:1-lactate dehydrogenase,][sp:p00343][db:swissprot] |
| 16532250_c2_38 | 621 | 4275 | 2289 | 762 | 406 | 3.50E-37 | [ln:erwpell][ac:142248][pn:pectate lyase][gn:pell][or:*erwinia chrysanthemi*][db:genpept-bct][de:*erwinia chrysanthemi* pectate lyase isozyme (pell) gene, completeeds.][ie:233][re:1510][di:direct] |
| 16558_f2_8 | 622 | 4276 | 1068 | 355 | 973 | 4.60E-98 | [ac:p46343][gn:phoh][or:*bacillus subtilis*][de:phoh protein homolog.][sp:p46343][db:swissprot] |
| 16579625_c3_17 | 623 | 4277 | 1191 | 396 | 946 | 3.30E-95 | [ac:p25744][gn:yccc][or:*escherichia coli*][de:hypothetical 43.9 kd protein in msyb-htrb intergenic region (orf1).][sp:p25744][db:swissprot] |
| 165887_f1_3 | 624 | 4278 | 183 | 60 | 69 | 0.3 | [ac:p30609][gn:cyp52a7][or:*candida tropicalis*][sr:,yeast][ec:1.14.14.1][de:cytochrome p450) iia7 (alkane-inducible), (p450-alk4)][sp:p30609][db:swissprot] |
| 16593760_c2_133 | 625 | 4279 | 918 | 305 | 1171 | 4.80E-119 | [ln:af029727][ac:af029727][pn:transposase][or:*enterococcus faecium*][db:genpept-bct][de:*enterococcus faecium* insertion sequence is1485, complete sequence.][nt:*putative transposase*][le:76:330][re:330:1238][di:directjoin] |
| 16593760_c2_22 | 626 | 4280 | 918 | 305 | 1155 | 2.40E-117 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_c3_69 | 627 | 4281 | 726 | 241 | 418 | 3.00E-39 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_f1_1 | 628 | 4282 | 264 | 87 | 196 | 3.60E-15 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_f1_3 | 629 | 4283 | 918 | 305 | 1567 | 5.20E-161 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_f2_11 | 630 | 4284 | 918 | 305 | 1572 | 1.50E-161 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_f2_8 | 631 | 4285 | 918 | 305 | 1575 | 7.30E-162 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |
| 16593760_f3_29 | 632 | 4286 | 918 | 305 | 1575 | 7.30E-162 | [ln:af029727][ac:af029727][pn:transposase][or:*enterococcus faecium*][db:genpept-bct][de:*enterococcus faecium* insertion sequence is1485, complete sequence.][nt:putative transposase][le:76:330][re:330:1238][di:directjoin] |

TABLE 2-continued

| Orf | NT Seq ID | AA Seq ID | NT Orf length | AA Orf length | Score | Probability | Description |
|---|---|---|---|---|---|---|---|
| 16595285_c3_34 | 633 | 4287 | 627 | 208 | 276 | 3.30E-24 | [ln:smachita][ac:138484] [pn:chitinase][or:*serratia marcescens*][dbgenpept-bct][ec:3.2.1.14][de:*serratia marcescens* basic 21 kda chitinase and acidic 54 kdachitinase genes, complete cds.) [nt:basic extracellular 21 kd protein][le:3096][re:3779] [di |
| 16598428_c1_44 | 634 | 4288 | 195 | 64 | 59 | 0.28 | [ac:p29773] [gn:ets-2] [or:*lytechinus variegatus*][sr:,sea urchin][de:c-ets-2 protein (fragment)][sp:p29773][dbswissprot] |
| 16600202_f2_8 | 635 | 4289 | 1011 | 336 | 513 | 2.50E-49 | [ac:jc4292][pn:insertion sequence element 1341:orf169 protein][gn:acp][or:thermophilic bacterium ps-3][db:pir] |
| 16600832_c2_6 | 636 | 4290 | 387 | 128 | 120 | 3.80E-07 | [ln:shu75349][ac:u75349][pn:putative permease shid) [or:*serpulina hyodysenteriae*] [dbgenpept-bct][de:*serpulina hyodysenteriae* shi operon, periplasmic-iron-bindingproteins shia and shib, putative abc transporter shic, and putativepermeases shid and shi |
| 16601568_c2_129 | 637 | 4291 | 207 | 68 | 52 | 0.085 | [ln:jcvyky2av][ac:d26591][pn:vp1 (capsid protein)][or:jc virus] [sr:jc virus (isolate tky-2a) isolated from brain of a pm1 patient dna][dbgenpept-vrl][de:jc virus gene for vp1 (capsid protein), complete cds.][le:1][re:1065][di:direct] |
| 16601590_c2_11 | 638 | 4292 | 1101 | 366 | 1037 | 7.50E-105 | [ac:p54518][gn:yqht][or:*bacillus subtilis*][ec:3.4.—.—.—][de:*putative peptidase* in gevt-spoiiaa intergenic region,][sp:p54518][dbswissprot] |
| 16601592_c2_36 | 639 | 4293 | 708 | 235 | 655 | 2.30E-64 | [ac:s49455][pn:deoxyribose-phosphate aldolase,][gn:dra][or:*bacillus subtilis*][ec:4.1.2.4][dbpir] |
| 16603438_c2_62 | 640 | 4294 | 267 | 88 | 177 | 1.00E-13 | [acq38441][or:*bacteriophage sppt*][de:hypothetical 10.3 kd protein in gp2-gp6 intergenic region (orf 5)][sp:q38441] [dbswissprot] |
| 16604162_c3_73 | 641 | 4295 | 393 | 130 | 212 | 2.00E-17 | [ln:cpu15027][ac:u15027][pn:tnpv][gn:tnpv) [or:*clostridium perfringens* ][dbgenpept-bct][de:*clostridium perfringens* transposon tn4451 site-specific recombinase(tnpx), chloramphenicol acetyltransferase (catp), tnpv, tnpy, tnpz, and tnpw gen |
| 16604687_c1_145 | 642 | 4296 | 372 | 123 | 121 | 8.80E-08 | [ac:q05070][or:*anabacna* sp][srpcc 7120,][de:hypothetical protein in ntca/bifa 5'region (orf5) (fragment)][sp:q05070][dbswissprot] |
| 16604813_c2_39 | 643 | 4297 | 1206 | 401 | 949 | 1.60E-95 | [acp39587][gn:ywhd:ipa-19d][or:*bacillus subtilis*][de:hypothetical 44.4 kd protein in epr-galk intergenic region][sp:p39587] [dbswissprot] |
| 16609642_f2_3 | 644 | 4298 | 1950 | 649 | 2209 | 4.80E-229 | [ac:p45694] [gn:tkt:tkta ][or:*bacillus subtilis*][ec:2.2.1.1][de:transketolase,) [sp:p45694][dbswissprot] |
| 16613150_f1_3 | 645 | 4299 | 243 | 80 | 63 | 0.61 | [ac:p21075] [gn:b171][or:*vaccinia virus*][sr:copenhagen,][de:protein b17][sp:p21075][dbswissprot] |
| 16614531_c3_54 | 646 | 4300 | 720 | 239 | 628 | 1.70E-61 | [ac:b69626][pn:pts fructose-specific enzyme iibc component frua][gn:frua][or:*bacillus subtilis*][db:pir] |
| 16617212_c3_11 | 647 | 4301 | 657 | 218 | 187 | 8.90E-15 | [ac:a57362][pn:gyrb protein][gn:gyrb][or:*streptococcus pneumoniae*][db:pir] |
| 16617337_c2_138 | 648 | 4302 | 534 | 177 | 432 | 9.70E-41 | [ac:c69671][pn:transcriptional repressor of sporulation, septation and degrad paia][gn:paia][or:*bacillus subtilis*][db:pir] |
| 16620260_f1_7 | 649 | 4303 | 204 | 67 | 61 | 0.55 | [ln:af004325][ac:af004325][pn:putative udp-n-acetyl-d-mannosamine transferase][gn:cps19bf][or:*streptococcus pneumoniae* capsular serotype 19b capsule biosynthesislocus, cps19bf gene, partial cds, cps19bg, |

TABLE 2-continued

| Orf | NT Seq ID | AA Seq ID | NT Orf length | AA Orf length | Score | Probability | Description |
|---|---|---|---|---|---|---|---|
| 1665_c3_36 | 650 | 4304 | 1920 | 639 | 1155 | 2.40E-117 | [ac:p47762][gn:dnag][or:*listeria monocytogenes*][ec:2.7.7.—][de:dna primase,][sp:p47762][db:swissprot] |
| 16676387_f1_1 | 651 | 4305 | 363 | 120 | 296 | 2.50E-26 | [ac:p35154][gn:ypug][or:*bacillus subtilis*][de:hypothetical 29.6 kd protein in rib-dacb intergenic region (orfx7)][sp:p35154][db:swissprot] |
| 16679668_f3_40 | 652 | 4306 | 231 | 76 | 69 | 0.088 | [n:meu40036][ac:u40036][pn:myosin heavy chain][or:*mytilus edulis*][sr:blue mussel][db:genpept-inv][de:*mytilus edulis* catch muscle myosin heavy chain mrna, partial cds.][nt:catch muscle isoform; ser-190 is phosphorylatable][le:<1][re:609][di:dire |
| 16682836_f2_4 | 653 | 4307 | 327 | 108 | 162 | 4.00E-12 | [ac:c69844][pn:hypothetical protein yjbk][gn:yjbk][or:*bacillus subtilis*][db:pir] |
| 16695192_f1_3 | 654 | 4308 | 1386 | 461 | 1438 | 2.40E-147 | [ac:p37469][gn:dnac][or:*bacillus subtilis*)][ec:3.6.1.—][de:replicative dna helicase,][sp:p37469][db:swissprot] |
| 16695317_c3_70 | 655 | 4309 | 273 | 90 | 233 | 1.20E-19 | [ac:p12049][gn:yexa][or:*bacillus subtilis*][de:hypothetical 9.7 kd protein in pur operon][sp:p12049][db:swissprot] |
| 167702_c3_74 | 656 | 4310 | 519 | 172 | 313 | 4.001E-28 | [ac:p94559][gn:ysnb][or:*bacillus subtilis*][de:hypothetical 19.2 kd protein in rph-ilvb intergenic region][sp:p94559][db:swissprot] |
| 16796885_c3_49 | 657 | 4311 | 492 | 163 | 581 | 1.60E-56 | [ac:p36922][or:*enterococcus faecalis*][sr:*streptococcus faecalis*][de:ebsc protein][sp:p36922][db:swissprot] |
| 16800252_c3_51 | 658 | 4312 | 1128 | 375 | 107 | 0.021 | [ln:pf111a][ac:x07453;x66268][pn:11-1 polypeptide][gn:11-1][or:*plasmodium falciparum*][sr:*malaria parasite*][db:genpept-inv][de:*plasmodium falciparum* 11-1 gene part 1.][le:579;899][re:791: |
| 16803437_c3_82 | 659 | 4313 | 858 | 285 | 99 | 0.023 | [ln:spemm25][ac:x92370][pn:m25 protein][gn:emm25][or:*streptococcus pyogenes*][db:genpept-bct][de:*s.pyogenes* cmm25 gene.][le: 1][re:1215] [di:direct] |
| 16807181_f1_5 | 660 | 4314 | 390 | 129 | 73 | 0.76 | [ac:p17854][gn:cysh][or:*escherichia coli*][ec:1.8.99.4][de:phosphoadenylylsulfate reductase)][sp:p17854][db:swissprot] |
| 16812775_c2_32 | 661 | 4315 | 261 | 86 | 64 | 0.092 | [ln:ac001129][ac:ae001129;ae000783][pn:ribosomal protein 135 (rpmi)][gn:bb0189] [or:*borrelia burgdorferi*][sr:lyme disease spirochete][db:genpept-bct][de:*borrelia burgdorferi* (section 15 of 70) of the complete genome.][nt:similar to gb:m76589 sp:p49 |
| 16812775_c3_52 | 662 | 4316 | 261 | 86 | 59 | 0.42 | [ln:nphlefla][ac:109723][pn:ecdysteroid udp-glucosyltransferase][gn:egt][fn:transfers glucose from udpglucose to][or:*autographa californica* nuclear polyhedrosis virus][sr:*autographa californica* nuclear polyhedrosis virus (strain 1-1) dna][db:genpep |
| 16824092_f1_6 | 663 | 4317 | 726 | 241 | 687 | 9.20E-68 | [ac:p06190][gn:arad][or:*salmonella typhimurium*][ec:5.1.3.4][de:1-ribulose-5-phosphate4-epimerase,][sp:p06190] [db:swissprot] |
| 16824135_c1_48 | 664 | 4318 | 1134 | 377 | 1193 | 2.20E-121 | [ac:p54453][gn:yqeh][or:*bacillus subtilis*][de:hypothetical 41.0 kd protein in nucb-arod intergenic region][sp:p54453][db:swissprot] |
| 16828451_c1_10 | 665 | 4319 | 357 | 118 | 66 | 0.84 | [ln:cee103a10][ac:z69793][pn:r03a10.1][or:*caenorhabditis elegans*][db:genpept-inv][de:*caenorhabditis elegans* cosmid r03a10, complete sequence.][nt:protein predicted using genefinder][le:2355:3106;3224][re:2496;3170:3286][di:complement|join] |
| 16829467_c1_39 | 666 | 4320 | 276 | 91 | 292 | 6.60E-26 | [ac:f69835][pn:ribosomal protein s14 homolog yhza][gn:yhza][or:*bacillus subtilis*][db:pir] |
| 16829703_c2_2 | 667 | 4321 | 228 | 75 | 229 | 8.5012-19 | [ac:p03764][or:*bacteriophage lambda*][de:hypothetical protein orf401][sp:p03764][db:swissprot] |
| 16830063_f3_11 | 668 | 4322 | 936 | 311 | 368 | 5.90E-34 | [ac:p46456][gn:purr:hi1635][or:*haemophilus influenzae*][de:purine nucleotide synthesis repressor][sp:p46456][db:swissprot] |

TABLE 2-continued

| Orf | NT Seq ID | AA Seq ID | NT Orf length | AA Orf length | Score | Probability | Description |
|---|---|---|---|---|---|---|---|
| 16831287_f1_7 | 669 | 4323 | 396 | 131 | 565 | 7.80E-55 | [acp04969][gn:rpsk][or:*bacillus subtilis*][de:30s ribosomal protein s11 (bs11)][sp:p04969][db:swissprot] |
| 16835930_f3_22 | 670 | 4324 | 420 | 139 | 234 | 9.30E-20 | [ln:lohsp18][acc:x99468][pn:heat shock protein][gn:hsp18][or:*oenococcus oeni*][db:genpept-bct][de:*l.oenos* hsp18 gene.][nt:18kda][le:138][re:584][di:direct] |
| 16837628_c3_207 | 671 | 4325 | 312 | 104 | 348 | 7.70E-32 | [acp43435][gn:ntpd][or:*enterococcus hirae*][ec:3.6.1.34][de:translocating atpase subunit d)][sp:p43435][db:swissprot] |
| 16838576_c1_59 | 672 | 4326 | 843 | 280 | 96 | 0.024 | [acs68125:s45091][pn:hypothetical protein iota][or:*streptococcus pyogenes*][db:pir] |
| 16839017_c3_17 | 673 | 4327 | 744 | 247 | 778 | 2.100E-77 | [acc69334][pn:glutamine abc transporter, atp-binding protein (glnq) homolog][or:*archaeoglobus fulgidus*][db:pir] |
| 16846093_c3_34 | 674 | 4328 | 495 | 164 | 194 | 1.40E-14 | [acp44714][gn:frua:hi0446][or:*haemophilus influenzae*][ec:2.7.1.69][de:(ec 2.7.1.69) (eii-fru)][sp:p44714][db:swissprot] |
| 16855453_c3_42 | 675 | 4329 | 849 | 282 | 92 | 0.029 | [acp44064][gn:hi0869][or:*haemophilus influenzae*][de:hypothetical protein hi0869][sp:p44064][db:swissprot] |
| 16875000_c2_179 | 676 | 4330 | 408 | 135 | 52 | 0.97 | [acc41903][pn:recombinase bin3][or:*staphylococcus aureus*][db:pir] |
| 16881680_f3_36 | 677 | 4331 | 393 | 130 | 61 | 0.25 | [ln:72604][acs72604][gn:all-1-af17][or:*homo sapiens*][sr:human acute myeloid leukemia patient][db:genpept-pri2][de:af17 . . . all-1 {reciprocal translocation} [human, acute myeloid leukemia patient, mrna partial mutant, 3 genes, 228 nt].][nt:leucine-zi |
| 16882140_c3_15 | 678 | 4332 | 219 | 72 | 158 | 7.40E-11 | [acg53610][pn:ntpj protein][or:*enterococcus hirae*][db:pir] |
| 16883505_c3_36 | 679 | 4333 | 864 | 287 | 428 | 2.60E-40 | [acp42095][gn:yqxn:yqfi][or:*bacillus subtilis*][de:(orf3)][sp:p42095][db:swissprot] |
| 16989701_f3_11 | 680 | 4334 | 252 | 83 | 136 | 2.30E-09 | [ln:spac57a10][acc:z94864][pn:unknown][gn:spac57a10.03][or:*schizosaccharomyces pombe*][sr:fission yeast][db:genpept-pln][de:*s.pombe* chromosome i cosmid c57a10.][nt:spac57a10.03, cyclophilin-related, len.156aa,][le:5344:5414:5521:5779][re:5373:5455 |
| 16989717_f3_23 | 681 | 4335 | 2784 | 927 | 1119 | 5.90E-120 | [acp23914][gn:levr][or:*bacillus subtilis*][de:transcriptional regulatory protein levr][sp:p23914][db:swissprot] |
| 16990753_c2_64 | 682 | 4336 | 216 | 71 | 63 | 0.12 | [aca61429][pn:m protein pepm57][cl:m5 protein][or:*streptococcus pyogenes*][db:pir] |
| 16995162_c1_18 | 683 | 4337 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_c1_5 | 684 | 4338 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_c2_220 | 685 | 4339 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_c3_106 | 686 | 4340 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_c3_11 | 687 | 4341 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_c3_18 | 688 | 4342 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_f1_5 | 689 | 4343 | 192 | 63 | 46 | 0.25 | [acp09639][gn:atpa][or:*sulfolobus acidocaldarius*][ec:3.6.1.34][de:alpha)][sp:p09639][db:swissprot] |
| 16995162_f2_39 | 690 | 4344 | 192 | 63 | 46 | 0.25 | [acp09639][gn:atpa][or:*sulfolobus acidocaldarius*][ec:3.6.1.34][de:alpha)][sp:p09639][db:swissprot] |

TABLE 2-continued

| Orf | NT Seq ID | AA Seq ID | NT Orf length | AA Orf length | Score | Probability | Description |
|---|---|---|---|---|---|---|---|
| 16995162_f2_7 | 691 | 4345 | 246 | 81 | 74 | 0.059 | [ln:llu36837][ac:u36837][pn:recа(p)][or:*lactococcus lactis*][db:genpept-bct][de:*lactococcus lactis* plasmid pnp40, abortive infection locus, abici,abieii,reca(lp), abif genes, complete cds.][re:21 18][re:3143][di:complement] |
| 16995162_f2_70 | 692 | 4346 | 192 | 63 | 46 | 0.25 | [ac:p09639][gn:atpa][or:*sulfolobus acidocaldarius*][ec:3.6.1.34][de:alpha)][sp:p09639][dbs:swissprot] |
| 16995162_f3_36 | 693 | 4347 | 192 | 63 | 46 | 0.25 | [ac:p09639][gn:atpa][or:*sulfolobus acidocaldarius*][ec:3.6.1.34][de:alpha)][sp:p09639][dbs:swissprot] |
| 16995162_f3_41 | 694 | 4348 | 192 | 63 | 46 | 0.25 | [ac:p09639][gn:atpa][or:*sulfolobus acidocaldarius*][ec:3.6.1.34][de:alpha)][sp:p09639][dbs:swissprot] |
| 17000052_c2_33 | 695 | 4349 | 1017 | 338 | 60 | 0.86 | [ac:b61430][pn:glucose-6-phosphate 1-dehydrogenase,][cl:glucose-6-phosphate dehydrogenase][or:*pichia:jadinii*:candida utilis][cc:1.1.1.49][db:pir] |
| 17010925_f2_15 | 696 | 4350 | 204 | 67 | 286 | 2.90E-25 | [ac:s46088:s59054][pn:ribosomal protein s14][gn:rps14][cl:*escherichia coli* ribosomal protein s 14][or:*bacillus stearothermophilus*][db:pir] |
| 17011635_f2_5 | 697 | 4351 | 705 | 234 | 103 | 0.0072 | [ln:ac001157;ac000783][pn:*b.burgdorferi* predicted coding region bb0553][gn:bb0553][or:*borrelia burgdorferi*][sr:lyme disease spirochete][db:genpept-bct][de:*borrelia burgdorferi* (section 43 of 70) of the complete genome.][nt:hypothetic |
| 1702_f1_22 | 698 | 4352 | 1008 | 335 | 98 | 0.029 | [ac:p44883][gn:mglb:hi0822][or:*haemophilus influenzae*][de:d-glucose binding protein) (ggbp)][sp:p44883][dbs:swissprot] |
| 17036301_f2_54 | 699 | 4353 | 234 | 77 | 72 | 0.064 | [ln:bk5tattp][ac:144593][fn:unidentified][or:*lactococcus lactis* phage bk5-t][sr:bacteriophage bk5-t dna][db:genpept-phg][de:bacteriophage bk5-t orf410, 3' end pf cds, 20 orfs, repressor protein, and cro repressor protein genes, complete cds, orf70g |
| 17042211_c1_37 | 700 | 4354 | 222 | 73 | 64 | 0.85 | [ln:af027272][ac:af027272][pn:nadh dehydrogenase][gn:ndbf][or:chloroplast *tetrachondra patagonica*][sr: *tetrachondra patagonica*][db:genpept-ptn][de:*tetrachondra patagonica* nadh dehydrogenase (ndbf) gene, chloroplast gene encoding chloroplast protein, |
| 17070937_f1_4 | 701 | 4355 | 414 | 137 | 75 | 0.32 | [ln:reef33e2][ac:z84574][pn:f33e2.4][or:*caenorhabditis elegans*][db:genpept-inv][de:*caenorhabditis elegans* cosmid f33c2, complete sequence.][nt:protein predicted using genefinder][re:13739:14142:14295:14710][re:13849:14238:14503:14766][di:directjoi |
| 17071017_f3_9 | 702 | 4356 | 207 | 68 | 72 | 0.13 | [ln:ceec06c3][ac:z36719][pn:c06c3.6][or:*caenorhabditis elegans*][db:genpept-inv][de:*caenorhabditis elegans* cosmid c06c3, complete sequence.][re:20375:21390:21826:22018][re:20496:21776:21974:22214][di:directjoin] |
| 17072332_c1_47 | 703 | 4357 | 261 | 86 | 64 | 0.11 | [ac:a44828][pn:alkaline phosphatase i][or:*bacillus licheniformis*][db:pir] |
| 17078392_c2_4 | 704 | 4358 | 498 | 166 | 859 | 5.50E-86 | [ac:p77432:q99894][gn:ydev][or:*escherichia coli*][de:hypothetical sugar kinase in hipb-uxab intergenic region][sp:p77432:q99894][dbs:swissprot] |
| 1712_c2_128 | 705 | 4359 | 1173 | 390 | 745 | 6.60E-74 | [ac:p42319][gn:yxjh:nlsor][or:*bacillus subtilis*][de:hypothetical 38.3 kd protein in katb 3'region][sp:p42319][dbs:swissprot] |
| 1713_f2_20 | 706 | 4360 | 447 | 148 | 256 | 4.30E-22 | [ac:p44558][gn:hi0186][or:*haemophilus influenzae*][de:hypothetical transcriptional regulator hi0186][sp:p44558][dbs:swissprot] |
| 172277_f1_15 | 707 | 4361 | 201 | 66 | 76 | 0.041 | [ac:p52371][gn:gm:39][or:*equine herpesvirus* type 2][sr:86/87, ehv-2][de:glycoprotein m][sp:p52371][dbs:swissprot] |

TABLE 2-continued

| Orf | NT Seq ID | AA Seq ID | NT Orf length | AA Orf length | Score | Probability | Description |
|---|---|---|---|---|---|---|---|
| 172281_c1_22 | 708 | 4362 | 1266 | 421 | 868 | 6.10E-87 | [ac:d69596][pn:branched-chain amino acid transporter brnq][gn:brnq][or:bacillus subtilis][db:pir] |
| 172558_f2_21 | 709 | 4363 | 195 | 64 | 59 | 0.49 | [ac:p17175][gn:u14][or:human cytomegalovirus][sr:towne.][de:early glycoprotein gp48 precursor][sp:p17175][db:swissprot] |
| 181252_c2_63 | 710 | 4364 | 225 | 74 | 60 | 0.042 | [ln:pau69261][ac:u69261][pn:cr-pii allergen][or:periplaneta americana][sr:american cockroach][db:genpept-inv][de:periplaneta americana cr-pii allergen mrna, partial cds.][le:<1][re:826][di:direct] |
| 181687_f2_54 | 711 | 4365 | 462 | 153 | 267 | 3.00E-23 | [ac:p42015][gn:ptsg][or:bacillus stearothermophilus][ec:2.7.1.69][de:component), (eii-glc/ciii-glc) (fragment)][sp:p42015][db:swissprot] |
| 18460188_c2_20 | 712 | 4366 | 1758 | 585 | 628 | 6.40E-89 | [ac:s36606:s46953][pn:phosphotransferase system enzyme ii,, glucose-specific, factor iib:glucose permease:phosphoenolpyruvate: glucose phosphotransferase system enzyme ii, glucose-specific: protein-npi-phosphohistidine--sugar phosphotransferase, glucose-sp |
| 187502_f3_9 | 713 | 4367 | 747 | 248 | 101 | 0.0026 | [ac:b69915][pn:hypothetical protein yoms][gn:yons][or:bacillus subtilis][db:pir] |
| 189717_c2_62 | 714 | 4368 | 1374 | 457 | 1509 | 7.20E-155 | [ac:b69745][pn:phosphoglucomutase(glycolysis) homolog ybbt][gn:ybbt][or:bacillus subtilis][db:pir] |
| 194093_c1_27 | 715 | 4369 | 354 | 117 | 413 | 1.00E-38 | [ac:s68609][pn:recombinase sin][or:staphyloccocus aureus][db:pir] |
| 194452_f3_21 | 716 | 4370 | 258 | 85 | 90 | 0.00036 | [ln:bbu80959][ac:u80959:178251][pn:putative outer membrane protein][gn:ospfi][or:borrelia burgdorferi][sr:lyme disease spirochete][db:genpept-bct][de:borrelia burgdorferi strain n40ch putative outer membrane protein(ospfi) gene, complete cds.][nt: |
| 19531500_f3_17 | 717 | 4371 | 210 | 69 | 69 | 0.058 | [ln:cmu23045][ac:u23045][pn:nadh dehydrogenase subunit 6][or:mitochondrion cepaea nemoralis][sr:banded wood snail][db:genpept-inv][de:cepaea nemoralis complete mitochondrial genome.][nt:followed by putative incomplete stop codon 'ta'][le:2884]re |
| 19531556_f3_71 | 718 | 4372 | 186 | 61 | 64 | 0.58 | [ac:p42907][gn:agas][or:escherichia coli][de:agas protein][sp:p42907][db:swissprot] |
| 19531707_c1_37 | 719 | 4373 | 186 | 61 | 68 | 0.0015 | [ac:p34296][gn:c06e1.1][or:caenorhabditis elegans][de:hypothetical 18.7 kd protein c06e1.1 in chromosome iii][sp:p34296][db:swissprot] |
| 19532077_c2_13 | 720 | 4374 | 303 | 100 | 155 | 4.60E-11 | [ac:b47092][pn:copy control protein repb][gn:repb][or:enterococcus faecalis][db:pir] |
| 19532265_c2_132 | 721 | 4375 | 327 | 108 | 103 | 7.10E-06 | [ln:lbphihol][ac:x90511][gn:gp162][or:bacteriophage phig1e][db:genpept-phg][de:lactobacillus bacteriophage phig1e dna for rorf162, holin, lysin,and rorf175 genes.][le:431][re:919][di:direct] |
| 19532312_f1_8 | 722 | 4376 | 939 | 312 | 172 | 5.70E-12 | [ac:g98899][pn:transcriptional regulator(arac/xyls famil) homolog yobq][gn:yobq][or:bacillus subtilis][db:pir] |
| 19532500_f1_4 | 723 | 4377 | 228 | 75 | 74 | 0.081 | [ac:p52150][gn:pura][or:spiroplasma citri][ec:6.3.4.4][de:adenylosuccinate synthetase, (imp--aspartate ligase)][sp:p52150][db:swissprot] |
| 19532532_f2_9 | 724 | 4378 | 234 | 77 | 57 | 0.1 | [ln:mtcy01b2][ac:z95554][pn:rpsa][gn:rpsa][or:mycobacterium tuberculosis][db:genpept-bct][de:mycobacterium tuberculosis cosmid scy01b2.][nt:mtcy01b2.22, rpsa. len: 481. function: ribosomal][le:24733][re:26178][di:direct] |

TABLE 2-continued

| Orf | NT Seq ID | AA Seq ID | NT Orf length | AA Orf length | Score | Probability | Description |
|---|---|---|---|---|---|---|---|
| 19533467_f1_1 | 725 | 4379 | 405 | 134 | 348 | 7.70E-32 | [ln:ehnapbc][ac:a000346][pn:napc protein][gn:napc][fn:putative tetracyclin efflux protein][or:enterococcus hirae][db:genpept-bct][de:enterococcus hirae napb and nape genes.][nt:telve predicted transmembranous helices][lec:756][re:1958][di:direc |
| 19534051_f1_11 | 726 | 4380 | 336 | 111 | 66 | 0.057 | [ln:tr:bvsgbr2][ac:m28617][or:trypanosoma brucei][sr:trypanosoma brucei (strain 427), cdna to mrna][db:genpept-inv][de:trypanosome variant surface glycoprotein (vsg br-2) mrna, 3'end.][nt:precursor variant surface glycoprotein br-2][le:<1][re:131] |
| 19541432_c1_38 | 727 | 4381 | 756 | 251 | 444 | 5.20E-42 | [ac:a69787][pn:hypothetical protein ydih][gn:ydih][or:bacillus subtilis][db:pir] |
| 19542257_c3_165 | 728 | 4382 | 237 | 78 | 106 | 2.90E-05 | [ln:efu63997][ac:u63997][or:enterococcus faccium][db:genpept-bct][de:enterococcus faccium insertion sequence is1476 putative transposasegene, complete eds.][nt:putative transposase][le:140][re:1414][di:direct] |
| 19542712_f3_12 | 729 | 4383 | 216 | 71 | 56 | 0.0017 | [ln:d90890][ac:d90890:ab001340][pn:succinate-semialdehyde dehydrogenase (nadp+) (ec)][gn:gabd][or:escherichia coli][sr:escherichia coli (strain:k12) dna, clone_lib:kohara lambda minise[dbgenpept-bct][dc:c.coli genomic dna, kohara clone #443(59.8-6 |
| 195463_c3_79 | 730 | 4384 | 297 | 98 | 64 | 0.092 | [ln:pf111d][ac:x07456][or:plasmodium falciparum][sr:malaria parasite][db:genpept-inv][de:plasmodium falciparum 11-1 gene part 4.][nt:partial 11-1 gene protein (72 aa)][le:<1][re: |
| 19554768_f2_10 | 731 | 4385 | 315 | 104 | 105 | 4.40E-06 | [ln:strinte][ac:129324][pn:orf11][or:streptococcus pneumoniae][dbgenpept-bct][de:streptococcus pneumoniae putative integrase, putative orf2,putative excisionase, putative orf7, putative repressor protein,putative orf8, putative dna relaxase, putativ |
| 19562658_c2_151 | 732 | 4386 | 1524 | 507 | 848 | 8.00E-85 | [ac:d69985][pn:dna mismatch repair protein homolog yshd][gn:yshd][or:bacillus subtilis][db:pir] |
| 19562658_f2_6 | 733 | 4387 | 243 | 81 | 62 | 0.28 | [ln:cec43d7][ac:z81483][pn:c43d7.f][or:caenorhabditis elegans][db:genpept-inv][de:caenorhabditis elegans cosmid c43d7, complete sequence.][nt:protein predicted using genefinder; preliminary][le:21691:22057:22233][re:21993:22173:22277][di:directjo |
| 19562900_c3_111 | 734 | 4388 | 2313 | 770 | 1003 | 3.00E-101 | [ac:h70040][pn:hypothetical protein yvgs][gn:yvgs][or:bacillus subtilis][db:pir] |
| 19565902_c2_133 | 735 | 4389 | 555 | 184 | 453 | 5.80E-43 | [ac:e69814][pn:conserved hypothetical protein yfnb][gn:yfnb][or:bacillus subtilis][db:pir] |
| 19569463_c1_39 | 736 | 4390 | 960 | 319 | 471 | 7.20E-45 | [ac:p29824][gn:lacg][or:agrobacterium radiobacter][de:lactose transport system permease protein lacg][sp:p29824][db:swissprot] |
| 19570327_c1_99 | 737 | 4391 | 495 | 164 | 127 | 2.00E-08 | [ln:ae001148][ac:ae001148:ae000783][pn:b. burgdorferi predicted coding region bb0426][gn:bb0426][or:borretia burgdorferi][sr:lyme disease spirochete][db:genpept-bct][de:borrelia burgdorferi (section 34 of 70) of the complete genome.][nt:hypothetic |
| 19571063_c2_102 | 738 | 4392 | 207 | 68 | 65 | 0.21 | [ac:146059][pn:beta-1 integrin subunit][cl:integrin beta chain][or:bos primigenius taurus][sr:, cattle][db:pir] |
| 19572337_f2_15 | 739 | 4393 | 2604 | 867 | 955 | 3.70E-96 | [ln:d85082][ac:d85082][pn:yfix][or:bacillus subtilis][sr:bacillus subtilis dna][db:genpept-bct][de:bacillus subtilis dna, genome sequence, 79 to 81 degree region.][le:7094][re:8926][di:direct] |

TABLE 2-continued

| Orf | NT Seq ID | AA Seq ID | NT Orf length | AA Orf length | Score | Probability | Description |
|---|---|---|---|---|---|---|---|
| 1957825_f2_9 | 740 | 4394 | 192 | 63 | 57 | 0.039 | [ln:ab009862][acc:ab009862][pn:outer surface protein a][gn:ospa][or:borrelia garinii][sr:borrelia garinii (strain:kku5) dna][db:genpept-bct][de:borrelia garinii gene for outer surface protein a, partial cds.][ie:<1][re: |
| 195787_f1_1 | 741 | 4395 | 426 | 141 | 220 | 2.80E-18 | [acc:e69702][pn:holliday junction dna helicase ruva][gn:ruva][or:bacillus subtilis][db:pir] |
| 19579510_c2_30 | 742 | 4396 | 342 | 113 | 54 | 0.73 | [ln:hivu52486][acc:u52486][gn:nef][or:human immunodeficiency virus type 1][db:genpept-vrl][de:human immunodeficiency virus type 1 nef gene, complete sequence.][nt:premature stop codon][ie:1][re:174][di:direct] |
| 1957963_f2_10 | 743 | 4397 | 1182 | 393 | 1066 | 6.40E-108 | [acc:p35881][or:lactococcus lactis][sr.subsplactis:streptococcus lactis][dc:transposase for insertion sequence element is905][sp:p35881][db:swissprot] |
| 19581552_c3_25 | 744 | 4398 | 507 | 168 | 136 | 5.40E-13 | [ln:bpu53767][acc:u53767][or:bacillus pumilus][sr:bacillus pumilus strain=sh1451][db:genpept-bct][de:bacillus pumilus plasmid psh 1452, rep gene, complete cds.][nt:orf6; similar to ansr genbank accession number][ie:4525][re:5160][di:complement] |
| 1960012_c1_43 | 745 | 4399 | 183 | 60 | 69 | 0.029 | [ln:chy14328][acc:y14328][pn:3e1 protein][or:entamoeba histolytica][db:genpept-inv][de:entamoeba histoytica mrna for 3e1 protein.][ie:32][re:418][di:direct] |
| 1960199_c1_8 | 746 | 4400 | 448 | 149 | 414 | 7.80E-39 | [acc:g69830][pn:lipoate-protein ligase homolog yhtj][gn:yhtf][or:bacillus subtilis][db:pir] |
| 19613416_c2_11 | 747 | 4401 | 210 | 69 | 80 | 0.0069 | [ln:ecu82664][acc:u82664][or:escherichia coli][db:genpept-bct][de:escherichia coli minutes 9 to 11 genomic sequence.][nt:hypothetical protein][ie:133380][re:134166][di:direct] |
| 1961592_f2_2 | 748 | 4402 | 870 | 289 | 769 | 1.90E-76 | [acc:p46338][gn:yggg][or:bacillus subtilis][de:region precursor (orf108)][sp:p46338][db:swissprot] |
| 19617813_c1_53 | 749 | 4403 | 345 | 114 | 414 | 7.80E-39 | [acc:g69633][pn:glutamine abc transporter (atp-binding protein) glnq][gn:glnq][or:bacillus subtilis][db:pir] |
| 19631430_f2_10 | 750 | 4404 | 210 | 69 | 72 | 0.39 | [acc:jc6009][pn:surface-located membrane protein lmp3][gn:lmp3][or:mycoplasma hominis][db:pir] |
| 1964457_c3_22 | 751 | 4405 | 237 | 78 | 65 | 0.073 | [acc:p5768][or:halobacterium halobium:halobacterium cutirubrum][de:50s ribosomal protein 112 ('a' type) (h120)][sp:p05768][db:swissprot] |
| 19658543_c2_78 | 752 | 4406 | 483 | 160 | 62 | 0.3 | [acc:p05835][gn:tray][or:escherichia coli][de:tray protein][sp:p05835][db:swissprot] |
| 19664792_c1_9 | 753 | 4407 | 231 | 76 | 66 | 0.13 | [ln:d85381][acc:d85381][pn:cytochrome c oxidase subunit vb precursor][gn:coxvb][or:mitochondrion oryza sativa][sr:oryza sativa (cultivar:nipponbare) mitochondrion dna][db:genpept-ptn][de:rice mitochondrial dna for cytochrome c oxidase subunit vbprec |
| 19665886_f1_2 | 754 | 4408 | 744 | 247 | 492 | 4.30E-47 | [acc:p54458][gn:yqem][or:bacillus subtilis][de:hypothetical 28.3 kd protein in arod-comer intergenic region][sp:p54458][db:swissprot] |
| 19666088_c1_42 | 755 | 4409 | 2454 | 817 | 946 | 3.30E-95 | [acc:q46939][gn:ygef][or:escherichia coli][ec:2.3.1.9][de:thiolase][sp:q46939][db:swissprot] |
| 196890_c1_91 | 756 | 4410 | 234 | 77 | 56 | 0.39 | [ln:a07234][acc:at7234][pn:toxin][or:bacillus thuringiensis][db:genpept-pat][de:b.thuringiensis (strain pgs 1208) gene.][sp:p17969][ie:342][re:2297][di:direct] |
| 196910031.15 | 757 | 4411 | 1545 | 514 | 1060 | 2.80E-107 | [acc:f69762][pn:transporter homolog ycli][gn:ycli][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 19706301_f3_22 | 758 | 4412 | 693 | 230 | 732 | 1.60E-72 | [ac:p71447][or:lactococcus lactis][sr:subsplactis:streptoococcus lactis][ec:5.4.2.6][de:beta-phosphoglucomutase,][sp:p71447][db:swissprot] |
| 19708400_c3_75 | 759 | 4413 | 366 | 121 | 85 | 0.019 | [ln:ccco1h6][ac:z71258][pn:m05b5.5][or:caenorhabditis elegans] [db:genpept-inv [de:caenorhabditis elegans cosmid c01h6, complete sequence.][nt:similarity to human transcription factor c2-alpha][le:<1:1121:1959][re:281:1608:2103][di:complement join] |
| 19719678_c3_16 | 760 | 4414 | 675 | 224 | 313 | 4.00E-28 | [ac:h69278][pn:glutamine abc transporter, permease protein (glnp) homolog][or:archacoglobus fulgidus][db:pir] |
| 19720332_c1_12 | 761 | 4415 | 216 | 71 | 177 | 1.00E-13 | [ac:s61910][pn:hypothetical protein 5][el:malk protein homology][or:streptococcus parasanguis][db:pir] |
| 19720950_f2_9 | 762 | 4416 | 1482 | 493 | 111 | 0.0083 | [ln:pfcompira][ac:x95275][or:plasmodium falciparum][sr:malaria parasite][db:genpept-inv][de:p.falciparum complete gene map of plastid-like dna (ir-a).][nt:frameshift][le:118844:13418][re:13418:14725][di:direction] |
| 19721933_f1_1 | 763 | 4417 | 462 | 153 | 279 | 7.10E-24 | [ac:s38903][pn:hypothetical protein 1][or:clostridium pasteurianum][db:pir] |
| 19722282_c3_17 | 764 | 4418 | 183 | 60 | 68 | 0.26 | [ac:p08409:q47051][gn:b00146,b0582][or:escherichia coli][de: insertion element is 186 40.9 kd hypothetical protein (orf1)][sp:p08409:q4705][db:swissprot] |
| 19726555_c1_174 | 765 | 4419 | 1176 | 391 | 102 | 0.024 | [ac:s43609][pn:rofa protein][or:streptococcus pyogenes][gn:rgdvs3cp][db:pir] |
| 19726562_c2_12 | 766 | 4420 | 231 | 76 | 57 | 0.039 | [ln:rgdvs3cp][ac:d13774][pn:core capsid protein][gn:rgdvs3cp][or: rice gall dwarf virus][sr:rice gall dwarf virus rna, clone_lib:pbr322][db:genpept-vrt][de:rice gall dwarf virus rna, s3 genome segment (full length) encoding116k major |
| 19726577_c1_21 | 767 | 4421 | 396 | 131 | 324 | 2.70E-29 | [ac:p54476][gn:yqf6][or:bacillus subtilis][ec:3.1.21.2][de:probable endonuclease iv, (endodcoxyribonuclease iv)][sp:p54476][db:swissprot] |
| 19728426_c2_79 | 768 | 4422 | 462 | 153 | 88 | 0.055 | [ac:q69857][pn:hypothetical protein yknt][or:bacillus subtilis][db:pir] |
| 19735211_c3_46 | 769 | 4423 | 645 | 214 | 1087 | 3.80E-110 | [ac:q47749][gn:vanxb][or:enterococcus faecalis][sr:streptococcus faecalis][ec:3.4.13.—][de(vancomycin b-type resistance protein vanxb)][sp:q47749][db:swissprot] |
| 19742200_f2_8 | 770 | 4424 | 420 | 139 | 677 | 1.10E-66 | [ln:instran][ac:128754][pn:transposase][or:insertion sequence is6770][sr:insertion sequence is6770 dna][db:genpept-bct][de: enterococcus faecalis (transposable elemenent: is6770) transposasegene, complete cds.][nt:putative][le:97][re:1056][di:direc |
| 19742312_f1_1 | 771 | 4425 | 1968 | 655 | 1830 | 7.00E-189 | [ac:f69633][pn:l-glutamine-d-fructose-6-phosphate amidotransferase glms][gn:glms][or:bacillus subtilis][db:pir] |
| 19743812_c1_45 | 772 | 4426 | 1038 | 345 | 964 | 4.10E-97 | [ac:f69769][pn:conserved hypothetical protein ydao][gn:ydao][or:bacillus subtilis][db:pir] |
| 19744037_c1_205 | 773 | 4427 | 303 | 100 | 80 | 0.0019 | [ac:p07008][gn:rele][or:escherichia coli][de:hypothetical rele protein][sp:p07008][db:swissprot] |
| 19754312_f2_9 | 774 | 4428 | 258 | 85 | 62 | 0.94 | [ln:cec05g5][ac:z70203][pn:c05g5.2][or:caenorhabditis elegans][db:genpept-inv][de:caenorhabditis elegans cosmid c05g5, complete sequence.][nt:cdna est yk97c6.3 comes from this gene; cdna est][le:15531:15647:15908:16092][re:15593:15811:16042:16338] |

TABLE 2-continued

| Orf | NT Seq ID | AA Seq ID | NT Orf length | AA Orf length | Score | Probability | Description |
|---|---|---|---|---|---|---|---|
| 19765676_f2_98 | 775 | 4429 | 390 | 129 | 91 | 0.0076 | [ln:spu09239][ac:u09239][pn:putative polysaccharide polymerase][gn:cps19fi][or:*streptoococcus pneumoniae*][db:genpept-bct][de:*streptococcus pneumoniae* type 19f capsular polysaccharidebiosynthesis operon, (cps19fabcdefghijklmno) genes, complete cds,and |
| 19781552_f3_10 | 776 | 4430 | 723 | 240 | 289 | 1.40E-25 | [ln:lgapfa][ac:y08498][pn:aggregation promoting protein][gn:apfa][or:*lactobacillus gasseri*][db:genpept-bct][de:*l.gasseri* apfa gene.][le:125][re:1018][di:direct] |
| 1978178_c3_28 | 777 | 4431 | 990 | 329 | 976 | 2.20E-98 | [ln:sgu57759][ac:u57759][pn:intragneric coaggregation-relevant adhesin][or:*streptoococcus gordonii*][db:genpept-bct][de: *streptococcus gordonii* intrageneric coaggregation-relevant adhesingene, complete cds.][le:277][re:1212][di:direct] |
| 19784783_f3_30 | 778 | 4432 | 609 | 202 | 280 | 1.20E-24 | [ac:p37515][gn:yyai][or:*bacillus subtilis*][de:hypothetical 20.2 kd protein in tetb-exoa intergenic region (orfg)][sp:p37515][db:swissprot] |
| 19784818_f3_151 | 779 | 4433 | 267 | 88 | 66 | 0.05 | [ac:pn01156][pn:glutamate receptor channel delta 2 chain precursor][cl:glutamate receptor:glutamate receptor homology][or:*mus musculus*][sr:house mouse][db:pir] |
| 1978752_f3_26 | 780 | 4434 | 246 | 81 | 84 | 0.012 | [ln:d87895][ac:d87895][pn:chitinase][gn:chia][or:*emericella nidulans*][sr:*aspergillus nidulans* (strain:fgsc89) dna][db:genpept-pln][de:*aspergillus nidulans* dna for chitinase, complete cds.][le:621:1211][re:1161:2652][di:direct|join] |
| 1979537_f1_1 | 781 | 4435 | 282 | 93 | 78 | 0.0032 | [ln:ehy14328][ac:y14328][pn:3e1 protein][or:*entamoeba histolytica*][db:genpept-inv][de:*entamoeba histotyica* mrna for 3e1 protein.][le:32][re:418][di:direct] |
| 1979562_c1_44 | 782 | 4436 | 234 | 77 | 59 | 0.28 | [ac:b69264][pn:transcriptional regulatory protein homolog][or:*archaeoglobus fulgidus*][db:pir] |
| 19796941_c3_138 | 783 | 4437 | 1389 | 462 | 1346 | 1.40E-137 | [ac:p94408][gn:yclf][or:*bacillus subtilis*][de:hypothetical 53.3 kd protein in sfp-gerka intergenic region][sp:p94408][db:swissprot] |
| 19805317_f2_5 | 784 | 4438 | 936 | 311 | 810 | 8.50E-81 | [ac:h65154:s47779] [pn:insertion element is150 hypothetical 33.3 kd protein (orfb):hypothetical protein o283][gn:yi5b][or: *escherichia coli*][db:pir] |
| 19805317_f2_55 | 785 | 4439 | 936 | 311 | 814 | 3.20E-81 | [ac:h65154:s47779] [pn:insertion element is150 hypothetical 33.3 kd protein (orfb):hypothetical protein o283][gn:yi5b][or: *escherichia coli*][db:pir] |
| 19819840_c2_28 | 786 | 4440 | 210 | 69 | 63 | 0.16 | [ac:a69844][pn:hypothetical protein yjbi][gn:yjbi][or:*bacillus subtilis*][db:pir] |
| 19819840_c2_44 | 787 | 4441 | 210 | 69 | 63 | 0.16 | [ac:a69844][pn:hypothetical protein yjbi][gn:yjbi][or:*bacillus subtilis*][db:pir] |
| 1986527_f1_2 | 788 | 4442 | 534 | 177 | 72 | 0.032 | [ac:s28711][pn:hypothetical protein 2][or:sugar beet yellows virus: sbyv][db:pir] |
| 1989717_f1_3 | 789 | 4443 | 978 | 325 | 877 | 6.80E-88 | [ln:mtu41100][ac:u41100][pn:ribonucleotide reductase r2-2 small subunit][or:*mycobacterium tuberculosis*][db:genpept-bct][de: *mycobacterium tuberculosis* ribonucleotide reductase r2-2 smallsubunit gene, partial cds.][le:1][re: |
| 199092_f1_6 | 790 | 4444 | 675 | 224 | 638 | 1.40E-62 | [ac:c69762][pn:abc transporter(permease) homolog yclh][gn:yclh][or:*bacillus subtilis*][db:pir] |
| 19928130_f1_40 | 791 | 4445 | 213 | 70 | 1211 | 1.60E-08 | [ac:s45205][pn:nodulation protein homolog] [or:*escherichia coli*][db:pir] |

TABLE 2-continued

| Orf | NT Seq ID | AA Seq ID | NT Orf length | AA Orf length | Score | Probability | Description |
|---|---|---|---|---|---|---|---|
| 19933518_c3_133 | 792 | 4446 | 1086 | 361 | 102 | 0.035 | [ln:celc17a2][ac:af016654][gn:c17a2.5][or:*caenorhabditis elegans*][sr:*caenorhabditis elegans* strain[32 bristol n2][db:genpept-inv][de:*caenorhabditis elegans* cosmid c17a2.][nt:contains similarity to *streptomyces mycarofaciens*][le:3217:3535:3798][re:34 |
| 1994061_f3_17 | 793 | 4447 | 408 | 135 | 677 | 1.10E-66 | [ac:p23391][gn:lacc][or:*lactococcus lactis*][ec:2.7.1.—][de:tagatose-6-phosphate kinase, (phosphotagatokinase)][sp:p23391][db:swissprot] |
| 1995327_f3_11 | 794 | 4448 | 738 | 245 | 138 | 5.90E-17 | [ac:d69029][pn:pantothenate metabolism flavoprotein][gn:mth1216][or:*methanobacterium thermoautotrophicum*][db:pir] |
| 19978430_f3_6 | 795 | 4449 | 207 | 68 | 64 | 0.19 | [ln:cel158a6][ac:u53339][gn158a6.2][or:*caenorhabditis elegans*][sr:*caenorhabditis elegans* strain=bristol n2][db:genpept-inv][de:*caenorhabditis elegans* cosmid 158a6.][le:3714:4389:4538][re:3887:4490:4741][di:directjoin] |
| 2000005_f2_24 | 796 | 4450 | 198 | 65 | 73 | 0.051 | [ac:s59078][pn:hypothetical protein 262][or:*mitochondrion chondrus crispus*][sr:, carragheen][db:pir] |
| 20056587_c1_63 | 797 | 4451 | 1830 | 609 | 133 | 6.00E-08 | [ln:llu50902][ac:u50902][pn:ltrc][gn:ltrc][or:*lactococcus lactis lactis*][sr:*lactococcus lactis lactis* strain=m13][db:genpept-bct][de:*lactococcus lactis lactis* prs01 ltrc (ltrc), ltrd (ltrd), ltrc(ltrc). relaxase (ltrb) and putative maturase (ltra) |
| 20056900_f1_7 | 798 | 4452 | 573 | 190 | 93 | 0.034 | [ac:p45321][gn:mode:hi1691][or:*haemophilus influenzae*][de:molybdenum transport atp-binding protein mode][sp:p45321][db:swissprot] |
| 20082500_f1_1 | 799 | 4453 | 201 | 66 | 105 | 2.40E-05 | [ac:69219][pn:conserved hypothetical protein mth894][gn:mth894][or:*methanobacterium thermoautotrophicum*][db:pir] |
| 20085062_c3_164 | 800 | 4454 | 474 | 157 | 109 | 7.90E-06 | [ac:d69783][pn:transcriptional regulator (marr family) homolog ydg][gn:ydgi][or:*bacillus subtilis*][db:pir] |
| 20098513_f3_85 | 801 | 4455 | 306 | 101 | 74 | 0.0098 | [ln:bsfi21lys][ac:x95646][gn:orf140b][or:bacteriophage sti21][db:genpept-phg][de:bacteriophage sfi21 dna; lysogeny module, 8141 bp.][le:2829][re:3251][di:direct] |
| 20098576_f2_2 | 802 | 4456 | 549 | 182 | 110 | 0.0005 | [ac:g69992][pn:spore cortex protein homolog ytgp][gn:ytgp][or:*bacillus subtilis*][db:pir] |
| 20114063_f3_15 | 803 | 4457 | 759 | 252 | 87 | 0.0077 | [ac:p39373][gn:gntp][or:*escherichia coli*][de:system][sp:p39373][db:swissprot] |
| 20159405_c1_26 | 804 | 4458 | 333 | 110 | 276 | 4.60E-24 | [ac:h69979][pn:proteinase homolog yrro][gn:yrro][or:*bacillus subtilis*][db:pir] |
| 20159425_f1_20 | 805 | 4459 | 360 | 119 | 63 | 0.12 | [ac:q95705][gn:mtatp8:atp8][or:*hylobates lar*][sr:,common gibbon][ec:3.6.1.34][de:atp synthase protein 8, (a61)][sp:q95705][db:swissprot] |
| 20161377_f1_2 | 806 | 4460 | 204 | 67 | 53 | 0.76 | [ac:c21774][pn:el glycoprotein][cl:togavirus structural polyprotein][or:venezuelan equine encephalitis virus][db:pir] |
| 20167818_c1_30 | 807 | 4461 | 204 | 67 | 70 | 0.022 | [ln:af034606][ac:af034606][pn:chordin][or:*danio rerio*][sr:zebrafish][db:genpept-vrt][de:*danio rerio* chordin mrna, complete cds.][le:152][re:2974][di:direct] |
| 20179682_c2_39 | 808 | 4462 | 468 | 155 | 533 | 1.90E-51 | [ac:a53309][pn:regulatory protein prgw:pheromone responsive gene w protein][gn:prgw][or:*enterococcus faecalis*][db:pir] |
| 20182688_f2_20 | 809 | 4463 | 639 | 212 | 210 | 3.30E-17 | [ac:f69876][pn:conserved hypothetical protein ylmf][gn:ylmf][or:*bacillus subtilis*][db:pir] |

TABLE 2-continued

| Orf | NT Seq ID | AA Seq ID | NT Orf length | AA Orf length | Score | Probability | Description |
|---|---|---|---|---|---|---|---|
| 2031306_f1_4 | 810 | 4464 | 183 | 60 | 44 | 0.25 | [ln:mmu07872][ac:u07872][pn:t cell receptor alpha chain][or:*mus musculus*][sr:house mouse][db:genpept-rod][de:*mus musculus* h-10.b5 t cell receptor alpha chain (v alpha 2 family)mma, partial cds.][nt:v alpha 2 family][le:24][re: |
| 20320463_c2_29 | 811 | 4465 | 372 | 123 | 481 | 6.20E-46 | [ac:p55873][gn:rplt][or:*bacillus subtilis*][de:50s ribosomal protein 120][sp:p55873][db:swissprot] |
| 20322133_c2_51 | 812 | 4466 | 1083 | 360 | 307 | 1.70E-27 | [ln:spdnagcpo][ac:y114463][gn:cpoa][or:*streptococcus pneumoniae*][db:genpept-bct][de:*streptococcus pneumoniae* dnag, rpod, cpoa genes and orf3 and orf5.][le:2160][re:3176][di:direct] |
| 2032632_c2_27 | 813 | 4467 | 615 | 204 | 838 | 9.20E-84 | [ac:p23531][gn:lace][or:*lactococcus lactis*][ec:2.7.1.69][de:(ec 2.7.1.69) (eii-lac)][sp:*streptococcus lactis*: subsplactis: p23531][db:swissprot] |
| 20344436_f3_153 | 814 | 4468 | 393 | 130 | 60 | 0.95 | [ac:s45103][pn:kfafprotein][or:*escherichia coli*][db:pir] |
| 20345003_f1_2 | 815 | 4469 | 410 | 137 | 347 | 9.90E-32 | [ac:a69700][pn:ribosomal protein s10 (bs13) rpsj][gn:rpsj][or:*bacillus subtilis*][db:pir] |
| 20345260_c1_111 | 816 | 4470 | 288 | 95 | 72 | 0.015 | [ln:af014288][ac:af014288][pn:ma-p17][gn:gag][or:human immunodeficiency virus type 1][db:genpept-vrl][de:hiv-1 patient 1524 from glasgow, ma-p17 (gag) gene, partial cds.][nt:complete sequence of ma-p17 peptide][le:<1][re: |
| 20345306_f2_30 | 817 | 4471 | 219 | 72 | 67 | 0.16 | [ac:p49546][gn:rp14][or:*odontella sinensis*][de:chloroplast 50s ribosomal protein 14][sp:p49546][db:swissprot] |
| 20350135_f1_7 | 818 | 4472 | 198 | 65 | 60 | 0.1 | [ac:p12887][gn:ung1ym1021c][or:*saccharomyces cerevisiae*][sr;baker's yeast][ec:3.2.2.—][de:uracil-dna glycosylase precursor,][sp:p12887][db:swissprot] |
| 20353588_f1_10 | 819 | 4473 | 903 | 300 | 117 | 9.90E-07 | [ac:q57682][gn:mj0229][or:*methanococcus jannaschii*][de:hypothetical protein mj0229][sp:q57682][db:swissprot] |
| 20353762_f1_12 | 820 | 4474 | 273 | 90 | 81 | 0.0016 | [ln:cbu24431][ac:u24431][pn:17 kd hemagglutinin component][gn:hem 17/b][or:*clostridium botulinum* b][db:genpept-bct][de:*clostridium botulinum* b 35 kd hemagglutinin component (hem35/b) and 17 kd hemagglutinin component (hem 17/b) genes, complete cds, and |
| 20361427_c3_65 | 821 | 4475 | 300 | 99 | 85 | 0.0062 | [ac:p06739][gn:hlyd][or:*escherichia coli*][de:hemolysin secretion protein d, plasmid][sp:p06739][db:swissprot] |
| 20367000_c2_16 | 822 | 4476 | 225 | 74 | 68 | 0.17 | [ln:ab009376][ac:ab009376][pn:icad-s][gn:icad-s][or:*mus musculus*][sr:*mus musculus* lymphoma cell_line:wr191 cdna to mrna][db:genpept-rod][de:*mus musculus* mrna for icad-s, complete cds.][le:1][re:798][di:direct] |
| 20370453_f2_12 | 823 | 4477 | 666 | 221 | 353 | 2.30E-32 | [ac:q47744][or:*enterococcus faecalis*][sr;*streptococcus faecalis*][gn:regulatory protein vanrb][sp:q47744][db:swissprot] |
| 20377712_c2_119 | 824 | 4478 | 330 | 109 | 93 | 0.00045 | [ln:af036486][ac:af036486][pn:unknown][or:plasmid pnz4000][db:genpept][de:plasmid pnz4000 replication protein (repb1) gene, complete cds.][nt:orfd1][le:3432][re:4364][di:direct] |
| 20377712_f1_5 | 825 | 4479 | 1284 | 427 | 419 | 8.80E-59 | [ln:llu90222][ac:u90222][pn:type ic modification subunit][gn:hsds][or:*lactococcus lactis*][db:genpept][dc:*lactococcus lactis* plasmid pil2614 replication protein (repb), typeic restriction subunit (hsdr), type ic modification subunit (hsdm),type ic mo |
| 2037825_c2_118 | 826 | 4480 | 507 | 168 | 160 | 6.50E-12 | [ln:af011378][ac:af011378][pn:unknown][or:bacteriophage sk1][db:genpept-phg][de:bacteriophage sk1 complete genome.][nt:orf3s][le:20507][re:21142][di:complement] |

TABLE 2-continued

| Orf | NT Seq ID | AA Seq ID | NT Orf length | AA Orf length | Score | Probability | Description |
|---|---|---|---|---|---|---|---|
| 2037825_c3_80 | 827 | 4481 | 795 | 264 | 411 | 1.60E-38 | [ln:naf011378][ac:af011378][pn:unknown][or:bacteriophage sk1][db:genpept-phg][de:bacteriophage sk1 complete genome.][nt:orf35][le:20507][re:21142][di:complement] |
| 2039178_c2_29 | 828 | 4482 | 1347 | 448 | 311 | 6.90E-25 | [ac:s75138][pn:hypothetical protein slr1753][or:synechocystis sp.][sr:pcc 6803, , pcc6803][sr:pcc 6803,][db:pir] |
| 20397332_c2_17 | 829 | 4483 | 201 | 66 | 54 | 0.3 | [ac:q93591p91830][gn:f26a3.7][or:caenorhabditis elegans][de:hypothetical 33.2 kd protein f26a3.7 in chromosome i][sp:q93591:p91830][db:swissprot] |
| 204067_c2_41 | 830 | 4484 | 447 | 148 | 193 | 2.10E-15 | [ln:sgu81957][ac:u81957][pn:comyc][gn:comyc][or:streptococcus gordonii][db:genpept-bct][de:streptococcus gordonii rna polymerase beta subunit (rpoc),putative dna binding protein, putative abc transporter subunitcomya (comya), putative abc transport |
| 2041678_f2_18 | 831 | 4485 | 633 | 210 | 102 | 0.019 | [ac:s59310][pn:probable membrane protein ymr317w:hypothetical protein ym9924.09][or:saccharomyces cerevisiae][db:pir][mp:13r] |
| 204717_c2_156 | 832 | 4486 | 402 | 133 | 461 | 8.20E-44 | [ln:nefu09422][ac:u09422][or:enterococcus faecalis][db:genpept-bct][de:enterococcus faecalis ds16 transposon tn916, (tet(m)), (xis-tn), (int-tn) genes, orfs 1-24, complete cds, complete sequence.][nt:orf17][le:4703][re:5209][di:direct] |
| 2048162_f2_4 | 833 | 4487 | 912 | 303 | 360 | 5.60E-33 | [ac:a70009][pn:two-component sensor histidine kinase [yuf homolog yufl][gn:yufl][or:bacillus subtilis][db:pir] |
| 2049068_c1_15 | 834 | 4488 | 315 | 104 | 62 | 0.17 | [ln:bcu02311][ac:u02311][or:beet curly top virus][db:genpept-vrl][de:beet curly top virus cfh complete genome, orfs r1, r2, r3, r4, 11,12, 13, and 14, complete cds.][nt:orf14][le:2525][re:2788][di:complement] |
| 2049068_c3_36 | 835 | 4489 | 777 | 258 | 223 | 5.90E-18 | [ac:q47745][gn:vansb][or:enterococcus faecalis][sr:,streptococcus faecalis][ec:2.7.3.—][deprotein vansb] (vancomycin histidine protein kinase)][sp:q47745][db:swissprot] |
| 2049068_f1_1 | 836 | 4490 | 300 | 99 | 72 | 0.012 | [ln:saaj0864][ac:aj000864][pn:histidine kinase][gn:comd][fn:receptor of competence stimulating peptide][or:streptococcus anginosus][db:genpept-bct][de:streptococcus anginosus comc, comd, come genes.][le:346][re:1692][di:direct] |
| 20490937_f2_7 | 837 | 4491 | 546 | 181 | 86 | 0.037 | [ln:cec01g10][ac:z81030][pn:c01g10.4][or:caenorhabditis elegans][db:genpept-inv][de:caenorhabditis elegans cosmid c01g10, complete sequence.][le:21759:21870:22752:22902][re:21821:22021:22854:23066][di:directjoin] |
| 20495427_f3_8 | 838 | 4492 | 249 | 82 | 104 | 7.80E-06 | [ac:q57066][gn:hi1720][or:haemophilus influenzae][de:hypothetical protein hi1720][sp:q57066][db:swissprot] |
| 20502253_c3_37 | 839 | 4493 | 921 | 306 | 821 | 5.80E-82 | [ac:p37454][gn:cxoa][or:bacillus subtilis][ec:3.1.11.2][de:exodcoxyribonuclease,][sp:p37454][db:swissprot] |
| 20503952_f2_15 | 840 | 4494 | 192 | 63 | 59 | 0.3 | [ln:d86491][ac:d86491][pn:nfrt][or:xenopus laevis][sr:xenopus laevis embryo cdna to mrna][db:genpept-vrt][de:xenopus laevis mrna for nfrl, compete cds.][nt:putative][le:92][re:1888][di:direct] |
| 20506568_f3_53 | 841 | 4495 | 204 | 67 | 56 | 0.59 | [ac:s57962][pn:cspc protein][cl:cpt repeat homology][or:clostridium acetobutylicum][db:pir] |
| 20507827_f1_1 | 842 | 4496 | 939 | 312 | 818 | 1.20E-81 | [ac:a69756][pn:adhesion protein homolog ycdb][gn:ycdb][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 20510875_f2_15 | 843 | 4497 | 204 | 67 | 52 | 0.27 | [ln:cezk262][ac:z99288][pn:zk262.b][or:*caenorhabditis elegans*][db:genpept-inv][de:*caenorhabditis elegans* cosmid zk262, complete sequence.][nt:protein predicted using genefinder; preliminary][le:17908:18418:18810][re:18354:18455:18958][di:compleme |
| 20510953_c1_31 | 844 | 4498 | 819 | 272 | 532 | 2.50E-51 | [ac:q01625][gn:spoiij][or:*bacillus subtilis*][de:stage iii sporulation protein j precursor][sp:q01625][dbs:swissprot] |
| 20511092_c1_64 | 845 | 4499 | 2049 | 682 | 670 | 5.80E-66 | [ac:a69768][pn:transcriptional antiterminator(bglg famil) homolog ydaa][gn:ydaa][or:*bacillus subtilis*][db:pir] |
| 20511432_c1_12 | 846 | 4500 | 624 | 207 | 594 | 6.60E-58 | [ac:g69626][pn:ribosome recycling factor frr][gn:frr][or:*bacillus subtilis*][db:pir] |
| 20511505_c2_12 | 847 | 4501 | 1245 | 414 | 91 | 0.064 | [ac:p41446][or:autographa californica nuclear polyhedrosis virus][sr:acmnpv][de:hypothetical 21.1 kd protein in p47-gta intergenic region][sp:p41446][db:swissprot] |
| 2051557_c1_90 | 848 | 4502 | 1962 | 653 | 2850 | 5.70E-297 | [ac:p37870][gn:rpob:rfm:crse][or:*bacillus subtilis*][ec:2.7.7.6][de: beta chain) (rna polymerase beta subunit)][sp:p37870][dbs:swissprot] |
| 20525062_c1_85 | 849 | 4503 | 2700 | 899 | 556 | 1.80E-56 | [ac:p23914][gn:levr][or:*bacillus subtilis*][de:transcriptional regulatory protein levr][sp:p23914][dbs:swissprot] |
| 205342_c1_48 | 850 | 4504 | 354 | 117 | 60 | 0.94 | [ln:mmicln2][ac:u72058][pn:chloride channel regulator][gn:icln][or:*mus musculus*][sr:house mouse][db:genpept-rod][de:*mus musculus* chloride channel regulator (icln) gene, exon 2 and partial cds.][nt:putatively volume regulated; ubiquitously][le:u720 |
| 20570326_c2_14 | 851 | 4505 | 246 | 81 | 230 | 1.00E-18 | [ac:g53610][pn:ntpi protein][or:*enterococcus hirae*][db:pir] |
| 20573500_c2_234 | 852 | 4506 | 300 | 99 | 287 | 2.30E-25 | [ac:p96349][gn:cspl][or:*lactobacillus plantarum*][de:cold shock protein 2][sp:p96349][dbs:swissprot] |
| 20585943_c2_9 | 853 | 4507 | 729 | 242 | 954 | 4.70E-96 | [ln:efplsep1g][ac:x96976][pn:transposase][gn:tnp1062][or: *enterococcus faecalis*][db:genpept-bct][de:*e.faecalis* plasmid dna sep1 gene, 4068bp.][le:2496][re:3455][di:complement] |
| 20585943_c3_10 | 854 | 4508 | 729 | 242 | 955 | 3.70E-96 | [ln:efplsep1g][ac:x96976][pn:transposase][gn:tnp1062][or: *enterococcus faecalis*][db:genpept-bct][de:*e.faecalis* plasmid dna sep1 gene, 4068bp.][le:2496][re:3455][di:complement] |
| 20586592_c3_50 | 855 | 4509 | 912 | 303 | 321 | 5.60E-29 | [ln:llu36837][ac:u36837][pn:abicii][fn:with abici, abortive infection bacteriophage][or:*lactococcus lactis*][db:genpept-bct][de: *lactococcus lactis* plasmid pnp40, abortive infection locus, abici, abicii, reca(lp), abif genes, complete cds.][le:1058][ |
| 20595840_f3_1 | 856 | 4510 | 257 | 86 | 44 | 0.061 | [ac:s45489][pn:h+transporting atp synthase, protien 8][cl:h+-transporting atp synthase protien 8][or:*mitochondrion dicentrarchus labrax*][sr:, european seabass][ec:3.6.1.34][db:pir] |
| 20703156_f3_100 | 857 | 4511 | 195 | 64 | 74 | 0.039 | [ln:af012877][ac:af012877:m31161][pn:unknown][or:*spiroplasma citri*][db:genpept-bct][de:*spiroplasma citri* ribosomal protein s2 (rpsb), elongation factor ts(tsf), spiralin (spi), and 6-phosphofructokinase (pfka) genes,complete cds; and pyruvate kinase |
| 20707025_f3_54 | 858 | 4512 | 1449 | 482 | 900 | 2.50E-90 | [ac:h69862][pn:na+-transporting atp synthase homolog ykrm][gn: ykrm][or:*bacillus subtilis*][db:pir] |
| 20709525_f2_47 | 859 | 4513 | 1176 | 391 | 819 | 9.50E-82 | [ln:bk5tatrp][ac:144593][pn:integrase][gn:int][fn:site specific recombinase][or:*lactococcus lactis* phage bk5-t][sr:bacteriophage bk5-t dna][db:genpept-phg][de:bacteriophage bk5-t orf410, 3' end pf cds, 20 orfs, repressorprotein, and cro repressor |

TABLE 2-continued

| Orf | NT Seq ID | AA Seq ID | NT Orf length | AA Orf length | Score | Probability | Description |
|---|---|---|---|---|---|---|---|
| 20714686_f2_16 | 860 | 4514 | 600 | 199 | 119 | 1.10E-05 | [ac:a45612:b35349][pn:h+transporting atp synthase, chain 6:murf4 protein][gn:murf4][or:mitochondrion leishmania tarentolac][ec:3.6.1.34][db:pir] |
| 20736053_f3_10 | 861 | 4515 | 1122 | 373 | 1086 | 4.80E-110 | [ln:ilxerhsl][ac:x84261][pn:heat shock induced protein htpo][gn:hslv][or:lactobacillus leichmannii][db:genpept-bct][de:l.leichmannii xerc, hslu and hslv genes.][re:1638][re:2813][di:direct] |
| 20745312_c2_77 | 862 | 4516 | 1059 | 352 | 719 | 3.80E-71 | [ac:c69763][pn:ferrichrome abc transporter (binding prote) homolog yclq][gn:yclq][or:bacillus subtilis][db:pir] |
| 20745443_f2_18 | 863 | 4517 | 1413 | 470 | 1555 | 9.70E-160 | [ln:laclacg][ac:in28357][pn:phospho-beta-galactosidase][gn:tacg][or:lactococcus lactis][sr:lactococcus lactis dna][db:genpept-bct][de:lactococcus lactis phospho-beta-galactosidase (lacg) gene, completeeds.][tc:121][re:1527][di:direct] |
| 20759716_c3_71 | 864 | 4518 | 2187 | 728 | 109 | 3.60E-07 | [ln:a12901][ac:a12901][pn:fibronectin binding protein][or:staphylococcus aureus][db:genpept-pat][de:s.aureus dna for fibronectin binding protein (partial).][le:<1][re:dbsswissprot] |
| 2077_c3_31 | 865 | 4519 | 1122 | 373 | 334 | 2.40E-30 | [ac:p23479][gn:sbcd][or:bacillus subtilis][de:exonuclease sbcd homolog (fragment)][sp:p23479][db:swissprot] |
| 2079752_f2_50 | 866 | 4520 | 750 | 249 | 406 | 5.50E-38 | [ac:p35159][gn:yput][or:bacillus subtilis][de:hypothetical 26.0 kd protein in spmb-aroc intergenic region (orfx13)][sp:p35159][db:swissprot] |
| 20803567_c2_33 | 867 | 4521 | 237 | 78 | 64 | 0.25 | [ac:p05012][gn:ifnb][or:equus caballus][sr:horse][de:interferon beta precursor (ifn-beta)][sp:p05012][db:swissprot] |
| 20835927_c1_44 | 868 | 4522 | 984 | 327 | 710 | 3.40E-70 | [ac:c69759][pn:hypothetical protein ycgr][gn:ycgr][or:bacillus subtilis][db:pir] |
| 20878791_f1_3 | 869 | 4523 | 1083 | 360 | 91 | 0.0041 | [ac:p39854][gn:capc][or:staphylococcus aureus][de:cape protein][sp:p39854][db:swissprot] |
| 20879126_f3_8 | 870 | 4524 | 183 | 60 | 65 | 0.054 | [ln:atf18f4][ac:a1021637][pn:hypothetical protein][gn:f18f4.110][or:arabidopsis thaliana][sr:thale cress][db:genpept-pln][de:arabidopsis thaliana dna chromosome 4, bac clone f1814 (essaiproject).][le:50640:51150:51431:51732][re:51055:51288:51539 |
| 2088511_c1_18 | 871 | 4525 | 225 | 74 | 97 | 0.00013 | [ac:q46938][gn:kdui][or:escherichia coli][ec:5.3.1.17][de:(5-keto-4-deoxyuronate isomerase) (dki isomerase)][sp:q46938][db:swissprot] |
| 2088_f2_16 | 872 | 4526 | 570 | 189 | 201 | 2.90E-16 | [ac:d69783][pn:transcriptional regulator (marr family) homolog ydgi][gn:ydgi][or:bacillus subtilis][db:pir] |
| 20898286_c3_191 | 873 | 4527 | 354 | 117 | 83 | 0.00093 | [ac:pc2396][pn:hypothetical 111k protein][or:leuconostoc ocnos phage 110][db:pir] |
| 20898452_f3_9 | 874 | 4528 | 444 | 147 | 117 | 2.30E-07 | [ln:pbu42580][ac:u42580:u17055:u32570][gn:a2731][or:paramecium bursaria chlorella virus 1][db:genpept-vrl][de:paramecium bursaria chlorella virus 1, complete genome.][le:138650][re:139066][di:complement] |
| 20898462_c1_57 | 875 | 4529 | 1098 | 365 | 1111 | 1.10E-112 | [ac:p12043][gn:purm:ath][or:bacillus subtilis][ec:6.3.3.1][de:(phosphoribosyl-aminoimidazole synthetase) (air synthase)][sp:p12043][db:swissprot] |
| 20911562_c3_37 | 876 | 4530 | 864 | 287 | 819 | 9.50E-82 | [ac:a70090][pn:hypothetical protein yycj][gn:yycj][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 20914077_f1_18 | 877 | 4531 | 318 | 105 | 75 | 0.53 | [ac:p46863][gn:klp61f:klp2][or:drosophila melanogaster][sr:fruit fly][de:bipolar kinesin krp-130 (kinesin-like protein klp61 f)][sp:p46863][db:swissprot] |
| 20954425_f3_4 | 878 | 4532 | 471 | 156 | 257 | 2.40E-21 | [ac:a69829][pn:abc transporter (atp-binding protein) homolog yhci][gn:yhci][or:bacillus subtilis][db:pir] |
| 20963952_c3_49 | 879 | 4533 | 765 | 254 | 602 | 9.40E-59 | [ac:p54461][gn:yyqeu][or:bacillus subtilis][de:hypothetical 28.8 kd protein in dnaj-rpsu interegenic region][sp:p54461][db:swissprot] |
| 20976568_c3_26 | 880 | 4534 | 1374 | 457 | 1104 | 6.00E-112 | [ln:111pk214][ac:x92946;y10522][pn:macrolide efflux protein][gn:mef214][or:lactococcus lactis][db:genpept-bct][de:lactobacillus lactis plasmid pk214, complete sequence.][le:10534][re:11790][di:direc] |
| 20978375_f2_20 | 881 | 4535 | 402 | 133 | 128 | 1.60E-08 | [ln:ececopri][ac:x98141][gn:doc][or:escherichia coli][db:genpept-bct][de:e.coli dna sequence upstream of the ecopri hsd locus.][le:401][re:781][di:direc] |
| 20992205_f2_19 | 882 | 4536 | 735 | 244 | 98 | 0.028 | [ac:q05813][gn:peppi:pepp][or:streptomyces lividans][ec:3.4.11.9][de:i)][sp:q05813][db:swissprot] |
| 20992925_f3_59 | 883 | 4537 | 2628 | 875 | 2460 | 1.20E-255 | [ac:p53533][gn:clpb][or:synechococcus sp][sr:pcc 7942,anacystis nidulans r2][de:clpb protein][sp:p53533][db:swissprot] |
| 210317_c3_31 | 884 | 4538 | 744 | 247 | 615 | 3.90E-60 | [ac:q59484][or:lactobacillus acidophilus][ec:2.7.1.113:2.7.1.76][de:(ec 2.7.1.76) subunit2][sp:q59484][db:swissprot] |
| 2112655_f3_23 | 885 | 4539 | 1602 | 533 | 230 | 2.10E-31 | [ac:c69796][pn:two-component response regulator [yesm]homolog yesn][gn:yesn][or:bacillus subtilis][db:pir] |
| 2114537_c1_54 | 886 | 4540 | 1329 | 442 | 301 | 1.10E-25 | [ln:scmalrefg][ac:y07706][pn:putative maltose-binding protein][gn:male][or:streptomyces coelicolor][db:genpept-bct][de:s.coelicolor malr, male, malf and malg genes.][le:1620][re:2891][di:direc] |
| 211558_f3_31 | 887 | 4541 | 771 | 256 | 585 | 5.90E-57 | [ac:s76993][pn:hypothetical protein][cl:ribitol dehydrogenase: short-chain alcohol dehydrogenase homolog][or:synechocystis sp.][sr:pcc 6803, , pcc 6803][sr:pcc 6803,][db:pir] |
| 213140_c3_159 | 888 | 4542 | 1197 | 398 | 959 | 1.40E-96 | [ac:f69791][pn:conserved hypothetical protein yebb][gn:yebb][or:bacillus subtilis][db:pir] |
| 2135037_f1_1 | 889 | 4543 | 936 | 311 | 454 | 4.50E-43 | [ac:p16400][gn:mler][or:lactococcus lactis][sr:,subsplactis:streptococcus lactis][de:malolactic fermentation system transcriptional activator][sp:p16400][db:swissprot] |
| 2141250_c1_14 | 890 | 4544 | 1002 | 333 | 1285 | 4.00E-131 | [ac:p31304][gn:sssab][or:streptococcus sanguis][de:adhesin b precursor (saliva-binding protein)][sp:p31304][db:swissprot] |
| 214200_c2_176 | 891 | 4545 | 489 | 162 | 753 | 9.40E-75 | [ac:p43457][gn:ntpk:ntpn][or:enterococcus hirae][ec:3.6.1.34][de:translocating atpase subunit k) (sodium atpase proteolipid component)][sp:p43457][db:swissprot] |
| 21484453_c3_59 | 892 | 4546 | 630 | 210 | 518 | 7.50E-50 | [ac:p37537][gn:tmk][or:bacillus subtilis][ec:2.7.4.9][de:thymidylate kinase, (dtmp kinase)][sp:p37537][db:swissprot] |
| 21486027_f1_1 | 893 | 4547 | 687 | 228 | 309 | 1.10E-27 | [ac:jh0364][pn:hypothetical protein 176 (sagp 5' region)][or:streptococcus pyogenes][db:pir] |
| 2148910_c1_68 | 894 | 4548 | 1896 | 631 | 1467 | 2.00E-150 | [ac:p50852][gn:mtla][or:bacillus stearothermophilus][ec:2.7.1.69][de:(ec 2.7.1.69) (cii-mtl)][sp:p50852][db:swissprot] |
| 21490637_f2_12 | 895 | 4549 | 198 | 65 | 170 | 5.60E-13 | [ac:jc1262][pn:hypothetical 4.5k protein][or:lactococcus lactis subsp. lactis][db:pir] |
| 2149192_c1_49 | 896 | 4550 | 921 | 306 | 736 | 5.90E-73 | [ac:h69744][pn:conserved hypothetical protein ybbp][gn:ybbp][or:bacillus subtilis][db:pir] |

TABLE 2-continued

| Orf | NT Seq ID | AA Seq ID | NT Orf length | AA Orf length | Score | Probability | Description |
|---|---|---|---|---|---|---|---|
| 21492192_c3_30 | 897 | 4551 | 723 | 240 | 694 | 1.70E-68 | [ac:p54476][gn:yqfs][or:*bacillus subtilis*][ec:3.1.21.2][de:probable endonuclease iv, (endodeoxyribonuclease iv)][sp:p54476] [db:swissprot] |
| 21500801_c1_59 | 898 | 4552 | 3894 | 1297 | 117 | 0.024 | [ln:pfstarp][ac:z26314][pn:starp antigen][or:*plasmodium falciparum*][sr:malaria parasite][db:genpept-inv][de:*p.falciparum* gene for starp antigen.][le:735:982][re:806:2724][di:direct join] |
| 2151058_c3_142 | 899 | 4553 | 348 | 115 | 115 | 3.90E-07 | [ac:f69187][pn:epoxidase][gn:mth659][or:*methanobacterium thermoautotrophicum*][db:pir] |
| 21516680_c3_13 | 900 | 4554 | 1725 | 575 | 923 | 9.10E-93 | [ac:p37484][gn:yybf][or:*bacillus subtilis*][de:hypothetical 74.3 kd protein in rpli-cotf intergenic region][sp:p37484][db:swissprot] |
| 21520250_c2_260 | 901 | 4555 | 189 | 62 | 47 | 0.046 | [ac:p54943][gn:yxed:hs74dr][or:*bacillus subtilis*][de:hypothetical 13.6 kd protein in idh-deor intergenic region][sp:p54943] [db:swissprot] |
| 21520307_c3_24 | 902 | 4556 | 1155 | 384 | 914 | 8.10E-92 | [ac:p05649:p11571][gn:dnan:dnag][or:*bacillus subtilis*][ec:2.7.7.7] [de:dna polymerase iii, beta chain,][sp:p05649-p11571] [db:swissprot] |
| 21520952_f1_2 | 903 | 4557 | 453 | 150 | 57 | 0.69 | [ac:p35074][gn:ama-1][or:*caenorhabditis briggsae*][ec:2.7.7.6] [de:(fragment)][sp:p35074][db:swissprot] |
| 21523563_f1_6 | 904 | 4558 | 222 | 73 | 72 | 0.039 | [ac:s51908][pn:cryptogene protein g1(nd9)][or:*leishmania tarentolae*][sr:strain lem125, , strain lem 125][sr:strain lem 125,] [db:pir] |
| 21523587_c1_11 | 905 | 4559 | 2142 | 713 | 129 | 1.40E-08 | [ln:pfcompirb][ac:x95276][gn:clp (c?)][de:*p.falciparum* [sr:malaria parasite][db:genpept-inv][de:*p.falciparum* complete gene map of plastid-like dna (ir-b).][le:10926][re:13226][di:direct] |
| 21524188_c2_23 | 906 | 4560 | 258 | 85 | 56 | 0.49 | [ac:i77319][pn:nadh dehydrogenase subunit 5][or:*mitochondrion tarsius syrichta*][sr:,tarsier, philippine tarsier][db:pir] |
| 21525312_c2_99 | 907 | 4561 | 597 | 198 | 194 | 1.60E-15 | [ln:kpu95087][ac:u95087][pn:mdcg][gn:mdcg][fn:involved in formation of the holo-acyl carrier][or:*klebsiella pneumoniae*][db: genpept-bct][de:*klebsiella pneumoniae* malonate decarboxylase gene cluster (mdca,mdcb, mdcc, mdcd, mdce, mdcf, mdcg, mdch, mdc |
| 21542550_f1_1 | 908 | 4562 | 1203 | 400 | 151 | 2.00E-18 | [ln:af007800] [ac:af007800:u39468] [pn:mannitol dehydrogenase] [gn:mtld] [or: *pseudomonas fluorescens*] [db:genpept-bct] [ec:1.1.1.67] [de:*pseudomonas fluorescens* mannitol operon, mtle (mtle), mtlf (mtlf),mtlg (mtlg), mtlk (mtlk), mannitol dehydrogenase (mt |
| 21563137_c1_22 | 909 | 4563 | 1023 | 340 | 704 | 1.50E-69 | [ac:c69841] [pn:conserved hypothetical protein yitt] [gn:yitt] [or:*bacillus subtilis*] [db:pir] |
| 21583501_f3_13 | 910 | 4564 | 1755 | 584 | 992 | 4.40E-100 | [ln:llu78967] [ac:u78967] [pn:cadmium resistance protein] [gn:cada] [fn:cadmium efflux atpase] [or:*lactococcus lactis*] [db:genpept-bct] [de: *lactococcus lactis* cadmium resistance regulatory protein (cadc) and cadmium resistance protein (cada) genes, complet |
| 21601688_c2_71 | 911 | 4565 | 183 | 60 | 60 | 0.23 | [ln:reu19188] [ac:u19188] [pn:type i immunoglobulin light chain variable] [or:*raja erinacca*] [sr:little skate] [db:genpept-vrt] [de:*raja erinacea* clone 27102 type i immunoglobulin light chainvariable region gene, partial cds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 2160452_f2_10 | 912 | 4566 | 183 | 60 | 62 | 0.32 | [ln:ehu54764] [ac:eu54764] [pn:phosphoglucose isomerase] [gn:pgi] [fn:glycolytic enzyme] [or:erwinia herbicola] [sr:erwinia herbicola strain-318] [db:genpept-bct] [ec:5.3.1.9] [de:erwinia herbicola phosphoglucose isomerase (pgi) mrna, partial cds.] [nt:glu |
| 21610208_f3_15 | 913 | 4567 | 576 | 191 | 214 | 1.20E-17 | [acp42978] [gn:ypjc:jojc] [or:bacillus subtilis] [de:hypothetical 23.6 kd protein in qerc-dapb intergenic region] [sp:p42978] [db:swissprot] |
| 21614376_c1_26 | 914 | 4568 | 747 | 248 | 275 | 4.20E-24 | [ln:ab002668] [ac:ab002668] [or:haemophilus actinomycetemcomitans] [sr:actinobacillus actinomycetemcomitans (strain:y4) dna] [db:genpept-bct] [de:actinobacillus actinomycetemcomitans dna for glycosyltransferase, lytic transglycosylase, ddp-4-rhamnose redu |
| 21619816_c3_110 | 915 | 4569 | 522 | 173 | 242 | 1.30E-20 | [acp26380] [gn:levc:sacl] [or:bacillus subtilis] [ec:2.7.1.69] [de(ec 2.7.1.69) (p18)] [sp:p26380] [db:swissprot] |
| 21640693_c3_122 | 916 | 4570 | 1143 | 380 | 510 | 5.30E-49 | [acp31114] [gn:gercc:gerc3] [or:bacillus subtilis] [ec:2.5.1.30] [de(heppp synthase) (spore germination protein c3)] [sp:p31114] [db:swissprot] |
| 21640880_f1_38 | 917 | 4571 | 246 | 81 | 71 | 0.12 | [acp75121] [or:mycoplasma pneumoniae] [de:hypothetical protein mg456 homolog] [sp:p75121] [db:swissprot] |
| 21641538_f2_13 | 918 | 4572 | 339 | 112 | 389 | 3.50E-36 | [acp04455] [gn:rplx] [or:bacillus stearothermophilus] [de:50s ribosomal protein 124] [sp:p04455] [db:swissprot] |
| 21642686_c1_128 | 919 | 4573 | 210 | 69 | 95 | 0.0005 | [ac:q58065] [gn:mj06649] [or:methanococcus jannaschii] [sp:q58065] [db:swissprot] |
| 21648586_c2_13 | 920 | 4574 | 222 | 73 | 61 | 0.23 | [ec:1.6.—.—] [de:putative nadh oxidase, (nxoase)] [gn:nuc1] [or:saccharomyces cerevisiac] [sr:saccharomyces cerevisiac dna] [db:genpept-pln] [de:saccharomyces cerevisiae psti-bamhi fragment chp1 gene, 3' end andnucl gene, 3' end.] [le:426] [re:807] [di:complement] |
| 21656283_c2_59 | 921 | 4575 | 195 | 64 | 58 | 0.34 | [ln:d90883] [ac:d90883:ab001340] [pn:csie protein.] [gn:csie] [or:escherichia coli] [sr:escherichia coli (strain:k12) dna, clone_lib:kohara lambda minise] [db:genpept-bct] [de:e.coli genomic dna, kohara clone #430(57.2–57.5 min.).] [nt:similar to [swisspr |
| 21656655_f2_49 | 922 | 4576 | 231 | 76 | 66 | 0.063 | [ln:pop29g14] [ac:x049062] [or:bacteriophage phi-29] [db:genpept-phg] [de:bacillus phage phi 29 genes 14 and 15.] [nt:orf (127aa); put. gene 13 product (1 is 3rd base in [sp:p15132] [1e:<1] [re:385] [di:direct] |
| 21661562_f1_36 | 923 | 4577 | 195 | 64 | 52 | 0.098 | [ac:q36425] [gn:nd6] [or:locusta migratoria] [sr::migratory locust] [ec:1.65.3] [de:nadh-ubiquinone oxidoreductase chain 6,] [sp:q36425] [db:swissprot] |
| 21664780_c1_19 | 924 | 4578 | 261 | 86 | 294 | 4.10E-26 | [ac:q58418] [gn:pstb:mj1012] [or:methanococcus jannaschii] [de:probable phosphate transport atp-binding protein pstb] [sp:q58418] [db:swissprot] |
| 21671927_c1_18 | 925 | 4579 | 222 | 73 | 252 | 7.00E-21 | [ln:ab007465] [ac:ab007465] [pn:dna gyrase subunit a] [gn:gyra coding region encoding for dna gyrase subunit] [or:streptococcus thermophilus] [sr:streptococcus thermophilus (strain:m-192) dna] [db:genpept-bct] [de:streptococcus thermophilus gene for dna g |

TABLE 2-continued

| Orf | NT Seq ID | AA Seq ID | NT Orf length | AA Orf length | Score | Probability | Description |
|---|---|---|---|---|---|---|---|
| 21673127_c1_25 | 926 | 4580 | 870 | 289 | 302 | 5.80E-27 | [acc:70066] [pn:conserved hypothetical protein ywpj] [gn:ywpj] [or:*bacillus subtilis*] [db:pir] |
| 21676058_c1_38 | 927 | 4581 | 795 | 264 | 921 | 1.50E-92 | [ac:p37522] [gn:soj] [or:*bacillus subtilis*] [de:soj protein] [sp:p37522] [db:swissprot] |
| 21676577_c3_288 | 928 | 4582 | 498 | 165 | 235 | 7.30E-20 | [acc:69671] [pn:transcriptional repressor of sporulation, septation and degrad paia] [gn:paia] [or:*bacillus subtilis*] [db:pir] |
| 21676577_f3_47 | 929 | 4583 | 498 | 165 | 218 | 4.60E-18 | [acc:69671] [pn:transcriptional repressor of sporulation, septation and degrad paia] [gn:paia] [or:*bacillus subtilis*] [db:pir] |
| 21678802_c1_90 | 930 | 4584 | 816 | 271 | 109 | 0.00075 | [acc:p03687] [gn:p18] [or:bacteriophage p22] [de:replication protein gp18] [sp:p03687] [db:swissprot] |
| 21678928_f2_111 | 931 | 4585 | 330 | 109 | 108 | 2.10E-06 | [ln:tbu01849] [acc:u01849] [or:kinetoplast trypanosoma brucei] [sr:trypanosoma brucei] [db:genpept-inv] [de:trypanosoma brucei catro 164 kinetoplast (cr4) mrna, complete cds.] [nt:orf2] [le:107] [re:532] [di:direct] |
| 21679637_c3_44 | 932 | 4586 | 879 | 292 | 896 | 6.60E-90 | [ln:af030359] [acc:af030359] [pn:dtdp-1-rhamnose synthase] [gn:cpso] [or:*streptococcus pneumoniae*] [db:genpept-bct] [de:*streptococcus pneumoniae* strain ncte11906 glucose-1-phosphatethymidyl transferase (cps1) gene, partial cds; anddtdp-4-keto-6-deoxyglucos |
| 21681508_c3_72 | 933 | 4587 | 942 | 313 | 575 | 6.80E-56 | [ac:p37540] [gn:yaas] [or:*bacillus subtilis*] [de:hypothetical 37.6 kd protein in xpac-abrb intergenic region] [sp:p37540] [db:swissprot] |
| 21681582_c1_68 | 934 | 4588 | 720 | 239 | 750 | 1.90E-74 | [ac:p50924] [gn:pyrf] [or:*lactococcus lactis*] [sr, subspcremoris:*streptococcus cremoris*] [ec:4.1.1.23] [de:decarboxylase] [sp:p50924][db:swissprot] |
| 21682826_c1_46 | 935 | 4589 | 336 | 111 | 168 | 9.20E-13 | [ln:mmu46463] [acc:u46463] [pn:glutamine repeat protein-1] [or:mus musculus] [sr:house mouse] [db:genpept-rod] [de:mus musculus glutamine repeat protein-1 mrna, complete cds.] [nt:grp-1] [le:181] [re:696] [di:direct] |
| 21683375_c2_221 | 936 | 4590 | 399 | 132 | 82 | 0.051 | [ac:p22479] [gn:atph] [or:*bacillus firmus*] [ec:3.6.1.34] [de:atp synthase delta chain,] [sp:p22479] [db:swissprot] |
| 21687752_c2_32 | 937 | 4591 | 231 | 76 | 63 | 0.021 | [ln:cer06c7] [acc:z71266] [pn:r06c7.9] [or:*caenorhabditis elegans*] [db:genpept-inv] [de:caenorhabditis elegans cosmid r06c7, complete sequence,] [nt:similar to zinc-finger protein] [le:23182:23250:23409:23547] [re:23205:23363:23498:23633] [di:directjoin] |
| 21688830_c1_26 | 938 | 4592 | 213 | 70 | 79 | 0.031 | [ln:d64052] [acc:d64052] [pn:cytochrome p450 like_tbp] [gn:cbp] [or:*nicotiana tabacum*] [sr:*nicotiana tabacum* (strain:bright yellow 2) cdna to mrna] [db:genpept-pln] [ec:1.14.14.1] [de:tobacco mrna for cytochrome p450 like_tbp, complete cds.] [le:155] [re: |

TABLE 2-continued

| Orf | NT Seq ID | AA Seq ID | NT Orf length | AA Orf length | Score | Probability | Description |
|---|---|---|---|---|---|---|---|
| 21688830_c3_34 | 939 | 4593 | 213 | 70 | 79 | 0.031 | [ln:d64052] [ac:d64052] [pn:cytochrome p450 like tbp] [gn:ctbp] [or:nicotiana tabacum] [sr:nicotiana tabacum (strain:bright yellow 2) cdna to mrna] [db:genpept-pln] [ec:1.14.14.1] [de:tobacco mrna for cytochrome p450 like_tbp, complete cds.] [le:155] [re: |
| 21691012_f3_8 | 940 | 4594 | 951 | 316 | 94 | 0.0077 | [ac:p22088] [gn:lipa] [or:burkholderia cepacia] [sr:pseudomonas cepacia] [ec:3.1.1.3] [de:lipase precursor, (triacylglycerol lipase] [sp:p22088] [db:swissprot] |
| 21694466_c3_72 | 941 | 4595 | 1497 | 498 | 1529 | 5.50E-157 | [ac:p00497] [gn:purf] [or:bacillus subtilis] [ec:2.4.2.14] [de:phosphoribosylpyrophosphate amidotransferase) (atase)] [sp:p00497] [db:swissprot] |
| 21698340_f2_5 | 942 | 4596 | 207 | 68 | 90 | 9.70E-05 | [ac:q09928] [gn:spac21e11.05c] [or:schizosaccharomyces pombe] [sr:fission yeast] [ec:5.2.1.8] [de:probable peptidyl-prolyl cis-trans isomerase c21e11.05c,] [sp:q09928] [db:swissprot] |
| 21730042_c3_61 | 943 | 4597 | 459 | 152 | 317 | 1.50E-28 | [ac:p54510] [gn:yqhl] [or:bacillus subtilis] [de:hypothetical 14.6 kd protein in gevt-spoiiiaa intergenic region] [sp:p54510] [db:swissprot] |
| 21730325_f1_2 | 944 | 4598 | 819 | 272 | 763 | 8.20E-76 | [ln:stproba] [ac:x92418] [pn:gamma-glutamyl kinase] [gn:prob] [or:streptococcus thermophilus] [db:genpept-bct] [de:s. thermophilus prob and proa genes.] [le:141] [re:944] [di:direct] |
| 21734450_f1_7 | 945 | 4599 | 243 | 80 | 110 | 2.10E-05 | [ac:a30374:q90796] [pn:hypothetical 77k protein (spot 3' region)] [or: escherichia coli] [db:pir] [mp:82 min] |
| 21741031_f2_22 | 946 | 4600 | 225 | 74 | 126 | 4.70E-07 | [ac:p39695] [gn:comec:come3] [or:bacillus subtilis] [de:come operon protein 3] [sp:p39695] [db:swissprot] |
| 21751425_c3_157 | 947 | 4601 | 645 | 214 | 314 | 3.10E-28 | [ac:h69850] [pn:mutator mutt protein homolog yjhb] [gn:yjhb] [or:bacillus subtilis] [db:pir] |
| 21756382_c3_52 | 948 | 4602 | 282 | 93 | 73 | 0.27 | [ac:s58126] [gn:pdr1] [or:saccharomyces cerevisiae] [sr:baker's yeast] [db:genpept-pln] [de:lcu1-ate1 loci: leu1 . . . yg1029 [saccharomyces cerevisiae, genomic.14 genes, 16956 nt.] [le:4141] [re:7316] [di:direct] |
| 21767962_c2_27 | 949 | 4603 | 1254 | 417 | 1053 | 1.50E-106 | [ac:p45246] [gn:hi1545] [or:haemophilus influenzae] [de:hypothetical symporter hi1545] [sp:p45246] [db:swissprot] |
| 21774127_c1_63 | 950 | 4604 | 2283 | 760 | 298 | 7.70E-36 | [ac:a65049:a24136] [pn:glutamate--cysteine ligase;:gamma-glutamylcysteine synthetase] [gn:gsha (gshi)] [cf:glutamate--cysteine ligase] [or:escherichia coli] [ec:6.3.2.2] [db:pir] [mp:58 min] |
| 21775430_f1_1 | 951 | 4605 | 660 | 219 | 919 | 2.40E-92 | [ln:bsu43929] [ac:u43929] [pn:s3] [gn:rpse] [or:bacillus subtilis] [db:genpept-bct] [de:bacillus subtilis ribosomal protein gene cluster, rpsj, rpsle, rpld, rplw, rplb, rpss, rplv and rpse genes, complete cds, and rplp gene,partial cds.] [nt:ribosomal prote |
| 21875052_c2_19 | 952 | 4606 | 204 | 67 | 60 | 0.44 | [ln:af025803] [ac:af025803] [pn:cyclophilin 1] [gn:cyp1] [or:drosophila pseudoobscura] [db:genpept-inv] [de:drosophila pseudoobscura cyclophilin 1 (cyp1) mrna, partial cds.] [le:1] [re: |

TABLE 2-continued

| Orf | NT Seq ID | AA Seq ID | NT Orf length | AA Orf length | Score | Probability | Description |
|---|---|---|---|---|---|---|---|
| 21878557_c1_38 | 953 | 4607 | 795 | 264 | 580 | 2.10E-56 | [ac:s76896] [pn:hypothetical protein] [or:synechocystis sp.] [sr:pcc 6803, , pcc 6803] [sr:pcc 6803,] [db:pir] |
| 21882781_c1_42 | 954 | 4608 | 810 | 269 | 106 | 1.30E-05 | [ln:af020798] [ac:af020798] [pn:repressor] [or:streptococcus thermophilus bacteriophage tp-j34] [db:genpept] [de:streptococcus thermophilus bacteriophage lysogeny module, integrasehomolog (int), putative host cell surface-exposed lipoprotein,putative meta |
| 21884682_f1_2 | 955 | 4609 | 792 | 263 | 523 | 2.20E-50 | [ac:e69785] [pn:transcriptional regulator (gntr family) homolog ydhq] [gn:ydhq] [or:bacillus subtilis] [db:pir] |
| 21898430_f1_12 | 956 | 4610 | 1059 | 352 | 290 | 1.10E-25 | [ac:p20668] [gn:gltc] [or:bacillus subtilis] [de:transcriptional regulatory protein gltc] [sp:p20668] [db:swissprot] |
| 21912943_f1_2 | 957 | 4611 | 465 | 154 | 451 | 9.40E-43 | [ac:p02417] [gn:rpli] [or:bacillus stearothermophilus] [de:50s ribosomal protein 19 (b117)] [sp:p02417] [db:swissprot] |
| 21929175_c2_50 | 958 | 4612 | 612 | 203 | 509 | 6.70E-49 | [ac:p37470] [gn:spovc:pth] [or:bacillus subtilis] [ec:3.1.1.29] [de:sporulation protein c)] [sp:p37470] [db:swissprot] |
| 2195337_c3_37 | 959 | 4613 | 573 | 190 | 670 | 5.80E-66 | [ac:p19064] [gn:glna] [or:bacillus cereus] [ec:6.3.1.2] [de:glutamine synthetase, (glutamate–ammonia ligase)] [sp:p19064] [db:swissprot] |
| 21956467_c3_30 | 960 | 4614 | 189 | 62 | 69 | 0.37 | [ac:p40631] [gn:mlh] [or:tetrahymena thermophila] [de:proteins alpha, beta, delta and gamma) (mic 1h)] [sp:p40631] [db:swissprot] |
| 21959575_f1_1 | 961 | 4615 | 1176 | 391 | 211 | 2.10E-14 | [ac:g69992] [pn:spore cortex protein homolog yrgp] [or:bacillus subtilis] [db:pir] |
| 21960301_f2_17 | 962 | 4616 | 1491 | 496 | 306 | 9.60E-25 | [ac:a69655] [pn:two-component sensor histidine kinase involved in the rate of lyts] [gn:lyts] [or:bacillus subtilis] [db:pir] |
| 21969592_c1_23 | 963 | 4617 | 540 | 179 | 137 | 1.60E-08 | [ac:p77260] [gn:ydfi] [or:escherichia coli] [de:hypothetical 53.7 kd protein in dcp-noha intergenic region] [sp:p77260] [db:swissprot] |
| 21969806_c2_120 | 964 | 4618 | 273 | 90 | 66 | 0.075 | [ln:celc54g6] [ac:af043698] [gn:e54g6.4] [or:caenorhabditis elegans] [sr:caenorhabditis elegans strain=bristol n2] [db:genpept-inv] [de:caenorhabditis elegans cosmid c54g6.] |
| 21972656_c3_6 | 965 | 4619 | 1032 | 343 | 473 | 4.40E-45 | [nt:partial cds; coded for by c. elegans cdna ceesd69t] [1e:26533:27287] [re:268] [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 2198588_c1_17 | 966 | 4620 | 327 | 108 | 103 | 7.10E-06 | [ac:c69525] [pn:conserved hypothetical protein af2203] [or:archaeoglobus fulgidus] [db:pir] |
| 22000318_f3_32 | 967 | 4621 | 477 | 158 | 346 | 1.30E-31 | [ac:p49778] [gn:cfp] [or:bacillus subtilis] [de:elongation factor p (ef-p)] [sp:p49778] [db:swissprot] |
| 22008436_c3_69 | 968 | 4622 | 201 | 66 | 57 | 0.43 | [ac:jc4576] [pn:serine proteinase v2, precursor:aprv2 precursor:extracellular serine protease v2 precursor] [gn:aprv2] [el:subtilisin homology] [or:dichelobacter nodosus] [ec:3.4.—.—] [db:pir] |

TABLE 2-continued

| Orf | NT Seq ID | AA Seq ID | NT Orf length | AA Orf length | Score | Probability | Description |
|---|---|---|---|---|---|---|---|
| 22036625_c2_86 | 969 | 4623 | 1326 | 441 | 1660 | 7.20E-171 | [ln:instranspo] [ac:134675] [pn:transposase] [or:insertion sequence is1251] [sr:insertion sequence is1251 dna] [db:genpept-bct] [de:insertion sequence is1251 from *enterococcus faecium* transposasegene, complete cds.] [nt:putative] [le: 128] [re: 1417] [di:di] |
| 22036625_c3_23 | 970 | 4624 | 444 | 147 | 535 | 1.20E-51 | [ln:instranspo] [ac:134675] [pn:transposase] [or:insertion sequence is1251] [sr:insertion sequence is1251 dna] [db:genpept-bct] [de:insertion sequence is1251 from *enterococcus faecium* transposasegene, complete cds.] [nt:putative] [le:128] [re:1417] [di:di] |
| 22036625_f1_2 | 971 | 4625 | 1326 | 441 | 1660 | 7.20E-171 | [ln:instranspo] [ac:134675] [pn:transposase] [or:insertion sequence is1251] [sr:insertion sequence is1251 dna] [db:genpept-bct] [de:insertion sequence is1251 from *enterococcus faecium* transposasegene, complete cds.] [nt:putative] [le:128] [re:1417] [di:di] |
| 22036625_f3_24 | 972 | 4626 | 924 | 307 | 1124 | 4.50E-114 | [ln:instranspo] [ac:134675] [pn:transposase] [or:insertion sequence is1251] [sr:insertion sequence is1251 dna] [db:genpept-bct] [de:insertion sequence is1251 from *enterococcus faecium* transposasegene, complete cds.] [nt:putative] [le:128] [re:1417] [di:di] |
| 22036625_f3_7 | 973 | 4627 | 1179 | 393 | 1436 | 3.90E-147 | [ln:instranspo] [ac:134675] [pn:transposase] [or:insertion sequence is1251] [sr:insertion sequence is1251 dna] [db:genpept-bct] [de:insertion sequence is1251 from *enterococcus faecium* transposasegene, complete cds.] [nt:putative] [le:128] [re:1417] [di:di] |
| 22046890_f1_2 | 974 | 4628 | 189 | 62 | 78 | 0.018 | [ac:q07211] [gn:sctk] [or:*streptococcus mutans*] [ec:2.7.1.4] [de:fructokinase,] [sp:q07211] [dbsswissprot] |
| 22063441_f2_13 | 975 | 4629 | 1416 | 471 | 208 | 7.80E-15 | [ac:q58902] [gn:mj1507] [or:*methanococcus jannaschii*] [de:hypothetical protein mj1507] [sp:q58902] [dbsswissprot] |
| 22064843_f1_17 | 976 | 4630 | 186 | 61 | 46 | 0.52 | [ac:s70114] [pn:probable membrane protein ydr284:hypothetical protein d9819.10] [gn:dpp1] [or:*saccharomyces cerevisiae*] [db:pir1] [mp:4r] |
| 22070443_c1_87 | 977 | 4631 | 2553 | 850 | 562 | 9.70E-81 | [ac:p23914] [gn:levr] [or:*bacillus subtilis*][de:transcriptional regulatory protein [evr] [sp:p23914] [dbsswissprot] |
| 22072132_c2_73 | 978 | 4632 | 1830 | 609 | 193 | 1.60E-11 | [ln:yscintana] [ac:103188] [fn:integrin analogue] [or:*saccharomyces cerevisiae* (library: lambda gt11) dna] [db:genpept-pln] [de:*saccharomyces cerevisiae* integrin analogue gene, complete cds.] [nt:putative] [le:1] [re:3049] [d |
| 22078536_f3_3 | 979 | 4633 | 1131 | 376 | 1719 | 4.00E-177 | [ac:p33166] [gn:tufa] [or:*bacillus subtilis*] [de:elongation factor tu (ef-tu) (p-40)] [sp:p33166] [dbsswissprot] |

TABLE 2-continued

| Orf | NT Seq ID | AA Seq ID | NT Orf length | AA Orf length | Score | Probability | Description |
|---|---|---|---|---|---|---|---|
| 22087513_c1_4 | 980 | 4634 | 414 | 137 | 52 | 0.97 | [ac:p44897] [gn:hi0840] [or:haemophilus influenzae] [de:hypothetical protein hi0840] [sp:p44897] [db:swissprot] |
| 22109387_f2_9 | 981 | 4635 | 270 | 89 | 68 | 0.036 | [ac:s45096] [pn:13k transport protein] [or:beet necrotic yellow vein mosaic virus] [db:pir] |
| 22147812_f1_4 | 982 | 4636 | 720 | 239 | 1129 | 1.30E-114 | [ac:s68603;s45077;s45078] [pn:hypothetical protein gamma] [gn:gamma] [or:streptococcus pyogenes] [db:pir] |
| 22150426_c2_58 | 983 | 4637 | 849 | 282 | 365 | 1.20E-33 | [ac:p08188] [gn:manz;ptsm;gptb] [or:escherichia coli] [de:(eii-m-man)] [sp:p08188] [dbsswissprot] |
| 22152182_c1_38 | 984 | 4638 | 1587 | 528 | 1487 | 1.60E-152 | [ac:q06752] [gn:cyss;spna] [or:bacillus subtilis] [ec:6.1.1.16] [de:(cysrs)] [sp:q06752] [db:swissprot] |
| 22164001_c3_75 | 985 | 4639 | 204 | 67 | 82 | 0.017 | [ln:humfaci1] [ac:m63597] [pn:fibril-associated collagen] [gn:hy-67] [or: homo sapiens] [sr:homo sapiens rhabdomyosarcoma mrna] [db:genpept-pri1] [de:human fibril-associated collagen (hy-67) mrna, partial cds.] [le:1] [re:1798] [di:direct] |
| 2224191_c2_19 | 986 | 4640 | 198 | 65 | 51 | 0.1 | [ac:p46854] [gn:yhhy] [or:escherichia coli] [de:hypothetical 18.8 kd protein in gntr-ggt intergenic region (o162)] [sp:p46854] [dbsswissprot] |
| 2224191_f1_5 | 987 | 4641 | 186 | 61 | 59 | 0.28 | [ln:mcacgdh] [ac:m10376;j02047] [or:cauliflower mosaic virus] [sr:cauliflower mosaic virus (individual_isolate cabb-d/h) dna] [db:genpept-vrl] [de:cauliflower mosaic virus (altered virulence isolate d/h), completegenome.] [nt:orf8; putative] [le:3260] [re |
| 2224191_f2_20 | 988 | 4642 | 186 | 61 | 59 | 0.28 | [ln:mcacgdh] [ac:m10376;j02047] [or:cauliflower mosaic virus] [sr:cauliflower mosaic virus (individual_isolate cabb-d/h) dna] [db:genpept-vrl] [de:cauliflower mosaic virus (altered virulence isolate d/h), completegenome.] [nt:orf8; putative] [le:3260] [re |
| 22273436_c1_93 | 989 | 4643 | 186 | 61 | 155 | 1.30E-10 | [ac:f70019] [pn:nfs protein homolog homolog yurw] [gn:yurw] [or:bacillus subtilis] [db:pir] |
| 22273567_c3_71 | 990 | 4644 | 864 | 287 | 199 | 4.80E-16 | [ln:spu33315] [ac:u33315] [pn:response regulator] [gn:come] [or:streptococcus pneumoniae] [db:genpept-bct] [de:streptococcus pneumoniae orfl gene, partial cds, competencestimulating peptide precursor (come), histidine protein kinase(comd) and response reg |
| 22281262_c3_209 | 991 | 4645 | 528 | 175 | 96 | 0.012 | [ln:a08388] [ac:a08388] [pn:polypeptide with immunological or biological] [or:unidentified] [db:genpept-pat] [de:recombinant dna gene for human fibroblast interferon-likepolypeptides.] [le:1] [re:1059] [di:direct] |
| 22288387_c1_46 | 992 | 4646 | 603 | 200 | 702 | 2.40E-69 | [ac:p37472] [gn:hprt:hpt] [or:bacillus subtilis] [ec:2.4.2.8] [de:(hgprtase)] [sp:p37472] [dbsswissprot] |

TABLE 2-continued

| Orf | NT Seq ID | AA Seq ID | NT Orf length | AA Orf length | Score | Probability | Description |
|---|---|---|---|---|---|---|---|
| 22292812_c1_57 | 993 | 4647 | 438 | 145 | 77 | 0.48 | [ln:rnd61a] [ac:y13275] [pn:d6.1a protein] [or:rattus norvegicus] [sr:norway rat] [db:genpept-rod] [de:rattus norvegicus mrna for d6.1a protein.] [le:230] [re:937] [di:direct] |
| 22297061_f1_3 | 994 | 4648 | 330 | 109 | 131 | 7.60E-08 | [ln:pau84154] [ac:u84154] [pn:putative transposase subunit] [gn:orf1] [or:pseodomonas alcaligenes] [db:genpept-bct] [de:pseudomonas alcaligenes insertion sequence is1491 putativetransposase subunit genes, complete cds.] [le:124] [re:1653] [di:direct] |
| 22300143_f3_25 | 995 | 4649 | 396 | 131 | 194 | 1.60E-15 | [ac:g69781] [pn:thioredoxin homolog ydfq] [gn:ydfq] [or:bacillus subtilis] [db:pir] |
| 22314811_f3_77 | 996 | 4650 | 195 | 64 | 57 | 0.41 | [ln:mtcy16b7] [ac:z81331] [pn:unknown] [gn:mtcy16b7.47] [or:mycobacterium tuberculosis] [db:genpept-bct] [de:mycobacterium tuberculosis cosmid scy16b7.] [nt:mtcy16b7.47, unknown partial orf] [le:43456] [re: |
| 22320135_c1_10 | 997 | 4651 | 756 | 251 | 160 | 1.10E-09 | [ln:ecu70214] [ac:u70214] [gn:yaeg] [or:escherichia coli] [db:genpept-bct] [de:escherichia coli chromosome minutes 4–6.] [nt:hypothetical] [le:13538] [re:14695] [di:direct] |
| 22343938_f2_11 | 998 | 4652 | 372 | 123 | 618 | 1.90E-60 | [ac:p23391] [gn:lacc] [or:lactococcus lactis] [sr:subsplactis:streptococcus lactis] [ec:2.7.1.—] [de:tagatose-6-phosphate kinase, (phosphotagatokinase) [sp:p23391] [dbswissprot] |
| 22351578_c3_76 | 999 | 4653 | 954 | 317 | 389 | 3.50E-36 | [ln:u88974] [ac:u88974] [pn:orf28] [or:streptococcus thermophilus] [db:genpept-bct] [de:streptococcus thermophilus bacteriophage 01205 dna sequence.] [le:17062] [re:17955] [di:direct] |
| 22352000_c2_39 | 1000 | 4654 | 192 | 63 | 69 | 0.097 | [ac:p45028] [gn:hi1084] [or:haemophilus influenzae] [de:hypothetical protein hi1084 precursor] [sp:p45028] [dbsswissprot] |
| 22362827_c1_26 | 1001 | 4655 | 723 | 240 | 781 | 1.00E-77 | [ln:lslaclm] [ac:x82287] [pn:beta-galactosidase large subunit] [gn:lacl] [or:lactobacillus sake] [db:genpept-bct] [de:l.sake lacI and lacm genes.] [le:188] [re:2065] [di:direct] |
| 22379660_c3_49 | 1002 | 4656 | 819 | 272 | 149 | 4.50E-14 | [ln:llu36837] [ac:u36837] [pn:abici] [fn:with abieii,abortive infection bacteriophage] [or:lactococcus lactis] [db:genpept-bct] [de:lactococcus lactis plasmid pnp40, abortive infection locus, abici,abicii, reca(lp), abif genes, complete cds.] [le:198] [r |
| 22383437_c1_26 | 1003 | 4657 | 792 | 263 | 191 | 3.40E-15 | [ac:b69885] [pn:transcriptional regulator (gntr family) homolog ymfc] [gn:ymfc] [or:bacillus subtilis] [db:pir] |
| 22386592_c1_42 | 1004 | 4658 | 846 | 281 | 84 | 0.085 | [ac:p95790] [gn:atpc] [or:streptcoococcus mutans] [ec:3.6.1.34] [de:atp synthase epsilon chain.] [sp:p95790] [dbsswissprot] |
| 22400931_c3_29 | 1005 | 4659 | 384 | 127 | 111 | 1.00E-06 | [ln:ssc12b06] [ac:z81264] [pn:nuclear protein] [or:sus scrofa] [sr:pig] [db:genpept-est7] [de:s.scrofa mrna; expressed sequence tag (5'; clone c12b06).] [nt:expressed sequence tag; ensis minor homolog] [le:<1] [re: |

TABLE 2-continued

| Orf | NT Seq ID | AA Seq ID | NT Orf length | AA Orf length | Score | Probability | Description |
|---|---|---|---|---|---|---|---|
| 2242936_f2_14 | 1006 | 4660 | 1947 | 648 | 1446 | 3.40E-148 | [ac:f69869] [pn:heavy metal-transporting atpase homolog ykvw] [gn:ykvw] [or:*bacillus subtilis*] [db:pir] |
| 2243907_f1_1 | 1007 | 4661 | 858 | 285 | 279 | 1.60E-24 | [n:stu73111] [ac:u73111] [pn:high-affinity periplasmic glutamine binding] [or:*salmonella typhimurium*] [db:genpept-bct] [de:*salmonella typhimurium* pexb (pexb) gene, partial cds andhigh-affinity glutamine transport operon, high-affinity periplasmicglutamin |
| 22439180_c1_36 | 1008 | 4662 | 969 | 322 | 538 | 5.70E-52 | [ac:g69803] [pn:abc transporter (atp-binding protein) homolog yfil] [gn:yfil] [or:*bacillus subtilis*] [db:pir] |
| 22439637_f2_27 | 1009 | 4663 | 384 | 127 | 140 | 8.50E-10 | [n:bphiadh] [ac:z99974] [pn:rad protein] [gn:rad] [fn:transcriptional repressor protein] [or:bacteriophage phiadh] [db:genpept-una] [de:bacteriophage phiadh lys, hol, intg, rad,and tee genes,] [re:5308] [re:5634] [di:complement] |
| 22442162_f1_1 | 1010 | 4664 | 495 | 164 | 283 | 6.00E-25 | [ac:p54520] [gn:yqhz] [or:*bacillus subtilis*] [den utilization substance protein b homolog (nusb protein)] [sp:p54520] [db:swissprot] |
| 22445306_f2_6 | 1011 | 4665 | 732 | 243 | 895 | 8.40E-90 | [ac:p39814] [gn:topa:topi] [or:*bacillus subtilis*] [ec:5.99.1.2] [de:(untwisting enzyme) (swivelase)] [sp:p39814] [db:swissprot] |
| 22447216_c2_9 | 1012 | 4666 | 360 | 119 | 179 | 6.30E-14 | [ac:p08655] [or:*staphylococcus aureus*] [de:hypothetical 19.7 kd protein in mercuric resistance operon] [sp:p08655] [db:swissprot] |
| 2245337_c1_21 | 1013 | 4667 | 783 | 260 | 1273 | 7.40E-130 | [n:laclacr] [ac:m35375] [or:*lactococcus lactis* sr:*l.lactis* (strain mg 1820) dna] [db:genpept-bct] [de:*l.lactis* lactose phosphotransferase system repressor (lacr) gene,complete cds.] [nt:lactose repressor (lacr; alt.)] [le:370] [re:1155] [di:direct] |
| 22457280_f2_24 | 1014 | 4668 | 192 | 63 | 73 | 0.073 | [ln:yeu46859] [ac:u46859:u18674:u25113] [pn:wbcd] [gn:wbcd] [fn:putative glycosyltransferase] [or:*yersinia enterocolitica*] [de:*yersinia enterocolitica* lipopolysaccharide o-side chainbiosynthesis genes.] [le:78844] [re:8854] [di: |
| 22457787_f2_16 | 1015 | 4669 | 351 | 116 | 58 | 0.38 | [ac:p51274] [gn:ycf47] [or:*porphyra purpurea*] [de:hypothetical 8.2 kd protein ycf47 (orf71)] [sp:p51274] [db:swissprot] |
| 22459686_f2_10 | 1016 | 4670 | 261 | 86 | 77 | 0.015 | [ln:cbqprs] [ac:y15898] [pn:hypothetical protein] [gn:orf233] [or:*coxiella burnetii*] [db:genpept-bct] [de:*coxiella burnetii* plasmid qprs dna.] [le:17116] [re:17817] [di:direct] |
| 22460055_f1_1 | 1017 | 4671 | 903 | 300 | 857 | 8.90E-86 | [ac:b64829] [pn:hypothetical protein b0899] [or:*escherichia coli*] [db:pir] |
| 22460816_c2_129 | 1018 | 4672 | 1203 | 400 | 2003 | 3.20E-207 | [ac:p19775] [gn:tnp] [or:*staphylococcus aureus*] [de:transposase for insertion sequence element is256 in transposon tn4001] [sp:p19775] [db:swissprot] |
| 22460816_c2_54 | 1019 | 4673 | 1203 | 400 | 2003 | 3.20E-207 | [ac:p19775] [gn:tnp] [or:*staphylococcus aureus*] [de:transposase for insertion sequence element is256 in transposon tn4001] [sp:p19775] [db:swissprot] |
| 22460816_c3_142 | 1020 | 4674 | 450 | 149 | 644 | 3.30E-63 | [ac:p19775] [gn:tnp] [or:*staphylococcus aureus*] [de:transposase for insertion sequence element is256 in transposon tn4001] [sp:p19775] [db:swissprot] |

TABLE 2-continued

| Orf | NT Seq ID | AA Seq ID | NT Orf length | AA Orf length | Score | Probability | Description |
|---|---|---|---|---|---|---|---|
| 22460816_c3_62 | 1021 | 4675 | 1203 | 400 | 1979 | 1.10E-204 | [ac:p19775] [gn:tnp] [or:*staphylococcus aureus*] [de:transposase for insertion sequence element is256 in transposon tn4001] [sp:p19775] [db:swissprot] |
| 22460816_f3_8 | 1022 | 4676 | 834 | 277 | 1329 | 8.60E-136 | [ac:p19775] [gn:tnp] [or:*staphylococcus aureus*] [de:transposase for insertion sequence element is256 in transposon tn4001] [sp:p19775] [db:swissprot] |
| 22461077_c3_15 | 1023 | 4677 | 1077 | 358 | 736 | 5.90E-73 | [ac:c69975] [pn:acyltransferase homolog yrhl] [gn:yrhl] [or:*bacillus subtilis*] [db:pir] |
| 22461693_f2_44 | 1024 | 4678 | 339 | 112 | 212 | 2.00E-17 | [ac:p46319] [gn:eeIc] [or:*bacillus subtilis*] [ec:2.7.1.69] [de:(ec 2.7.1.69) (eiii-cel)] [sp:p46319] [db:swissprot] |
| 22462688_c2_42 | 1025 | 4679 | 2640 | 879 | 1951 | 4.40E-204 | [ac:a69979] [pn:conjugation transfer protein homolog yrre] [gn:yrre] [or:*bacillus subtilis*] [db:pir] |
| 22462752_f2_6 | 1026 | 4680 | 201 | 66 | 359 | 5.30E-33 | [ln:entaorf] [ac:x94181] [pn:enterocin a] [gn:enta] [or:*enterococcus faecium*] [db:genpept-bct] [de:*e.faecium* enta and orf2 genes.] [le:108] [re:305] [di:direct] |
| 22463937_f2_28 | 1027 | 4681 | 915 | 304 | 1028 | 6.80E-104 | [ac:g69989] [pn:abc transporter (permease) homolog ytcp] [gn:ytcp] [or:*bacillus subtilis*] [db:pir] |
| 22464215_f3_17 | 1028 | 4682 | 1773 | 590 | 1359 | 5.70E-139 | [ac:q07744] [gn:pepo] [or:*lactococcus lactis*] [sr:,subsp*lactis*:*streptococcus lactis*] [ec:3.4.24.—] [de:neutral endopeptidase, (peptidase o)] [sp:q07744] [db:swissprot] |
| 22464375_c2_37 | 1029 | 4683 | 1821 | 606 | 69 | 0.0034 | [ac:b32227] [pn:hypothetical protein 2 (mer operon)] [or:*bacillus sp.*] [db:pir] |
| 22464427_c1_54 | 1030 | 4684 | 720 | 239 | 783 | 6.20E-78 | [ac:p12041] [gn:purq] [or:*bacillus subtilis*] [ec:6.3.5.3] [de:synthase i)] [sp:p12041] [db:swissprot] |
| 22468765_c2_4 | 1031 | 4685 | 435 | 144 | 285 | 3.70E-25 | [ac:p54554] [gn:yqiq] [or:*bacillus subtilis*] [de:(ec 1.—.—.—)] [sp:p54554] [db:swissprot] |
| 22468765_c3_70 | 1032 | 4686 | 300 | 99 | 91 | 0.000063 | [ac:d69841] [pn:hypothetical protein yits] [gn:yits] [or:*bacillus subtilis*] [db:pir] |
| 22475327_c1_64 | 1033 | 4687 | 261 | 86 | 69 | 0.071 | [ac:s05244] [pn:alpha-2u-globulin precursor (clone 36)] [cl:lipocalin:lipocalin homology] [or:*rattus norvegicus*] [sr:, norway rat] [db:pir] |
| 22476587_c3_53 | 1034 | 4688 | 1197 | 398 | 210 | 1.10E-16 | [ln:anu85709] [ac:u85709] [pn:putative fimbrial-associated protein] [or:*actinomyces naeslundii*] [db:genpept-bct] [de:*actinomyces naeslundii* putative fimbrial-associated protein genes,complete cds.] [nt:orf4] [le:98] [re:940] [di:direct] |
| 22477250_c2_69 | 1035 | 4689 | 189 | 62 | 74 | 0.0084 | [ac:p20194] [or:*sulfolobus* virus-like particle ssv1] [de:hypothetical 11.9 kd protein (orf a-100)] [sp:p20194] [db:swissprot] |
| 22477318_c1_11 | 1036 | 4690 | 1359 | 452 | 1685 | 1.60E-173 | [ac:p13375] [gn:pgia] [or:*bacillus stearothermophilus*] [ec:5.3.1.9] [de:isomerase a)] [sp:p13375] [db:swissprot] |
| 22478437_f1_2 | 1037 | 4691 | 951 | 316 | 678 | 8.30E-67 | [ac:s77381] [pn:hypothetical protein] [or:*synechocystis sp.*] [sr:pcc 6803, , pcc 6803, ] [db:pir] |

TABLE 2-continued

| Orf | NT Seq ID | AA Seq ID | NT Orf length | AA Orf length | Score | Probability | Description |
|---|---|---|---|---|---|---|---|
| 22478452_c1_39 | 1038 | 4692 | 966 | 321 | 932 | 1.00E-93 | [ac:f69794] [pn:dna ligase homolog yergl [gn:yerg] [or:*bacillus subtilis*] [db:pir] [ln:lppyibsop] [ac:z54240] [pn:glutaminase of carbamoyl-phosphate synthase] [gn:pyraa] |
| 22478462_f2_4 | 1039 | 4693 | 1056 | 351 | 1249 | 2.60E-127 | [or:*lactobacillus plantarum*] [db:genpept-bct] [ec:6.3.5.5] [de:*l.plantarum* pyrimidine biosynthetic operon (pyrr, pyrb, pyrc, pyraa, pyrab, pyrd, pyrf and pyre) genes.] |
| 22479562_f1_1 | 1040 | 4694 | 216 | 71 | 53 | 0.15 | [ln:mmu14648] [ac:u14648] [fn:dna binding transcription factor] [or:mus musculus] [sr:mouse] [db:genpept-rod] [de:mus musculus putative myelin regulatory factor 1 mrna partial cds.] |
| 22479842_c1_87 | 1041 | 4695 | 354 | 117 | 133 | 4.70E-09 | [nt:putative myelin regulatory factor 1: mrf-1] [le:<1] [re:854] [di:dir] [ln:bru38906] [ac:u38906] [or:bacteriophage r1t] [db:genpept-phg] [de:bacteriophage r1t integrase, repressor protein (rro), dutpase,holin and lysin genes complete cds.] [nt:orf6] [le:4051] [re:4383] [di:direct] |
| 22532752_f3_31 | 1042 | 4696 | 183 | 60 | 47 | 0.29 | [ln:cef56h6] [ac:z81553] [pn:f56h6.4] [or:*caenorhabditis elegans*] [db:genpept-inv] [de:*caenorhabditis elegans* cosmid f56h6, complete sequence.] [le:11440:118856:12032:12329] |
| 22539053_c3_112 | 1043 | 4697 | 207 | 68 | 62 | 0.15 | [re:11591:11987:12172:12486] [di:directjoin] [ln:ecu28377] [ac:u28377] [or:*escherichia coli*] [db:genpept-bct] [de:*escherichia coli* k-12 genome; approximately 65 to 68 minutes.] [nt:orf_o97] [le:112036] [re:112329] [di:direct] |
| 22546908_c2_66 | 1044 | 4698 | 1002 | 333 | 160 | 2.60E-09 | [ac:p39606] [gn:ywch:ipa-44d] [or:*bacillus subtilis*] [de:hypothetical 36.6 kd protein in qoxd-vpr intergenic region] [sp:p39606] [db:swissprot] |
| 22557928_c3_49 | 1045 | 4699 | 420 | 140 | 66 | 0.085 | [ln:s44195] [ac:s44195] [pn:agrin] [gn:agrn] [or:homo sapiens] [sr:human] [db:genpept-pri2] [de:agrn=agrin {alternatively spliced} human, mrna, 188 nt].] [nt:synaptic basal lamina component; this sequence] [le:1] [re:188] [di:direct] |
| 22557937_c2_61 | 1046 | 4700 | 366 | 121 | 62 | 0.65 | [ac:p35517] [gn:lcib] [or:*lactococcus lactis* sr;subsperenoris:*streptococcus cremoris*] [de:lactococcin b immunity protein] [sp:p35517] [db:swissprot] |
| 22558438_c1_172 | 1047 | 4701 | 750 | 249 | 397 | 5.00E-37 | [ln:cbaj2527] [ac:aj002527] [pn:orfx] [gn:orfx] [fn:putative transaldolase (37.4% identity to talc] [or:*clostridium beijerinckii*] [db:genpept-bct] [de:*clostridium beijerinckii* glucitol transport gene system.] [le:1833] [re:2513] [di:direct] |
| 22656280_f2_4 | 1048 | 4702 | 1008 | 335 | 726 | 6.80E-72 | [ac:g70030] [pn:amino acid permease homolog yvbw] [gn:yvbw] [or:*bacillus subtilis*] [db:pir] |
| 22657777_c2_64 | 1049 | 4703 | 201 | 66 | 268 | 2.30E-23 | [ac:p54689] [gn:ilve:hi1193] [or:*haemophilus influenzae*] [ec:2.6.1.42] [de:b) (bcat)] [sp:p54689] [db:swissprot] |
| 22663177_c3_21 | 1050 | 4704 | 213 | 70 | 51 | 0.097 | [ac:p04808] [gn:rln1] [or:homo sapiens] [sr:,human] [de:prorelaxin h1 precursor] [sp:p04808] [db:swissprot] |

TABLE 2-continued

| Orf | NT Seq ID | AA Seq ID | NT Orf length | AA Orf length | Score | Probability | Description |
|---|---|---|---|---|---|---|---|
| 22677202_c1_53 | 1051 | 4705 | 825 | 274 | 920 | 1.90E-92 | [ac:p18843;p78235] [gn:nadc:efg;ntrI] [or:escherichia coli] [ec:6.3.5.1] [de:protein] [sp:p18843:p78235] [db:swissprot] |
| 22678131_f3_83 | 1052 | 4706 | 2859 | 952 | 1515 | 1.70E-155 | [ln:sau58333] [acu58333] [pn:surface protein rib] [gn:rib] [or:streptococcus agalactiae] [sr:streptococcus agalactiae strain=bm110] [db:genpept-bct] [de:streptococcus agalactiae group b surface protein rib (rib) gene,complete cds.] [le:70] [re:3765] [di:<1] [re: |
| 22681287_c1_52 | 1053 | 4707 | 1050 | 349 | 1104 | 6.00E-112 | [ac:g69830] [pn:lipoate-protein ligase homolog yhf] [gn:yhfj] [or:bacillus subtilis] [db:pir] |
| 22682662_c2_15 | 1054 | 4708 | 204 | 67 | 48 | 0.24 | [ln:oau76739] [acu76739] [pn:nitric oxide synthase] [gn:nnos] [or:ovis aries] [sr:sheep] [db:genpept-mam] [de:ovis aries nitric oxide synthase (nnos) gene, partial cds.] [le:<1] [re: |
| 22682662_c2_30 | 1055 | 4709 | 204 | 67 | 48 | 0.24 | [ln:oau76739] [acu76739] [pn:nitric oxide synthase] [gn:nnos] [or:ovis aries] [sr:sheep] [db:genpept-mam] [de:ovis aries nitric oxide synthase (nnos) gene, partial cds.] [le:<1] [re: |
| 22687801_c3_87 | 1056 | 4710 | 450 | 149 | 126 | 2.80E-07 | [ac:s76167] [pn:hypothetical protein] [or:synechocystis sp.] [sr:pcc 6803, , pcc 6803] [sr:pcc 6803,] [db:pir] |
| 22695812_f1_8 | 1057 | 4711 | 1470 | 489 | 149 | 2.20E-08 | [ln:shu35635] [acu35635] [pn:unknown] [or:staphylococcus haemolyticus] [sr:staphylococcus haemolyticus strain=y176] [db:genpept-bct] [de:staphylococcus haemolyticus is1272 orf1 and orf2 genes, completecds.] [nt:orf2] [le:394] [re:1083] [di:complement] |
| 22695812_f2_8 | 1058 | 4712 | 426 | 141 | 94 | 0.0031 | [ac:i40184:s41294] [pn:hypothetical protein 1169a] [or:bacteroides fragilis] [db:pir] |
| 22697590_f2_37 | 1059 | 4713 | 378 | 125 | 445 | 4.10E-42 | [ac:p37949] [gn:lepa] [or:bacillus subtilis] [de:gtp-binding protein lepa] [sp:p37949] [db:swissprot] |
| 22705437_f1_5 | 1060 | 4714 | 1200 | 399 | 483 | 3.80E-46 | [ac:c69789] [pn:hypothetical protein ydjg] [gn:ydjg] [or:bacillus subtilis] [db:pir] |
| 22738187_c1_14 | 1061 | 4715 | 525 | 174 | 78 | 0.099 | [ac:c69844] [pn:hypothetical protein yjbl] [gn:yjbl] [or:bacillus subtilis] [db:pir] |
| 22743937_f1_3 | 1062 | 4716 | 1020 | 339 | 508 | 8.60E-49 | [ln:efu63997] [acu63997] [or:enterococcus faecium] [db:genpept-bct] [de:enterococcus faecium insertion sequence is1476 putative transposasegene, complete cds.] [nt:putative transposase] [le:140] [re:1414] [di:direct] |
| 22832258_c3_7 | 1063 | 4717 | 693 | 230 | 113 | 0.00096 | [ac:p40367] [gn:yj1062w;j1132:hrc830] [or:saccharomyces cerevisiae] [sr:baker's yeast] [de:hypothetical 94.9 kd protein in mrpl8-nup82 intergenic region] [sp:p40367] [db:swissprot] |
| 22832943_c3_76 | 1064 | 4718 | 231 | 76 | 61 | 0.18 | [ln:d90845] [ac:d90845:ab001340] [gn:yega] [or:escherichia coli] [sr:escherichia coli (strain:k12) dna, clone_lib:kohara lambda minise) [db:genpept-bct] [de:e.coli genomic dna, kohara clone #356(46.1–46.5 min.).] [nt:orf_id:o355#3; similar to [swissprot a |

TABLE 2-continued

| Orf | NT Seq ID | AA Seq ID | NT Orf length | AA Orf length | Score | Probability | Description |
|---|---|---|---|---|---|---|---|
| 22836088_c2_99 | 1065 | 4719 | 894 | 297 | 1044 | 1.40E-105 | [ac:q54713] [gn:hasc] [or:streptococcus pyogenes] [ec:2.7.7.9] [de:uridylyltransferase) (uridine diphosphoglucose pyrophosphorylase)] [sp:q54713] [db:swissprot] |
| 22836693_c3_145 | 1066 | 4720 | 258 | 85 | 86 | 0.0079 | [ac:s40926] [pn:hypothetical protein zk1098.3] [or:caenorhabditis elegans] [db:pir] |
| 22837756_f1_6 | 1067 | 4721 | 579 | 192 | 513 | 2.50E-49 | [ac:d69670] [pn:glycine betaine/carnitine/choline abc transporter (membrane p) opucb] [gn:opucb] [or:bacillus subtilis] [db:pir] |
| 22844077_c1_121 | 1068 | 4722 | 1668 | 555 | 1755 | 6.20E-181 | [ac:q59905] [gn:dexb] [or:streptococcus equisimilis] [ec:3.2.1.70] [de:(exo-1,6-alpha-glucosidase) (glucodextranase)] [sp:q59905] [db:swissprot] |
| 22845463_f1_4 | 1069 | 4723 | 960 | 319 | 187 | 8.10E-12 | [ac:p46344-p46345:p46346] [gn:yqff] [or:bacillus subtilis] [de:hypothetical 79.2 kd protein in phol-dgka intergenic region] [sp:p46344-p46345:p46346] [db:swissprot] |
| 22848462_c1_16 | 1070 | 4724 | 336 | 111 | 71 | 0.017 | [ln:strinte] [ac:129324] [pn:orf11] [or:streptococcus pneumoniae] [db:genpept-bct] [de:streptococcus pneumoniae putative integrase, putative orf2,putative excisionase, putative orf7, putative repressor protein,putative orf8, putative dna relaxase, putativ |
| 22848537_f2_19 | 1071 | 4725 | 183 | 60 | 49 | 0.7 | [ac:p44067] [gn:hi0874] [or:haemophilus influenzae] [de:hypothetical protein hi0874] [sp:p44067] [db:swissprot] |
| 22849092_c1_30 | 1072 | 4726 | 1872 | 623 | 479 | 1.00E-45 | [ln:rmu67998] [ac:u67998] [pn:cyclic beta-1,2-glucan modification protein] [gn:cgma] [fn:transfers sn-1 phosphoglycerol substituents to] [or:sinorhizobium meliloti] [db:genpept-bct] [de:sinorhizobium meliloti orf1 and cyclic beta-1,2-glucan modificationpr |
| 22851080_f2_18 | 1073 | 4727 | 300 | 99 | 72 | 0.061 | [ln:s80644] [ac:s80644] [pn:glutaminase] [gn:glutaminase, ga] [or:mitochondrion sus scrofa sr:pig llc-pk1-f+ cells] [db:genpept-mam] [de:glutaminase {3' region} [swine, llc-pk1-f+ cells, mrna partial,3218 nt] |
| 22853337_c3_13 | 1074 | 4728 | 240 | 79 | 80 | 0.039 | [ln:af018164] [ac:af018164] [pn:kinesin-like protein 3c] [gn:kif3c] [or:homo sapiens] [sr:human] [db:genpept-pri2] [de:homo sapiens kinesin-like protein 3c (kif3c) mrna, complete cds.] [le:155] [re:2533] [di:direct] |
| 22854686_c1_46 | 1075 | 4729 | 972 | 324 | 674 | 2.20E-66 | [ac:p54184] [gn:cina] [or:streptococcus pneumoniae] [de:putative competence-damage protein] [sp:p54184] [db:swissprot] |
| 22862899_c1_20 | 1076 | 4730 | 679 | 226 | 318 | 1.20E-28 | [ac:f69903] [pn:d-alanyl-d-alanine carboxypeptidase homolog yodj] [gn:yodj] [or:bacillus subtilis] [db:pir] |
| 22868762_c1_28 | 1077 | 4731 | 222 | 73 | 61 | 0.29 | [ln:cteu56093] [ac:u56093] [pn:cytochrome b] [gn:cyt b] [or:mitochondrion exoneura tridentata] [sr:exoneura tridentata cytochrome b (cyt b) gene, mitochondrial geneencoding mitochondrial protein, partial cds.] [le: |

TABLE 2-continued

| Orf | NT Seq ID | AA Seq ID | NT Orf length | AA Orf length | Score | Probability | Description |
|---|---|---|---|---|---|---|---|
| 22890701_f3_119 | 1078 | 4732 | 246 | 81 | 72 | 0.017 | [ac:p33967] [gn:bsr] [or:bacillus cereus] [ec:3.5.4.23] [de:blasticidin-s deaminase,] [sp:p33967] [db:swissprot] |
| 22916068_c2_46 | 1079 | 4733 | 291 | 96 | 195 | 1.30E-15 | [ac:p39274] [gn:yjdj] [or:escherichia coli] [de:hypothetical 10.5 kd protein in dcub-lysu intergenic region (o90a)] [sp:p39274] [db:swissprot] |
| 22926693_f1_3 | 1080 | 4734 | 615 | 204 | 87 | 0.0055 | [ac:s40099] [pn:hypothetical protein] [or:clostridium butyricum] [db:pir] |
| 23437568_c3_112 | 1081 | 4735 | 1077 | 358 | 256 | 4.00E-20 | [ac:p72720] [gn:glms:s110220] [or:synechocystis sp] [sr:pcc 6803,] [ec:2.6.1.16] [de:amidotransferase] (glucosamine-6-phosphate synthase)] [sp:p72720] [db:swissprot] |
| 23437882_f2_112 | 1082 | 4736 | 909 | 302 | 368 | 5.90E-34 | [ac:p15294] [gn:pttm] [or:lactococcus lactis] [sr:, subsplactis:streptococcus lactis] [de:protease maturation protein precursor] [sp:p15294] [db:swissprot] |
| 23438588_c2_64 | 1083 | 4737 | 753 | 250 | 85 | 0.3 | [ac:q05596] [gn:cbio] [or:salmonella typhimurium] [de:cobalt transport atp-binding protein cbio] [sp:q05596] [db:swissprot] |
| 23438762_f2_6 | 1084 | 4738 | 309 | 102 | 131 | 7.60E-09 | [ln:d78257] [ac:d78257] [pn:orf7] [gn:orf7] [or:enterococcus faecalis] [sr:enterococcus faecalis plasmid-pyi17 dna] [db:genpept-bct] [de:enterococcus faecalis plasmid pyi17 genes for baca, bacb, orf3,orf4, orf5, orf6, orf7, orf8, orf9, orf10, orf11,partia |
| 23438803_c3_57 | 1085 | 4739 | 1191 | 396 | 279 | 6.00E-29 | [ac:f64175:ss27579] [pn:hypothetical protein hi1698 (lsg locus)] [or:haemophilus influenzae] [db:pir] |
| 23439137_f2_21 | 1086 | 4740 | 1416 | 471 | 1068 | 3.90E-108 | [ac:p37062] [gn:npr] [or:enterococcus faecalis] [sr:,streptoococcus faecalis] [ec:1.11.1.1] [de:nadh peroxidase, (npxase)] [sp:p37062] [db:swissprot] |
| 23439715_f1_1 | 1087 | 4741 | 1692 | 563 | 2019 | 6.60E-209 | [ac:q45493] [gn:ykqc] [or:bacillus subtilis] [de:hypothetical 61.5 kd protein in adec-pdha intergenic region] [sp:q45493] [db:swissprot] |
| 23439818_f2_33 | 1088 | 4742 | 1137 | 378 | 895 | 8.40E-90 | [ac:a69954] [pn:conserved hypothetical protein yqfo] [gn:yqfo] [or:bacillus subtilis] [db:pir] |
| 23440812_f1_10 | 1089 | 4743 | 465 | 154 | 486 | 1.80E-46 | [ac:p37949] [gn:lepa] [or:bacillus subtilis] [de:gtp-binding protein lepa] [sp:p37949] [db:swissprot] |
| 23444068_c3_43 | 1090 | 4744 | 870 | 289 | 1474 | 3.70E-151 | [ac:q47747] [gn:vanw] [or:enterococcus faecalis] [sr:,streptoococcus faecalis] [de:vancomycin b-type resistance protein vanw] [sp:q47747] [db:swissprot] |
| 23444827_c3_60 | 1091 | 4745 | 204 | 67 | 112 | 1.20E-06 | [ac:s69748] [pn:hypothetical protein ydr537c] [or:saccharomyces cerevisiae] [db:pir] [mp:4r] |
| 23445375_c1_13 | 1092 | 4746 | 207 | 68 | 61 | 0.16 | [ac:s42738] [pn:hypothetical protein 1] [or:mitochondrion williopsis suaveolens] [db:pir] |
| 23445431_c1_34 | 1093 | 4747 | 1509 | 502 | 1631 | 8.50E-168 | [ac:p25811] [gn:thdf] [or:bacillus subtilis] [de:possible thiophene and furan oxidation protein thdf] [sp:p25811] [db:swissprot] |
| 23445463_c1_192 | 1094 | 4748 | 249 | 82 | 132 | 6.00E-09 | [ln:efgls24b] [ac:aj000042] [gn:glsb] [or:enterococcus faecalis] [db:genpept-bct] [de:enterococcus faecalis gls24, glsb genes.] [le:881] [re:1075] [di:direct] |

TABLE 2-continued

| Orf | NT Seq ID | AA Seq ID | NT Orf length | AA Orf length | Score | Probability | Description |
|---|---|---|---|---|---|---|---|
| 23446063_f1_2 | 1095 | 4749 | 1173 | 390 | 337 | 1.10E-30 | [acc:c69673] [pn:penicillin-binding protein pbpx] [gn:pbpx] [or:bacillus subtilis] [db:pir] |
| 23447682_c2_47 | 1096 | 4750 | 213 | 70 | 64 | 0.26 | [acc:p02635] [or:penaeus sp] [sr:penoeid shrimp] [de:sarcoplasmic calcium-binding protein (sep). beta chain] [sp:p02635] [db:swissprot] |
| 23447682_c3_39 | 1097 | 4751 | 189 | 62 | 53 | 0.82 | [n:srreppro] [ac:z12102] [gn:orf5] [or:selenomonas ruminantium] [db:genpept-bct] |
| 23455327_f1_5 | 1098 | 4752 | 2193 | 730 | 3444 | 0 | [des.ruminantium replication protein.] [le:1986] [re:2324] [di:complement] [ln:ehy13922] [acy13922:y15222] [gn:pbp3s] [or:enterococcus hirae] [db:genpept-bct] [de:enterococcus hirae mraz, pbp3s, mray, murd, murg, ftsq and ftsagenes, mraw, yllc and ftsz partial genes.] [le:1885] [re:4077] [di:direct] |
| 23456502_c2_53 | 1099 | 4753 | 813 | 270 | 623 | 5.60E-61 | [acp18816] [gn:lacr] [or:lactococcus lactis] [sr;subsplactis:streptococcus lactis] [de:lactose phosphotransferase system repressor] [sp:p18816] [db:swissprot] |
| 234567_f3_13 | 1100 | 4754 | 531 | 176 | 138 | 4.10E-11 | [acc:q00750] [gn:msmf] [or:streptococcus mutans] [de:multiple sugar-binding transport system permease protein msmf] [sp:q00750] [db:swissprot] |
| 23457031_c1_95 | 1101 | 4755 | 417 | 138 | 82 | 0.23 | [acc:q12365] [gn:bbpl:yp1255w] [or:saccharomyces cerevisiae] [sr:baker's yeast] [de:bbpl protein] [sp:q12365] [db:swissprot] |
| 23459412_c2_27 | 1102 | 4756 | 480 | 159 | 57 | 0.73 | [acc:p51366] [gn:ycf18] [or:porphyra purpurea] [de:hypothetical 6.9 kd protein yef18 (orf58)] [sp:p51366] [db:swissprot] |
| 23460842_c3_186 | 1103 | 4757 | 234 | 77 | 57 | 0.004 | [ln:cet23f1] [ac:z81129] [pn:t23f1.3] [or:caenorhabditis elegans] [db:genpept-inv] [de:caenorhabditis elegans cosmid t23f1, complete sequence.] [le:4774:4928:5654] |
| 23461013_f3_23 | 1104 | 4758 | 516 | 171 | 132 | 2.00E-08 | [re:4877:5376:6153] [di:complementjoin] [acc:g69777] [pn:transcriptional regulator (arac/xyls famil) homolog ydee] [gn:ydee] [or:bacillus subtilis] [db:pir] |
| 23464087_f1_13 | 1105 | 4759 | 1641 | 546 | 927 | 3.40E-93 | [ln:lsexogc] [acx98238] [fn:dipeptidase] [or:lactobacillus sake] [db:genpept-bct] [de:l.sake gene cluster.] [nt:putative; orf1] [le:2989] [re:4410] [di:direct] |
| 23469138_f2_12 | 1106 | 4760 | 402 | 133 | 47 | 0.049 | [ln:llb11] [ac:x68609:s47066] [pn:protein export element] [or:lactococcus lactis] [db:genpept-bct] [de:l. lactis dna for export element b11.] [nt:fragment b11] [le:117] [re: |
| 23470688_f1_8 | 1107 | 4761 | 864 | 287 | 915 | 6.40E-92 | [acc:c69854] [pn:conserved hypothetical protein yjqc] [gn:yjqc] [or:bacillus subtilis] [db:pir] |
| 23472002_c2_20 | 1108 | 4762 | 975 | 324 | 1154 | 3.00E-117 | [acq547131] [gn:hasc] [or:streptococcus pyogenes] [ec:2.7.7.9] [de:uridylyltransferase (uridine diphosphoglucose pyrophosphorylase)] [sp:q547131] [db:swissprot] |
| 23472132_f2_23 | 1109 | 4763 | 876 | 291 | 406 | 5.50E-38 | [acc:c69744] [pn:conserved hypothetical protein ybbh] [gn:ybbh] [or:bacillus subtilis] [db:pir] |
| 23475026_c3_40 | 1110 | 4764 | 1161 | 386 | 717 | 6.10E-71 | [acb:69721] [pn:teichoic acid linkage unit synthesis tago] [gn:tago] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 23478433_c2_177 | 1111 | 4765 | 321 | 106 | 358 | 6.70E-33 | [ac:q08637] [gn:ntpb] [or:enterococcus hirae] [ec:3.6.1.34] [de:translocating atpase subunit b]) [sp:q08637] [db:swissprot] |
| 23479827_c2_69 | 1112 | 4766 | 534 | 178 | 384 | 1.20E-35 | [ac:p25744] [gn:ycee] [or:escherichia coli] [de:hypothetical 43.9 kd protein in msyb-htrb intergenic region (orf1)] [sp:p25744] [db:swissprot] |
| 23484375_c3_53 | 1113 | 4767 | 360 | 119 | 150 | 6.80E-13 | [ac:q60310] [gn:mjecs11] [or:methanococcus jannaschii] [de:hypothetical protein mjecs11] [sp:q60310] [db:swissprot] |
| 23486017_c1_29 | 1114 | 4768 | 828 | 275 | 872 | 2.30E-87 | [ac:g69884] [pn:conserved hypothetical protein ymdb] [gn:ymdb] [or:bacillus subtilis] [db:pir] |
| 23491577_c1_12 | 1115 | 4769 | 1002 | 333 | 1323 | 3.70E-135 | [ac:q59309] [gn:gap] [or:clostridium pasteurianum] [ec:1.2.1.12] [de:glyceraldehyde 3-phosphate dehydrogenase, (gapdh)] [sp:q59309] [db:swissprot] |
| 23492776_f2_14 | 1116 | 4770 | 216 | 71 | 60 | 0.52 | [ac:q06463] [gn:ycf21] [or:antithamnion sp] [de:hypothetical 21.4 kd protein in seca 5'region (orf179)] [sp:q06463] [db:swissprot] |
| 23525463_c3_75 | 1117 | 4771 | 468 | 155 | 233 | 1.20E-19 | [ln:bsargr] [ac:y09546] [pn:arginine repressor] [gn:argr] [fn:regulation of arginine biosynthesis genes] [or:bacillus stearothermophilus] [db:genpept-bct] [de:b.stearothermophilus argr gene.] [le:32] [re:481] [di:direct] |
| 2353387_c1_33 | 1118 | 4772 | 531 | 176 | 125 | 1.60E-07 | [ac:g69831] [pn:phosphoglycerate mutase (glycolysis) homolog yhfr] [gn:yhfr] [or:bacillus subtilis] [db:pir] |
| 235340_c3_208 | 1119 | 4773 | 375 | 124 | 72 | 0.014 | [ln:serry] [ac:107627] [or:saccharopolyspora erythraea] [sr:saccharopolyspora erythraea (strain nrrl 2338) dna; and insertio] [db:genpept-bct] [de:saccharopolyspora erythraea insertion sequence is1136, copy b, 5'end.] [nt:putative] [le:445] [re:718] [di:direct] |
| 235402_f2_2 | 1120 | 4774 | 261 | 86 | 68 | 0.055 | [ac:q00990] [gn:rplm] [or:staphylococcus carnosus] [de:50s ribosomal protein 113] [sp:q00990] [db:swissprot] |
| 23539053_c2_23 | 1121 | 4775 | 270 | 89 | 81 | 0.0031 | [ac:h69908] [pn:phage-related protein homolog yok1] [gn:yok1] [or:bacillus subtilis] [db:pir] |
| 23547001_c3_26 | 1124 | 4778 | 813 | 270 | 427 | 3.30E-40 | [ac:p23553] [gn:xync] [or:caldocellum saccharolyticum] [ec:3.1.—.—] [de:acetyl esterase,] [sp:p23553] [db:swissprot] |
| 23547162_c3_51 | 1125 | 4779 | 1119 | 372 | 859 | 5.50E-86 | [ac:p20692] [gn:tyra] [or:bacillus subtilis] [ec:1.3.1.12] [de:prephenate dehydrogenase, (pdh)] [sp:p20692] [db:swissprot] |
| 23547180_c1_24 | 1126 | 4780 | 864 | 287 | 323 | 3.40E-29 | [ac:p54535] [gn:yqix] [or:bacillus subtilis] [de:intergenic region precursor] [sp:p54535] [db:swissprot] |
| 235402_f2_2 (cont) | 1122 | 4776 | 513 | 170 | 62 | 0.33 | [ln:ssspcoper] [ac:y07778] [pn:ribosomal protein s14] [or:sulfolobus acidocaldarius] [db:genpept-bct] [de:s.acidocaldarius dna for spc operon.] [le:1529] [re:1693] [di:direct] |
| 23546676_c3_57 | 1123 | 4777 | 1137 | 378 | 1339 | 7.50E-137 | [ac:p29727] [gn:guaa] [or:bacillus subtilis] [ec:6.3.5.2] [de:amidotransferase] (gmp synthetase) [sp:p29727] [db:swissprot] |

TABLE 2-continued

| Orf | NT Seq ID | AA Seq ID | NT Orf length | AA Orf length | Score | Probability | Description |
|---|---|---|---|---|---|---|---|
| 23547827_f2_7 | 1127 | 4781 | 984 | 327 | 1309 | 1.10E-133 | [acc:c69806] [pn:conserved hypothetical protein yfjn] [gn:yfjn] [or:*bacillus subtilis*] [db:pir] |
| 23550280_c2_92 | 1128 | 4782 | 228 | 75 | 60 | 0.03 | [ln:ggcor3gen] [ac:x947431] [pn:olfactory receptor 3] [gn:cor3] [or:*gallus gallus*] [sr:chicken] |
| 23553177_c3_292 | 1129 | 4783 | 231 | 76 | 57 | 0.068 | [db:genpept-vrt] [de:*g.gallus* cor3 dna for olfactory receptor 3,] [le:1] [re:acc:q09787] [gn:spac13g6.09] [or:*schizosaccharomyces pombe*] [sr:fission yeast] [de:hypothetical 31.1 kd protein c13g6.09 in chromosome i] [sp:q09787] [db:swissprot] |
| 23554817_c3_25 | 1130 | 4784 | 375 | 124 | 57 | 0.53 | [acc:o09392] [pn:fms protein] [cl:macrophage colony-stimulating factor 1 receptor:immunoglobulin homology:protein kinase homology] [or:*mus musculus*] [sr:,house mouse] [db:pir] |
| 23557812_c3_65 | 1131 | 4785 | 1239 | 412 | 87 | 0.2 | [ln:af034952] [ac:af034952] [pn:mast cell function-associated antigen] [gn:mafa] [or:homo sapiens] [sr:human] [db:genpept-pri2] [de:homo sapiens mast cell function-associated antigen (mafa) mrna,complete cds.] [nt:type ii integral membrane glycoprotein; s |
| 23569567_f3_32 | 1132 | 4786 | 210 | 69 | 68 | 0.22 | [acp:47544] [gn:mg302] [or:*mycoplasma genitalium*] [de:hypothetical protein mg302] [sp:p47544] [db:swissprot] |
| 235715_f2_2 | 1133 | 4787 | 522 | 173 | 515 | 1.60E-49 | [acc:q00990] [gn:rplm] [or:*staphylococcus carnosus*] [de:50s ribosomal protein 113] [sp:q00990] [db:swissprot] |
| 23571941_f3_25 | 1134 | 4788 | 1128 | 375 | 207 | 2.40E-15 | [acc:c69901] [pn:two-component sensor histidine kinase [yoc homolog yocf] [gn:yocf] [or:*bacillus subtilis*] [db:pir] |
| 23572187_c3_153 | 1135 | 4789 | 3174 | 1057 | 519 | 1.80E-46 | [ln:af011378] [ac:af011378] [pn:unknown] [or:bacteriophage sk1] [db:genpept-phg] [de:bacteriophage sk1 complete genome.] [nt:orf14] [le:8582] [re:11581] [di:direct] |
| 23572282_f1_13 | 1136 | 4790 | 702 | 233 | 353 | 2.30E-32 | [acs:74821] [pn:hypothetical protein slr1742] [or:synechocystis sp.] [sr:pcc 6803, , pcc 6803] [sr:pcc 6803,] [db:pir] |
| 23573817_f3_12 | 1137 | 4791 | 591 | 196 | 79 | 0.0066 | [ln:ttphestfo] [ac:y15464] [pn:unknown] [gn:orf5] [or:*thermus thermophilus*] [db:genpept-bct] [de:*thermus thermophilus* phes. phet genes and 5 orfs.] [le:7297] [re: |
| 23594018_c1_127 | 1138 | 4792 | 348 | 115 | 173 | 2.70E-13 | [acp:54510] [gn:yqh1] [or:*bacillus subtilis*] [de:hypothetical 14.6 kd protein ingevt-spoiiiaa intergenic region] [sp:p54510] [db:swissprot] |
| 23594180_f2_6 | 1139 | 4793 | 765 | 254 | 414 | 7.80E-39 | [acc:q57855] [gn:mj0412] [or:*methanococcus jannaschii*] [de:hypothetical abc transporter atp-binding protein mj0412] [sp:q57855] [db:swissprot] |
| 23594702_f3_20 | 1140 | 4794 | 381 | 126 | 233 | 1.20E-19 | [ach:70010] [pn:polyribonucleotide nucleotidyltransferase homolog yugi] [gn:yugi] [or:*bacillus subtilis*] [db:pir] |
| 23598577_f3_19 | 1141 | 4795 | 765 | 254 | 593 | 8.40E-58 | [ach:70023] [pn:n-acetyl-glucosamine catabolism homolog yutf] [gn:yutf] [or:*bacillus subtilis*] [db:pir] |
| 23600282_f2_7 | 1142 | 4796 | 984 | 327 | 676 | 1.40E-66 | [acc:c65008] [pn:hypothetical protein b2351] [or:*escherichia coli*] [db:pir] |

TABLE 2-continued

| Orf | NT Seq ID | AA Seq ID | NT Orf length | AA Orf length | Score | Probability | Description |
|---|---|---|---|---|---|---|---|
| 23600910_c2_22 | 1143 | 4797 | 1458 | 485 | 1668 | 1.00E-171 | [ac:p24240:q59375:p78104] [gn:ascb] [or:escherichia coli] [ec:3.2.1.86] [de:6-phospho-beta-glucosidase ascb,] [sp:p24240:q59375:p78104] [db:swissprot] |
| 23603327_c3_76 | 1144 | 4798 | 2043 | 680 | 302 | 9.10E-36 | [ac:b70001] [pn:abc transporter (permease) homolog ytsd] [gn:ytsd] [or:bacillus subtilis] [db:pir] |
| 23603461_c2_59 | 1145 | 4799 | 876 | 291 | 687 | 9.20E-68 | [ac:p37544] [gn:yabc] [or:bacillus subtilis] [de:hypothetical 33.0 kd protein in xpac-abrb intergenic region] [sp:p37544] [db:swissprot] |
| 23604837_c1_58 | 1146 | 4800 | 474 | 157 | 84 | 0.2 | [ln:bhu52041] [ac:u52041] [pn:variable major protein 23] [gn:vmp23] [or:borrelia hermsii] [sr:borrelia hermsii strain=hs1; accc 35209] [db:genpept-bct] [de:borrelia hermsii variable major protein 23 (vmp23) gene, completecds.] [nt:vmp23; outer membrane li |
| 23609711_c1_42 | 1147 | 4801 | 183 | 60 | 46 | 0.27 | [ac:p18975] [or:panthera leo] [sr:,lion] [de:hemoglobin alpha chain] [sp:p18975] [db:swissprot] |
| 23614665_c3_66 | 1148 | 4802 | 267 | 88 | 75 | 0.0066 | [ln:ae001124] [ac:ac001124:ac000783] [pn:b. burgdorferi predicted coding region bb0124] [gn:bb0124] [or:borrelia burgdorferi] [sr:lyme disease spirochete] [db:genpept-bct] [de:borrelia burgdorferi (section 10 of 70) of the complete genome.] [nt:hypothetic |
| 23617015_f2_29 | 1149 | 4803 | 477 | 158 | 479 | 1.00E-45 | [ac:d69989] [pn:hypothetical protein ytcg] [gn:ytcg] [or:bacillus subtilis] [db:pir] |
| 23619083_c1_13 | 1150 | 4804 | 252 | 83 | 70 | 0.017 | [ln:stsipstp] [ac:x92546] [gn:sipa] [or:salmonella typhi] [db:genpept-bct] [de:s.typhi sipa, sipf, and stpa genes.] [le:<1] [re:1353] [di:direct] |
| 23620262_c1_19 | 1151 | 4805 | 828 | 275 | 590 | 1.80E-57 | [ac:p39345] [gn:yjgu] [or:escherichia coli] [ec:1.-.-.-] [de:(ec 1.-.-.-)] [sp:p39345] [db:swissprot] |
| 23625127_f2_5 23625427_f1_20 | 1152 1153 | 4806 4807 | 252 1149 | 83 382 | 64 1333 | 0.092 3.20E-136 | [ac:c64671] [pn:hypothetical protein hp1211] [or:helicobacter pylori] [db:pir] [ac:q00752] [gn:msmk] [or:streptococcus mutans] [de:multiple sugar-binding transport atp-binding protein msmk] [sp:q00752] [db:swissprot] |
| 23625437_c1_8 | 1154 | 4808 | 444 | 147 | 79 | 0.32 | [ac:o11453] [gn:4cl] [or:african swine fever virus] [sr:,isolate malawi lil 20/1;asfv] [de:iap-like protein] [sp:o11453] [db:swissprot] |
| 23625625_c1_81 | 1155 | 4809 | 1848 | 615 | 1129 | 6.40E-125 | [ac:p39263:p76493:p77678] [gn:yfcc] [or:escherichia coli] [de:hypothetical 54.8 kd protein in pta-folx intergenic region] [sp:p39263:p76493:p77678] [db:swissprot] |
| 23626253_f1_3 | 1156 | 4810 | 2922 | 973 | 3427 | 0 | [ln:d83706] [ac:d83706] [pn:pyruvate carboxylase] [or:bacillus stearothermophilus] [sr:bacillus stearothermophilus (strain:k1041) dna] [db:genpept-bct] [ec:6.4.1.1] [de:bacillus stearothermophilus dna for pyruvate carboxylase, completecds.] [le:92] [re:35 |
| 23626552_f3_21 | 1157 | 4811 | 267 | 88 | 65 | 0.38 | [ac:q58873] [gn:mj1478] [or:methanococcus jannaschii] [de:hypothetical protein mj1478] [sp:q58873] [db:swissprot] |

TABLE 2-continued

| Orf | NT Seq ID | AA Seq ID | NT Orf length | AA Orf length | Score | Probability | Description |
|---|---|---|---|---|---|---|---|
| 23627182_c3_22 | 1158 | 4812 | 183 | 60 | 76 | 0.054 | [ac:s10439] [pn:dna-directed rna polymerase, beta chain] [gn:rpoc] [or:*plasmodium falciparum*] [ec:2.7.7.6] [db:pir] |
| 23628400_f1_2 | 1159 | 4813 | 207 | 68 | 60 | 0.42 | [ac:p16427] [gn:hyca:heva] [or:*escherichia coli*] [de:formate hydrogenlyase regulatory protein hyca] [sp:p16427] [db:swissprot] |
| 23628432_c2_4 | 1160 | 4814 | 189 | 62 | 69 | 0.15 | [ln:af007568] [ac:af007568] [pn:replication initiator protein] [gn:repa] [or:*erwinia stewartii*] [db:genpept-bct] [de:*erwinia stewartii* plasmid psw 1200 replication initiator protein(repa) gene, complete cds.] [le:1639] [re:2475] [di:direct] |
| 23628432_c2_56 | 1161 | 4815 | 189 | 62 | 70 | 0.12 | [ln:af007568] [ac:af007568] [pn:replication initiator protein] [gn:repa] [or:*erwinia stewartii*] [db:genpept-bct] [de:*erwinia stewartii* plasmid psw 1200 replication initiator protein(repa) gene, complete cds.] [le:1639] [re:2475] [di:direct] |
| 23629677_f1_4 | 1162 | 4816 | 1296 | 431 | 206 | 3.50E-16 | [ac:c69789] [pn:hypothetical protein ydji] [gn:ydji] [or:*bacillus subtilis*] [db:pir] |
| 23632211_f3_41 | 1163 | 4817 | 705 | 234 | 508 | 8.60E-49 | [ac:p54176] [or:*bacillus cereus*] [de:hemolysin iii (hly-iii)] [sp:p54176] [db:swissprot] |
| 23632751_c1_135 | 1164 | 4818 | 195 | 64 | 47 | 0.39 | [ac:p19541] [gn:yp1133c|pi12c] [or:*saccharomyces cerevisiae*] [sr:,baker's yeast] [de:region] [sp:p19541] [db:swissprot] |
| 23633250_c3_68 | 1165 | 4819 | 426 | 141 | 155 | 2.20E-11 | [ac:p26379] [gn:levd:sacl] [or:*bacillus subtilis*] [ec:2.7.1.69] [de:(ec 2.7.1.69) (p16) (sp:p26379] [db:swissprot] |
| 23633563_c2_11 | 1166 | 4820 | 249 | 82 | 273 | 6.90E-24 | [ac:p10806] [gn:rpsi] [or:*bacillus stearothermophilus*] [de:30s ribosomal protein s18 (bs21)] [sp:p10806] [db:swissprot] |
| 23633588_c2_153 | 1167 | 4821 | 861 | 286 | 472 | 5.60E-45 | [ac:h69299] [pn:nadh oxidase (noxa-3) homolog] [or:*archaeoglobus fulgidus*] [db:pir] |
| 23634628_c2_17 | 1168 | 4822 | 1584 | 527 | 1261 | 1.40E-128 | [ac:p39883] [gn:prfe] [or:*bacteroides nodosus*] [sr:*dichelobacter nodosus*] [de:peptide chain release factor 3 (rf-3)] [sp:p39883] [db:swissprot] |
| 23634637_c3_82 | 1169 | 4823 | 978 | 325 | 975 | 2.80E-98 | [ac:q01609] [or:*pseudomonas aeruginosa*] [de:hypothetical 40.7 kd protein in opde 3'region (orf2)] [sp:q01609] [db:swissprot] |
| 23634637_f2_17 | 1170 | 4824 | 264 | 87 | 78 | 0.059 | [ln:ceelw01a11] [ac:u64852] [gn:w01a11.5] [or:*caenorhabditis elegans*] [sr:*caenorhabditis elegans* strain=bristol n2] [db:genpept-inv] [de:*caenorhabditis elegans* cosmid w01a11.] |
| 23634662_c2_31 | 1171 | 4825 | 1362 | 453 | 933 | 7.90E-94 | [nt:coded for by *c. elegans* cdna yk49c1.5; coded for by] [le:17224:17633:17869] [ac:q08432] [gn:patb] [or:*bacillus subtilis*] [ec:2.6.1.—] [de:putative aminotransferase b,] [sp:q08432] [db:swissprot] |
| 23634677_c3_81 | 1172 | 4826 | 678 | 225 | 93 | 0.024 | [ac:s32215] [pn:hypothetical protein 1] [or:*bacillus megaterium*] [db:pir] |
| 23635452_c1_99 | 1173 | 4827 | 354 | 117 | 80 | 0.11 | [ac:q00123] [gn:24] [or:ictalurid herpesvirus 1] [sr:,channel catfish virus:ccv] [de:hypothetical gene 24 protein] [sp:q00123] [db:swissprot] |

TABLE 2-continued

| Orf | NT Seq ID | AA Seq ID | NT Orf length | AA Orf length | Score | Probability | Description |
|---|---|---|---|---|---|---|---|
| 23636088_f2_13 | 1174 | 4828 | 717 | 238 | 128 | 4.70E-10 | [ac:s67185:s72052] [pn:hypothetical protein yor283w:hypothetical protein o5480] [or:saccharomyces cerevisiae] [db:pir] [mp:15r] |
| 23636587_c2_64 | 1175 | 4829 | 366 | 121 | 61 | 0.95 | [ln:af007261] [ac:af007261] [pn:ribosomal protein 118] [gn:rp118] [or:mitochondrion reclinomonas americana] [sr:reclinomonas americana] [db:genpept-inv] [de:reclinomonas americana mitochondrial dna, complete genome.] [le:27672] [re:27962] [di:direct] |
| 23642962_c2_65 | 1176 | 4830 | 618 | 205 | 375 | 1.10E-34 | [ac:d64866] [pn:hypothetical protein b1199] [or:escherichia coli] [db:pir] |
| 23644077_c1_101 | 1177 | 4831 | 2292 | 763 | 111 | 0.0091 | [ln:af02131] [ac:af002131] [pn:oscillin] [or:phormidium uncinatum] [db:genpept-bct] [de:phormidium uncinatum oscillin gene, complete cds.] [nt:cell surface protein; structural protein; contains] [le:133] [re:2073] [di:direct] |
| 23647003_c2_106 | 1178 | 4832 | 345 | 114 | 64 | 0.092 | [ln:ae001153] [ac:ae001153:ae000783] [pn:b. burgdorferi predicted coding region bb0510] [gn:bb0510] [or:borrelia burgdorferi] [sr:lyme disease spirochete] [db:genpept-bct] [de:borrelia burgdorferi (section 39 of 70) of the complete genome.] [nt:hypothetic |
| 23647500_f1_10 | 1179 | 4833 | 315 | 104 | 71 | 0.099 | [ac:b64493] [pn:hypothetical protein mj1547] [or:methanococcus jannaschii] [db:pir] [mp:for1525642–1526010] |
| 23647913_f3_5 | 1180 | 4834 | 195 | 64 | 150 | 7.40E-11 | [ac:q45399] [gn:cela] [or:bacillus stearothermophilus] [ec:2.7.1.69] [de:(ec 2.7.1.69)] [sp:q45399] [db:swissprot] |
| 23648437_c1_182 | 1181 | 4835 | 426 | 141 | 63 | 0.97 | [ac:i52722] [pn:gene teta protein] [gn:teta] [or:homo sapiens] [sr:, man] [db:pir] [mp:3p21—3p21] |
| 23650256_c3_44 | 1182 | 4836 | 450 | 149 | 748 | 3.20E-74 | [ac:q47748] [gn:vanhb] [or:enterococcus faecalis] [sr:streptococcus faecalis] [ec:1.1.1.—] [de:b-type resistance protein vanhb] [sp:q47748] [db:swissprot] |
| 23650402_c3_64 | 1183 | 4837 | 789 | 262 | 764 | 6.40E-76 | [ln:bacpk] [ac:d13095] [pn:undefined open reading frame] [or:bacillus stearothermophilus] [sr:bacillus stearothermophilus (strain:nca1503) dna] [db:genpept-bct] [de:b.stearothermophilus phosphofructokinase and pyruvate kinasegenes.] [le:<1] [re:963] [di:direct] |
| 23671875_c3_76 | 1184 | 4838 | 204 | 67 | 65 | 0.59 | [ac:z99258] [pn:molybdopterin biosynthesis] [gn:spac1a6.10] [or:schizosaccharomyces pombe] [sr:fission yeast] [db:genpept-pln] [de:s.pombe chromosome i cosmid c1a6.] [nt:spac1a6.10, probable molybdopterin biosynthesis] [le:22528] [re:23985] |
| 23673136_c2_39 | 1185 | 4839 | 735 | 244 | 794 | 4.20E-79 | [ln:llu80410] [ac:u80410] [pn:purine nucleoside phosphorylase] [gn:deod] [or:lactococcus lactis cremoris] [db:genpept-bct] [de:lactococcus lactis cremoris phosphopentomutase (deob) and purinenucleoside phosphorylase (deod) genes, complete cds.] [nt:deod; |
| 23676713_c2_41 | 1186 | 4840 | 1179 | 392 | 1216 | 8.10E-124 | [ac:p31104] [gn:arof] [or:bacillus subtilis] [ec:4.6.1.4] [de:phospholyase)] [sp:p31104] [db:swissprot] |
| 23678437_c1_41 | 1187 | 4841 | 921 | 306 | 467 | 1.90E-44 | [ac:a69878] [pn:conserved hypothetical protein yloc] [gn:yloc] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 23679627__c2__131 | 1188 | 4842 | 690 | 229 | 86 | 0.31 | [ac:s48110] [pn:neurotoxin type f] [cl:tetanus toxin] [or:*clostridium botulinum*] [db:pir] |
| 23682965__c2__61 | 1189 | 4843 | 474 | 157 | 433 | 7.60E-41 | [ac:g69633] [pn:glutamine abc transporter (atp-binding protein) glnq] [gn:glnq] [or:*bacillus subtilis*] [db:pir] |
| 23703467__c3__12 | 1190 | 4844 | 990 | 329 | 647 | 1.60E-63 | [ac:c69670] [pn:glycine betaine/carnitine/choline abc transporter (atp-bindin) opuca] [gn:opuca] [or:*bacillus subtilis*] [db:pir] |
| 23703840__c1__65 | 1191 | 4845 | 1029 | 342 | 314 | 3.10E-28 | [ln:lllpk214] [ac:x92946:y10522] [pn:hypothetical protein] [gn:orf6] [or:*lactococcus lactis*] [db:genpept-bct] [de:*lactobacillus lactis* plasmid pk214, complete sequence.] [le:2610] [re:3554] [di:direct] |
| 23704637__c3__55 | 1192 | 4846 | 726 | 241 | 488 | 1.10E-46 | [ac:q06239] [gn:vanr] [or:*enterococcus faecium*] [sr:,*streptococcus faecium*] [de:regulatory protein vanr] [sp:q06239] [db:swissprot] |
| 23706936__c3__23 | 1193 | 4847 | 393 | 130 | 126 | 2.60E-08 | [ac:q00561] [gn:lcia] [or:*lactococcus lactis*:*lactococcus lactis*] [sr:,subsplactis:*streptococcus lactis*:subspcremoris:*streptococcus cremoris*] [de:lactococcin a immunity protein] [sp:q00561] [db:swissprot] |
| 23707580__c3__45 | 1194 | 4848 | 1335 | 444 | 106 | 0.0077 | [ln:llu93364] [ac:u93364] [pn:epsi] [gn:epsi] [or:*lactococcus lactis cremoris*] [db:genpept-bct] [de:*lactococcus lactis cremoris* plasmid pnz4000 insertion sequenceis982 putative transposase gene and eps gene cluster(epsrxabcdefghijkl), complete cds.] [nt:s |
| 23710762__f3__36 | 1195 | 4849 | 843 | 280 | 196 | 9.90E-16 | [ac:h56273] [pn:sakacin a production response regulator sapr] [gn:sapr] [or:*lactobacillus sake*] [db:pir] |
| 23711465__f1__2 | 1196 | 4850 | 501 | 166 | 196 | 9.90E-16 | [ac:a53641] [pn:arsenate reductase,] [cl:protein-tyrosine-phosphatase, low molecular weight] [or:*staphylococcus aureus*] [ec:1.—.—.—] [db:pir] |
| 23712812__f1__7 | 1197 | 4851 | 1155 | 384 | 1261 | 1.40E-128 | [ac:p11549] [gn:fuco] [or:*escherichia coli*] [ec:1.1.1.77] [de:lactaldehyde reductase, (propanediol oxidoreductase)] [sp:p11549] [db:swissprot] |
| 23714562__f3__43 | 1198 | 4852 | 1452 | 483 | 1348 | 8.30E-138 | [ac:c69852] [pn:glucuronate isomerase homolog yjma] [gn:yjma] [or:*bacillus subtilis*] [db:pir] |
| 23723842__f1__5 | 1199 | 4853 | 252 | 83 | 60 | 0.23 | [ln:mmbg13] [ac:v00724] [or:mus musculus] [sr:house mouse] [db:genpept-rod] [de:fragment from the mouse gene for beta-globin h1 (codes for part ofexon 2).] [nt:second exon] [le:<1] [re:138] [di:direct] |
| 23723842__f2__6 | 1200 | 4854 | 252 | 83 | 60 | 0.23 | [ln:mmbg13] [ac:v00724] [or:mus musculus] [sr:house mouse] [db:genpept-rod] [de:fragment from the mouse gene for beta-globin h1 (codes for part ofexon 2).] [nt:second exon] [le:<1] [re:138] [di:direct] |
| 23726062__c2__55 | 1201 | 4855 | 582 | 193 | 727 | 5.30E-72 | [ac:a69584] [pn:alanyl-trna synthetase alas] [gn:alas] [or:*bacillus subtilis*] [db:pir] |

TABLE 2-continued

| Orf | NT Seq ID | AA Seq ID | NT Orf length | AA Orf length | Score | Probability | Description |
|---|---|---|---|---|---|---|---|
| 23726687_f1_3 | 1202 | 4856 | 786 | 261 | 513 | 2.50E-49 | [ac:p42599:p42600:p76661] [gn:ygjr] [or:escherichia coli] [de:hypothetical 37.0 kd protein in ebgc-uxaa intergenic region] [sp:p42599:p42600:p76661] [db:swissprot] |
| 23727313_f1_2 | 1203 | 4857 | 426 | 141 | 532 | 2.50E-51 | [ln:bacrplp] [ac:147971] [pn:ribosomal protein s8] [gn:rpsh] [or:bacillus subtilis] [db:genpept-bct] [de:bacillus subtilis ribosomal protein (rplpnxefrog, rpmedj,rpsqnhemk) genes, integral membrane protein (secy) gene, adenylatekinase (adk) gene, methioni |
| 2375253_c1_46 | 1204 | 4858 | 1629 | 542 | 1226 | 7.10E-125 | [ac:a69584] [pn:alanyl-trna synthetase alas] [gn:alas] [or:bacillus subtilis] [db:pir] |
| 23781881_c1_18 | 1205 | 4859 | 333 | 110 | 51 | 0.94 | [ac:s58141] [pn:gene 12 protein] [or:phage spp1] [db:pir] |
| 2381306_f2_7 | 1206 | 4860 | 1365 | 454 | 758 | 2.80E-75 | [ln:bcu44828] [ac:u44828] [pn:transposase] [or:burkholderia cepacia] [db:genpept-bct] [de:burkholderia cepacia is402/is1356 hybrid insertion sequencetransposase gene, complete cds.] [le:243] [re:1502] [di:direct] |
| 2381931_f1_3 | 1207 | 4861 | 486 | 161 | 163 | 2.00E-11 | [ln:mty21c12] [ac:z95210] [pn:unknown] [gn:mtcy21c12.14c] [or:mycobacterium tuberculosis] [db:genpept-bct] [de:mycobacterium tuberculosis cosmid scy21c12.] [nt:mtcy21c12.14c. len: 439, function: probable] [le:14996] [re:16315] [di:complement] |
| 23828755_f1_3 | 1208 | 4862 | 279 | 92 | 54 | 0.67 | [ac:g64561] [pn:hypothetical protein hp0335] [or:helicobacter pylori] [db:pir] |
| 23828937_f2_100 | 1209 | 4863 | 243 | 80 | 69 | 0.59 | [ac:a45226] [pn:integrin alpha 1 subunit] [cl:von willebrand factor type a repeat homology] [or:homo sapiens] [sr:, man] [db:pir] |
| 23829635_c1_30 | 1210 | 4864 | 2835 | 944 | 736 | 1.10E-76 | [ac:p54394] [gn:cding] [or:bacillus subtilis] [de:probable atp-dependent helicase ding homolog] [sp:p54394] [db:swissprot] |
| 23829657_f3_28 | 1211 | 4865 | 1659 | 552 | 695 | 1.30E-68 | [ac:p48843] [or:bacillus circulans] [de:hypothetical protein in bgab 5'region (orf1) (fragment)] [sp:p48843] [db:swissprot] |
| 23829825_c3_36 | 1212 | 4866 | 870 | 289 | 176 | 8.20E-12 | [ac:h70089] [pn:hypothetical protein yyci] [gn:yyci] [or:bacillus subtilis] [db:pir] |
| 23831408_f2_15 | 1213 | 4867 | 207 | 68 | 103 | 6.00E-05 | [ln:efu63997] [ac:u63997] [or:enterococcus faecium] [db:genpept-bct] [de:enterococcus faecium insertion sequence is1476 putative transposasegene, complete cds.] [nt:putative transposase] [le:140] [re:1414] [di:direct] |
| 23832537_c3_84 | 1214 | 4868 | 1449 | 482 | 382 | 1.90E-35 | [ac:p39183:p76131:p77384] [gn:xasa:acsa:gade] [or:escherichia coli] [de:amino acid antiporter (extreme acid sensitivity protein)] [sp:p39183:p76131:p77384] [db:swissprot] |
| 23832808_c3_78 | 1215 | 4869 | 189 | 62 | 58 | 0.52 | [ln:af032701] [ac:af032701] [pn:nbs-lrr type resistance protein] [gn:r14] [or:oryza sativa] [sr:rice] [db:genpept-pln] [de:oryza sativa nbs-lrr type resistance protein (r14) gene, partialcds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 23834431_c2_172 | 1216 | 4870 | 240 | 79 | 58 | 0.34 | [ln:mhu02538] [acc:u02538] [pn:multidrug resistance protein homolog] [or:mycoplasma hyopneumoniae] [db:genpept-bct] [de:mycoplasma hyopneumoniae j atcc 25934 23s rrna gene, partialsequence.] [le:1545] [re: |
| 23835902_f3_18 | 1217 | 4871 | 390 | 129 | 618 | 1.90E-60 | [ln:sau83488] [acc:u83488] [pn:resolvase] [gn:resip] [or:streptococcus agalactiae] [db:genpept-bct] [de:streptococcus agalactiae plasmid pgb354, complete plasmid sequence.] [le:2026] [re:2643] [di:direct] |
| 23836527_c3_36 | 1218 | 4872 | 309 | 102 | 51 | 0.9 | [acc:p52628] [gn:fliz] [or:salmonella typhimurium] [de:fliz protein (fragment)] [sp:p52628] [db:swissprot] |
| 23837952_f2_13 | 1219 | 4873 | 204 | 67 | 62 | 0.53 | [acc:p38459] [gn:ymfl6] [or:marchantia polymorpha] [sr:liverwort] [de:(orf244)] [sp:p38459] [db:swissprot] |
| 23837957_c1_38 | 1220 | 4874 | 246 | 81 | 59 | 0.93 | [acc:p16440:p17619] [gn:rib:ribb] [or:bacillus subtilis] [ec:2.5.1.9] [de:riboflavin synthase alpha chain.] [sp:p16440:p17619] [db:swissprot] |
| 23850802_f2_2 | 1221 | 4875 | 216 | 71 | 79 | 0.013 | [acc:p46571] [gn:srg-2:c18f10.5] [or:caenorhabditis elegans] [de:srg-2 protein] [sp:p46571] [db:swissprot] |
| 23850802_f3_38 | 1222 | 4876 | 216 | 71 | 79 | 0.013 | [acc:p46571] [gn:srg-2:c18f10.5] [or:caenorhabditis elegans] [de:srg-2 protein] [sp:p46571] [db:swissprot] |
| 23855931_c3_51 | 1223 | 4877 | 375 | 124 | 336 | 1.40E-30 | [acc:s67490] [pn:single-stranded dna-binding protein] [cl:single-stranded dna-binding protein homology] [or:eubacterium sp.] [db:pir] |
| 23859827_f2_6 | 1224 | 4878 | 687 | 228 | 256 | 4.30E-22 | [acc:p77577] [gn:ydfh] [or:escherichia coli] [de:hypothetical transcriptional regulator in dep-noha intergenic region] [sp:p77577] [db:swissprot] |
| 23860790_c2_19 | 1225 | 4879 | 669 | 222 | 536 | 9.30E-52 | [acc:69981] [pn:nifs protein homolog yrvo] [gn:yrvo] [or:bacillus subtilis] [db:pir] |
| 23865875_c1_52 | 1226 | 4880 | 201 | 66 | 151 | 5.80E-11 | [ln:cpcpeaa] [acc:x71844] [pn:putative transposase] [or:clostridium perfringens uapc, cpe, and nade genes.] [bct] [de:c.perfringens uapc, cpe, and nade genes.] [le:2477] [re:2932] [di:direct] |
| 23866312_c1_8 | 1227 | 4881 | 219 | 72 | 64 | 0.092 | [ln:ab001684] [acc:ab001684] [gn:trnv] [or:chloroplast chlorella vulgaris] [sr:chlorella vulgaris chloroplast dna] [db:genpept-pln] [de:chlorella vulgaris c-27 chloroplast dna, complete sequence.] [nt:orf67] [le:53481] [re:53684] [di:direct] |
| 23866453_f3_33 | 1228 | 4882 | 186 | 61 | 59 | 0.28 | [ln:hiv1u13456] [acc:u13456] [pn:envelope glycoprotein v1v2 region] [gn:env] [or:human immunodeficiency virus type 1] [de:human immunodeficiency virus type 1 isolate 024 from rwanda,envelope glycoprotein (env) gene, v1v2 region, partial cd |
| 23867311_c1_32 | 1229 | 4883 | 258 | 85 | 135 | 2.90E-09 | [acc:q01620] [gn:jag] [or:bacillus subtilis] [de:jag protein (spoiij associated protein)] [sp:q01620] [db:swissprot] |

TABLE 2-continued

| Orf | NT Seq ID | AA Seq ID | NT Orf length | AA Orf length | Score | Probability | Description |
|---|---|---|---|---|---|---|---|
| 23867963_c1_40 | 1230 | 4884 | 390 | 129 | 74 | 0.38 | [ac:p19412] [gn:baie] [or:eubacterium sp] [sr:vpi 12708,] [de:bile acid-inducible operon protein c] [sp:p19412] [db:swissprot] |
| 23869582_c2_34 | 1231 | 4885 | 864 | 287 | 1433 | 8.20E-147 | [ac:q47745] [gn:vansb] [or:enterococcus faecalis] [sr:,streptococcus faecalis] [ec:2.7.3.—] [de:protein vansb) (vancomycin histidine protein kinase)] [sp:q47745] [db:swissprot] |
| 23869763_c3_23 | 1232 | 4886 | 1002 | 333 | 505 | 4.00E-47 | [ac:p13267] [gn:polc:dnac:dnaf:muti] [or:bacillus subtilis] [ec:2.7.1.7] [de:dna polymerase iii, alpha chain,] [sp:p13267] [db:swissprot] |
| 23869828_f2_52 | 1233 | 4887 | 189 | 62 | 47 | 0.22 | [ln:cef32d8] [ac:z74031] [pn:f32d8.10] [or:caenorhabditis elegans] [db:genpept-inv] [de:caenorhabditis elegans cosmid f32d8, complete sequence.] [nt:protein predicted using genefinder; weak similarity] [le:35836:36179:36361] [re:35975:36309:36725] [di:com |
| 23870277_c1_12 | 1234 | 4888 | 192 | 63 | 46 | 0.087 | [ln:af023998] [ac:af023998] [pn:gag protein] [gn:gag] [or:human immunodeficiency virus type 1] [db:genpept-vr1] [de:hiv-1 patient 3 clone pobv75_25 from the usa, gag protein p7,p1,p6region (gag) gene, partial cds.] [nt:p7,p1,p6 region] [le:<1] [re: |
| 23875301_f3_17 | 1235 | 4889 | 312 | 103 | 79 | 0.0025 | [ln:xeexbtonb] [ac:z95386] [gn:exbd2] [or:xanthomonas campestris] [db:genpept-bct] [de:x.campestris exbd1, exbd2, exbb and tonb genes.] [le:1141] [re:1551] [di:complement] |
| 23883327_c1_97 | 1236 | 4890 | 594 | 197 | 79 | 0.058 | [ac:jn0731:s21430] [pn:hypothetical 14.2k protein:hypothetical protein 43] [or:phage spp1] [db:pir] |
| 23884838_f1_4 | 1237 | 4891 | 438 | 145 | 701 | 3.00E-69 | [ac:p23494] [gn:laca] [or:lactococcus lactis] [sr:,subsp:lactis:streptococcus lactis] [ec:5.—.—.—] [de:galactose-6-phosphate isomerase laca subunit,] [sp:p23494] [db:swissprot] |
| 239057_c1_76 | 1238 | 4892 | 252 | 83 | 67 | 0.47 | [ac:s65231:s69218:s69220] [pn:trna-pseudouridine synthase i, pus1:protein p1805:protein yp1212c] [gn:pus1] [or:saccharomyces cerevisiae] [ec:5.4.99.12] [db:pir] [mp:161] |
| 23907507_f3_27 | 1239 | 4893 | 804 | 267 | 305 | 2.80E-27 | [ac:o69862] [pn:conserved hypothetical protein ykra] [gn:ykra] [or:bacillus subtilis] [db:pir] |
| 23907632_c2_257 | 1240 | 4894 | 1260 | 419 | 213 | 8.50E-15 | [ln:mtcy349] [ac:z83018] [pn:unknown] [gn:mtcy349.30] [or:mycobacterium tuberculosis] [db:genpept-bct] [de:mycobacterium tuberculosis cosmid y349,] [nt:mtcy349.30, len: 428 aa, unknown, near identity] [le:32094] [re:33380] [di:direct] |
| 23913568_f3_26 | 1241 | 4895 | 870 | 289 | 540 | 3.50E-52 | [ac:o07639] [gn:ylao] [or:bacillus subtilis] [de:hypothetical 43.7 kd protein in npre-pyca intergenic region] [sp:o07639] [db:swissprot] |
| 23922912_f1_13 | 1242 | 4896 | 1056 | 351 | 893 | 1.40E-89 | [ac:p77615] [gn:ycjw] [or:escherichia coli] [de:hypothetical transcriptional regulator in ompg-tyrr intergenic region] [sp:p77615] [db:swissprot] |

TABLE 2-continued

| Orf | NT Seq ID | AA Seq ID | NT Orf length | AA Orf length | Score | Probability | Description |
|---|---|---|---|---|---|---|---|
| 23928337_c3_168 | 1243 | 4897 | 1860 | 619 | 847 | 2.00E-117 | [ac:p18158] [gn:glpd] [or:bacillus subtilis] [ec:1.1.99.5] [de:aerobic glycerol-3-phosphate dehydrogenase,] [sp:p18158] [db:swissprot] |
| 23931503_f2_3 | 1244 | 4898 | 192 | 63 | 127 | 1.80E-07 | [ln:llu74322] [ac:u74322] [pn:6-phosphogluconate dehydrogenase] [or:lactococcus lactis] [db:genpept-bct] [ec:1.1.1.44] [de:lactococcus lactis 6-phosphogluconate dehydrogenase gene, completeecds, and potassium transporter homolog gene, partial cds.] [le:898 |
| 239375_c1_131 | 1245 | 4899 | 402 | 133 | 81 | 0.37 | [ln:ac00159] [ac:ac00159:ac000783] [pn:ctp synthase (pyrg)] [gn:bb0575] [or:borrelia burgdorferi] [sr:lyme disease spirochete] [db:genpept-bct] [de:borrelia burgdorferi (section 45 of 70) of the complete genome.] [nt:similar to gb:l77117 sp:q58574 pid:1 |
| 23937825_f3_15 | 1246 | 4900 | 978 | 325 | 106 | 0.0027 | [ac:p48278] [gn:ycf38] [or:cyanophora paradoxa] [de:hypothetical 33.3 kd protein ycf38] [sp:p48278] [db:swissprot] |
| 23938376_c2_47 | 1247 | 4901 | 390 | 129 | 144 | 6.90E-10 | [ac:p14184] [gn:licd] [or:haemophilus influenzae] [de:licd protein] [sp:p14184] [db:swissprot] |
| 23947182_f2_27 | 1248 | 4902 | 1956 | 651 | 104 | 0.018 | [ln:hpu12689] [ac:u12689] [or:helicobacter pylori] [db:genpept-bct] [de:helicobacter pylori plasmid phpm 180, complete sequence.] [nt:orf1; putative 54,517 kda protein; transcription of] [le:2871:1] [re:3506:756] [di:direction] |
| 23953405_c2_32 | 1249 | 4903 | 222 | 73 | 61 | 0.18 | [ln:yscura3p] [ac:m12926] [or:saccharomyces cerevisiae] [sr:yeast (s.cerevisiae) dna, clone phd6] [db:genpept-pln] [de:yeast (s.cerevisiae) ura3 gene encoding omp decarboxylase, promoteregion.] [nt:omp decarboxylase (ec 4.1.1.23)] [le:227] [re: |
| 23953505_c3_60 | 1250 | 4904 | 1020 | 339 | 680 | 5.10E-67 | [ac:p49936] [gn:fhub] [or:bacillus subtilis] [de:ferrichrome transport permease protein fhub] [sp:p49936] [db:swissprot] |
| 23954437_c2_80 | 1251 | 4905 | 882 | 293 | 433 | 7.60E-41 | [ac:p39610] [gn:thid:ipa-52r] [or:bacillus subtilis] [ec:2.7.4.7] [de:(hmp-p kinase)] [sp:p39610] [db:swissprot] |
| 23955443_f3_30 | 1252 | 4906 | 456 | 151 | 597 | 3.20E-58 | [ac:o06445] [gn:rplo] [or:staphylococcus aureus] [de:50s ribosomal protein 115] [sp:o06445] [db:swissprot] |
| 239653_f1_1 | 1253 | 4907 | 267 | 88 | 72 | 0.39 | [ln:efu91527] [ac:u91527] [pn:aggregation substance] [gn:ash701] [or:enterococcus faecium] [db:genpept-bct] [de:enterococcus faecium plasmid phkk701 aggregation substance (ash701)gene, complete cds.] [nt:putative adhesin protein] [le:1] [re:3918] [di:dire |
| 23984575_c2_43 | 1254 | 4908 | 732 | 243 | 80 | 0.62 | [ac:d69224] [pn:hypothetical protein mth929] [gn:mth929] [or:methanobacterium thermoautotrophicum] [db:pir] |

TABLE 2-continued

| Orf | NT Seq ID | AA Seq ID | NT Orf length | AA Orf length | Score | Probability | Description |
|---|---|---|---|---|---|---|---|
| 23986300_f2_20 | 1255 | 4909 | 309 | 102 | 78 | 0.0061 | [ac:p34778] [or:*astasia longa*] [sr:*euglenophycean alga*] [de:hypothetical 20.1 kd protein in trns-rp120 intergenic region (orf170)] [sp:p34778] [dbs:swissprot] |
| 23988452_f1_6 | 1256 | 4910 | 960 | 319 | 1693 | 2.30E-174 | [ln:instran] [ac:128754] [pn:transposase] [or:insertion sequence is6770] [sr:insertion sequence is6770 dna] [db:genpept-bct] [de:*enterococcus faecalis* (transposable element: is6770) transposasegene, complete cds.] [nt:putative] [le:97] [re:1056] [di:direc |
| 23988452_f3_15 | 1257 | 4911 | 231 | 76 | 328 | 1.00E-29 | [ln:instran] [ac:128754] [pn:transposase] [or:insertion sequence is6770] [sr:insertion sequence is6770 dna] [db:genpept-bct] [de:*enterococcus faecalis* (transposable element: is6770) transposasegene, complete cds.] [nt:putative] [le:97] [re:1056] [di:direc |
| 23988452_f3_6 | 1258 | 4912 | 960 | 319 | 1693 | 2.30E-174 | [ln:instran] [ac:128754] [pn:transposase] [or:insertion sequence is6770] [sr:insertion sequence is6770 dna] [db:genpept-bct] [de:*enterococcus faecalis* (transposable element: is6770) transposasegene, complete cds.] [nt:putative] [le:97] [re:1056] [di:direc |
| 23988587_c1_96 | 1259 | 4913 | 384 | 127 | 66 | 0.065 | [ln:pbu42580] [acu42580:u17055:u32570] [gn:a358r] [or:*paramecium bursaria chlorella* virus 1] [db:genpept-vr1] [de:*paramecium bursaria chlorella* virus 1, complete genome.] [le:177237] [re:177470] [di:direct] |
| 23988787_c1_16 | 1260 | 4914 | 231 | 76 | 61 | 0.077 | [ln:peapyrb2a] [ac:115798] [pn:aspartate transcarbamoylase] [gn:pyrb2] [or:*pisum sativum*] [sr:*pisum sativum* (strain wando) (library: of r.slocum in lambd dbgenpept-pln] [ec:2.1.3.2] [de:*pisum sativum* aspartate transcarbamoylase (pyrb2) mrna, completeed |
| 23399192_c1_7 | 1261 | 4915 | 639 | 212 | 335 | 1.80E-30 | [ac:p50726] [gn:ypaa] [or:*bacillus subtilis*] [de:hypothetical 20.5 kd protein in sera-fer intergenic region] [sp:p50726] [dbs:swissprot] |
| 23992067_c2_61 | 1262 | 4916 | 651 | 216 | 785 | 3.80E-78 | [ac:p37282] [gn:groel] [or:*lactococcus lactis*] [sr:subsplactis:*streptococcus lactis*] [de:60 kd chaperonin (protein cpn60) (groel protein)] [sp:p37282] [dbs:swissprot] |
| 23992257_c3_66 | 1263 | 4917 | 897 | 298 | 75 | 0.038 | [ac:p27227] [gn:e5] [or:human papillomavirus type 42] [de:probable e5 protein] [sp:p27227] [dbs:swissprot] |
| 23992838_c3_62 | 1264 | 4918 | 1194 | 397 | 108 | 6.30E-05 | [ac:p42401] [gn:ycke] [or:*bacillus subtilis*] [de:hypothetical 17.0 kd protein in comj 5'region (orf3)] [sp:p42401] [dbs:swissprot] |
| 23995942_c1_40 | 1265 | 4919 | 945 | 314 | 268 | 2.30E-23 | [ac:p44550] [gn:hi0172] [or:*haemophilus influenzae*] [de:hypothetical lipoprotein hi0172 precursor] [sp:p44550] [dbs:swissprot] |
| 24000262_c2_63 | 1266 | 4920 | 768 | 255 | 226 | 6.60E-19 | [ac:c64686] [pn:conserved hypothetical integral membrane protein hp1331] [or:*heliobacter pylori*] [db:pir] |

TABLE 2-continued

| Orf | NT Seq ID | AA Seq ID | NT Orf length | AA Orf length | Score | Probability | Description |
|---|---|---|---|---|---|---|---|
| 24007763_f1_8 | 1267 | 4921 | 348 | 115 | 76 | 0.37 | [ln:mbu57538] [acu57538] [pn:rhodopsin] [or:myripristis berndti] [db:genpept-vrt] [de:myripristis berndti rhodopsin mrna, partial cds.] [le:<1] [re:1051] [di:direct] |
| 24007952_c2_30 | 1268 | 4922 | 1437 | 478 | 1779 | 1.80E-183 | [ac:p42403] [gn:ycke] [or:bacillus subtilis] [ec:3.2.1.21] [de:(beta-d-glucoside glucohydrolase) (amygdalase)] [sp:p42403] [db:swissprot] |
| 24010217_f3_126 | 1269 | 4923 | 912 | 303 | 811 | 6.70E-81 | [ac:p37679] [gn:sgbu] [or:escherichia coli] [ec:5.-.-.-] [de:putative hexulose-6-phosphate isomerase, (humpi)] [sp:p37679] [db:swissprot] |
| 24010961_c3_75 | 1270 | 4924 | 951 | 316 | 609 | 5.40E-67 | [ac:c64866] [pn:hypothetical protein b 1200] [or:escherichia coli] [db:pir] |
| 24015957_c2_26 | 1271 | 4925 | 942 | 313 | 424 | 6.80E-40 | [ac:q38135] [or:bacteriophage rlt] [ec:3.5.1.28] [de:n-acetylmuramoyl-1-alanine amidase,] [sp:q38135] [db:swissprot] |
| 2401702_f2_3 | 1272 | 4926 | 480 | 159 | 540 | 3.50E-52 | [ac:p46352] [gn:ripx] [or:in bacillus subtilis] [de:probable integrase/recombinase ripx] [sp:p46352] [db:swissprot] |
| 24022192_c1_39 | 1273 | 4927 | 219 | 72 | 197 | 7.80E-16 | [ln:spdnaarg] [acaf000658] [fn:unknown] [or:streptococcus pneumoniae] [db:genpept-bct] [de:streptococcus pneumoniae r801 trna-arg gene, partial sequence, andputative serine protease (sphtra), spspoj (spspoj), initiatorprotein (spdnaa) and beta subunit of |
| 24022900_f1_7 | 1274 | 4928 | 183 | 60 | 48 | 0.32 | [ln:atfca3] [ac:z97338] [or:arabidopsis thaliana] [sr:thale cress] [db:genpept-pln] [de:arabidopsis thaliana dna chromosome 4, essa i contig fragment no.3.] [nt:similarity to cycloartenol synthase] [le:119592:120309] [re:120106;120408] [di:complementjoin] |
| 24022903_c2_65 | 1275 | 4929 | 378 | 125 | 55 | 0.73 | [ac:p15740] [gn:rpoh] [or:halobacterium halobium] [ec:2.7.7.6] [de:dna-directed rna polymerase subunit h.] [sp:p15740] [db:swissprot] |
| 24023387_f3_15 | 1276 | 4930 | 267 | 88 | 113 | 6.20E-07 | [ac:p50727] [gn:fer] [or:bacillus subtilis] [de:ferredoxin] [sp:p50727] [db:swissprot] |
| 24023552_c1_24 | 1277 | 4931 | 804 | 267 | 211 | 2.50E-17 | [ln:u97022] [ac:u97022] [or:fervidobacterium islandicum] [db:genpept-bct] [de:fervidobacterium islandicum dna topoisomerase i (topa) gene,complete cds.] [nt:orf; similar to serine/threonine protein] [le:3164] [re:3814] [di:direct] |
| 24026465_f2_26 | 1278 | 4932 | 285 | 94 | 69 | 0.0013 | [ac:p34488] [gn:f59p2.13] [or:caenorhabditis elegans] [de:hypothetical 51.0 kd protein f59p2.13 in chromosome iii] [sp:p34488] [db:swissprot] |
| 24026551_c2_63 | 1279 | 4933 | 1140 | 379 | 149 | 1.30E-07 | [ac:p23328;p78119] [gn:sela:fdha] [or:escherichia coli] [ec:2.9.1.1] [de:(selenocysteinyl-trna(ser) synthase] [sp:p23328;p78119] [db:swissprot] |
| 24027132_f1_1 | 1280 | 4934 | 906 | 301 | 452 | 7.40E-43 | [ln:ldgappgk] [ac:aj000339] [pn:ycse protein] [gn:ycse] [or:lactobacillus delbrueckii] [db:genpept-bct] [de:lactobacillus delbrueckii ygap, gap, pgk, tpi, and ycse genes.] [le:5927] [re: |

TABLE 2-continued

| Orf | NT Seq ID | AA Seq ID | NT Orf length | AA Orf length | Score | Probability | Description |
|---|---|---|---|---|---|---|---|
| 24027215_c3_12 | 1281 | 4935 | 267 | 89 | 251 | 1.50E-21 | [ac:p37468] [gn:ksga] [or:bacillus subtilis] [ec:2.1.1.—] [de:dimethyltransferase]] [sp:p37468] [db:swissprot] |
| 24027217_c1_51 | 1282 | 4936 | 1059 | 352 | 1258 | 2.90E-128 | [ac:p17921:p94539] [gn:phes] [or:bacillus subtilis] [ec:6.1.1.20] [de:-trna ligase alpha chain) (phers)] [sp:p17921:p94539] [db:swissprot] |
| 24031251_c2_34 | 1283 | 4937 | 228 | 75 | 68 | 0.17 | [ln:fmy12759] [ac:y12759] [pn:acid phosphatase] [gn:olpa] [or:flavobacterium meningosepticum] [db:genpept-bct] [ec:3.1.3.2] [de:f.meningosepticum olpa gene.] [le:27] [re:830] [di:direct] |
| 24032842_f2_4 | 1284 | 4938 | 2070 | 689 | 3426 | 0 | [ln:efpbp5g] [ac:x92687] [pn:penicillin-binding protein 5 gene] [gn:pbp5] [or:enterococcus faecium] [db:genpept-bct] [de:e.faecium pbp5 gene.] [le:127] [re:2163] [di:direct] |
| 24033562_c2_49 | 1285 | 4939 | 996 | 331 | 331 | 2.20E-36 | [ac:s76964] [pn:hypothetical protein] [or:synechocystis sp.] [sr:pcc 6803, , pcc 6803] [sr:pcc 6803,] [db:pir] |
| 24034659_c1_3 | 1286 | 4940 | 527 | 176 | 781 | 1.00E-77 | [ac:p38054:p77767] [gn:ybde] [or:escherichia coli] [de:hypothetical 114.7 kd protein in mfrb-phep intergenic region] [sp:p38054:p77767] [db:swissprot] |
| 24035813_f2_4 | 1287 | 4941 | 726 | 241 | 842 | 3.50E-84 | [ac:p39814] [gn:topa:topi] [or:bacillus subtilis] [ec:5.99.1.2] [de:(untwisting enzyme) (swivelase)] [sp:p39814] [db:swissprot] |
| 24038892_c1_32 | 1288 | 4942 | 1236 | 411 | 1145 | 2.70E-116 | [ac:p53001] [gn:aspb] [or:bacillus subtilis] [ec:2.6.1.1] [de:aspartate aminotransferase, (transaminase a) (aspat)] [sp:p53001] [db:swissprot] |
| 24041263_c2_21 | 1289 | 4943 | 891 | 296 | 807 | 1.80E-80 | [ac:f69785] [pn:fructokinase homolog ydhr] [gn:ydhr] [or:bacillus subtilis] [db:pir] |
| 24042337_c1_120 | 1290 | 4944 | 486 | 161 | 156 | 1.70E-11 | [ln:mtcy336] [ac:z95586] [pn:unknown] [gn:mtcy336.26] [or:mycobacterium tuberculosis] [db:genpept-bct] [de:mycobacterium tuberculosis cosmid y336.] [nt:mtcy336.26. len: 156. function: unknown, highly] [le:20465] [re:20935] [di:direct] |
| 24042961_c1_12 | 1291 | 4945 | 279 | 92 | 62 | 0.66 | [ac:p78609] [or:pichia jadinii] [sr:,yeast:candida utilis] [ec:1.7.3.3] [de:uricase, (urate oxidase)] [sp:p78609] [db:swissprot] |
| 24064712_f3_54 | 1292 | 4946 | 1464 | 487 | 435 | 4.70E-41 | [ac:p07908] [gn:dnab] [or:bacillus subtilis] [de:replication initiation and membrane attachment protein] [sp:p07908] [db:swissprot] |
| 24068966_f3_24 | 1293 | 4947 | 1005 | 334 | 486 | 1.80E-46 | [ac:p30363] [gn:ansa] [or:bacillus licheniformis] [ec:3.5.1.1] [de:1-asparaginase, (1-asparagine amidohydrolase)] [sp:p30363] [db:swissprot] |
| 24081436_f3_31 | 1294 | 4948 | 501 | 166 | 221 | 2.20E-18 | [ac:b70030] [pn:conserved hypothetical protein yvbk] [gn:yvbk] [or:bacillus subtilis] [db:pir] |
| 24084466_c3_26 | 1295 | 4949 | 183 | 60 | 45 | 0.14 | [ln:celc30e1] [ac:af026204] [gn:c30e1.4] [or:caenorhabditis elegans] [sr:caenorhabditis elegans strain=bristol n2] [db:genpept-inv] [de:caenorhabditis elegans cosmid c30e1.] [le:9513:10332:10472:10589] [re:9818:10420:10522:10679] [di:direct:join] |

TABLE 2-continued

| Orf | NT Seq ID | AA Seq ID | NT Orf length | AA Orf length | Score | Probability | Description |
|---|---|---|---|---|---|---|---|
| 24095287_c1_45 | 1296 | 4950 | 768 | 255 | 621 | 9.10E-61 | [ac:p51831] [gn:fabg] [or:bacillus subtilis] [ec:1.1.1.100] [de:acyl carrier protein reductase] [sp:p51831] [db:swissprot] |
| 24095931_c1_48 | 1297 | 4951 | 438 | 145 | 307 | 1.70E-27 | [ac:f69870] [pn:general stress protein homolog ykza] [gn:ykza] [or:bacillus subtilis] [db:pir] |
| 24098213_c1_37 | 1298 | 4952 | 525 | 174 | 891 | 2.20E-89 | [ln:ph4coinjn] [ac:138972] [pn:transposase] [or:plasmid phkk701] [db:genpept-bct] [de:plasmid phkk701 (cointegrate junctional region) orfx, is1252transposase, and is1216v1 transposase genes, complete cds.] [nt:is1216v1 transposase (iso-is1216); iss1 homol |
| 24105313_f3_53 | 1299 | 4953 | 906 | 301 | 807 | 1.80E-80 | [ac:p46338] [gn:yqgg] [or:bacillus subtilis] [de:region precursor (orf108)] [sp:p46338] [db:swissprot] |
| 24105337_c1_20 | 1300 | 4954 | 1197 | 398 | 1968 | 1.70E-203 | [ac:p23531] [gn:lace] [or:lactococcus lactis] [sr;subsplactis:streptococcus lactis] [ec:2.7.1.69] [de:(ec 2.7.1.69) (eii-lac)] [sp:p23531] [db:swissprot] |
| 24105467_c2_34 | 1301 | 4955 | 525 | 174 | 530 | 4.00E-51 | [ac:a70024] [pn:conserved hypothetical protein yutg] [gn:yutg] [or:bacillus subtilis] [db:pir] |
| 24112756_f1_2 | 1302 | 4956 | 195 | 64 | 69 | 0.19 | [ac:p38232] [gn:reg2-ybr050c;ybr0504] [or:saccharomyces cerevisiae] [sr;baker's yeast] [de:reg2 protein] [sp:p38232] [db:swissprot] |
| 24112757_f3_13 | 1303 | 4957 | 252 | 83 | 57 | 0.41 | [ln:dru49414] [ac:u49414] [pn:zg10] [gn:zg10] [or:danio rerio] [sr:zebrafish] [db:genpept-vrt] [de:danio rerio zg10 gene, partial cds.] [nt:putative transmembrane receptor] [le:<1] [re: |
| 24115677_f1_9 | 1304 | 4958 | 264 | 87 | 64 | 0.59 | [ln:mtcy4d9] [ac:z84725] [pn:unknown] [gn:mtcy04d9.12c] [or:mycobacterium tuberculosis] [db:genpept-bct] [de:mycobacterium tuberculosis cosmid scy04d9.] [nt:mtcy04d9.12c, len: 395 aa, similar to acyl coa] [le:10109] [re:11296] [di:complement |
| 24117274_c1_38 | 1305 | 4959 | 472 | 157 | 672 | 3.60E-66 | [ac:p30299] [gn:ptsi] [or:streptococcus salivarius] [ec:2.7.3.9] [de:(phosphotransferase system, enzyme i)] [sp:p30299] [db:swissprot] |
| 24119062_c1_78 | 1306 | 4960 | 312 | 104 | 390 | 2.70E-36 | [ac:p50926] [gn:upp] [or:lactococcus lactis] [sr;subsplactis:streptococcus lactis] [ec:2.4.2.9] [de:(uptase)] [sp:p50926] [db:swissprot] |
| 24218803_f2_10 | 1307 | 4961 | 621 | 206 | 214 | 2.80E-17 | [ac:e69796] [pn:two-component response regulator yesm] homolog yesn] [gn:yesn] [or:bacillus subtilis] [db:pir] |
| 24218808_f1_14 | 1308 | 4962 | 291 | 96 | 51 | 0.9 | [ln:halrghm] [ac:j05222] [pn:ribosomal protein] [or:haloarcula marismortui] [sr:halobacterium marismortui (clone: pp7.) dna] [db:genpept-bct] [de:halobacterium marismortui ribosomal protein gene cluster.] [nt:orf3; putative] [le:6139] [re: |
| 24219187_c1_31 | 1309 | 4963 | 714 | 237 | 235 | 7.30E-20 | [ac:p46908] [gn:fmr] [or:bacillus subtilis] [de:anaerobic regulatory protein] [sp:p46908] [db:swissprot] |

TABLE 2-continued

| Orf | NT Seq ID | AA Seq ID | NT Orf length | AA Orf length | Score | Probability | Description |
|---|---|---|---|---|---|---|---|
| 2421928_f3_8 | 1310 | 4964 | 825 | 274 | 288 | 5.00E-35 | [ln:spac57a10] [ac:z94864] [pn:unknown] [gn:spac57a10.03] [or:*schizosaccharomyces pombe*] [sr:fission yeast] [db:genpept-pln] [de:*s.pombe* chromosome i cosmid c57a10.] [nt:spac57a10.03, cyclophilin-related, len:156aa,] [le:5344:5414:5521:5779] [re:5373:5455 |
| 24222086_C1_69 | 1311 | 4965 | 561 | 186 | 90 | 0.00033 | [ln:mgu01701] [ac:u01701] [pn:unknown] [or:*mycoplasma genitalium*] [db:genpept-bct] [de:*mycoplasma genitalium* random genomic clone esa8, partial cds.] [le:<1] [re: |
| 24223428_c1_15 | 1312 | 4966 | 702 | 233 | 484 | 3.00E-46 | [ln:efu39859] [ac:u39859] [pn:invertase-enterococcal] [gn:entinv] [or:*enterococcus faecalis*] [sr:*enterococcus faecalis* strain=ch116] [db:genpept-bct] [de:*enterococcus faecalis* transposon tn5384 putative invertase (entinv)gene, complete cds.] [nt:descripti |
| 24223453_f2_18 | 1313 | 4967 | 312 | 103 | 139 | 1.10E-09 | [ln:llu35629] [ac:u35629] [pn:unknown] [or:*lactococcus lactis*] [db:genpept-bct] [de:*lactococcus lactis* plasmid psrq802 abortive infection protein k(abik) gene, complete cds.] [nt:orf4] [le:723] [re:1007] [di:direct] |
| 24225261_c2_72 | 1314 | 4968 | 525 | 174 | 103 | 0.0096 | [ln:af014012] [ac:af014012] [pn:restin] [or:*gallus gallus*] [sr:chicken] [db:genpept-vrt] [de:*gallus gallus* restin mrna, complete cds.] [le:115] [re:4416] [di:direct] |
| 24225925_c1_17 | 1315 | 4969 | 240 | 79 | 66 | 0.041 | [ac:q20086] [gn:ugt5:f35h8.6] [or:*caenorhabditis elegans*] [ec:2.4.1.17] [de:(udpgt)] [sp:q20086] [db:swissprot] |
| 24226417_c1_108 | 1316 | 4970 | 936 | 311 | 64 | 0.48 | [ln:d78257] [ac:d78257] [pn:orf7] [gn:orf7] [or:*enterococcus faecalis*] [sr:*enterococcus faecalis* plasmid:pyi17 dna] [db:genpept-bct] [de:*enterococcus faecalis* plasmid pyi17 genes for baca, bacb, orf3,orf4, orf5, orf6, orf7, orf8, orf9, orf10, orf11,partia |
| 24226552_c3_68 | 1317 | 4971 | 894 | 297 | 166 | 3.00E-10 | [ac:h69160] [pn:hypothetical protein mth465] [gn:mth465] [or:*methanobacterium thermoautotrophicum*] [db:pir] |
| 24228463_f2_28 | 1318 | 4972 | 1152 | 383 | 446 | 3.20E-42 | [ac:c55205] [pn:integrase] [gn:int] [or:*lactococcus lactis*] [db:pir] |
| 24234462_c2_43 | 1319 | 4973 | 909 | 302 | 520 | 4.60E-50 | [ac:s77536] [pn:hypothetical protein] [or:synechocystis sp.] [sr:pcc 6803, , pcc 6803] [sr:pcc 6803,] [db:pir] |
| 24238137_f1_9 | 1320 | 4974 | 1038 | 345 | 242 | 3.40E-21 | [ac:p73580] [gn:uvres:1110865] [or:synechocystis sp] [sr:pcc 6803,] [de:excinuclease abc subunit c] [sp:p73580] [db:swissprot] |
| 24240937_c2_82 | 1321 | 4975 | 966 | 321 | 684 | 1.90E-67 | [ac:b69988] [pn:hypothetical protein ytap] [gn:ytap] [or:*bacillus subtilis*] [db:pir] |
| 24251338_f3_20 | 1322 | 4976 | 984 | 327 | 209 | 5.50E-17 | [ac:p27029] [gn:rhas:rhac2] [or:*salmonella typhimurium*] [de:l-rhamnose operon regulatory protein rhas] [sp:p27029] [db:swissprot] |

TABLE 2-continued

| Orf | NT Seq ID | AA Seq ID | NT Orf length | AA Orf length | Score | Probability | Description |
|---|---|---|---|---|---|---|---|
| 24251537_c2_97 | 1323 | 4977 | 339 | 112 | 69 | 0.29 | [ln:d85752] [ac:d85752] [gn:bacd] [or:enterococcus faecalis] [sr:enterococcus faecalis plasmid:ppd1 dna] [db:genpept] [de:enterococcus faecalis plasmid ppd1 baca, bacb, bacc, bacd, bace, bacf, bacg, bach and baci genes, complete cds.] [le:3977] [re:4324] [ |
| 24252188_f1_23 | 1324 | 4978 | 648 | 215 | 98 | 0.0045 | [ac:e69797] [pn:conserved hypothetical protein yesv] [gn:yesv] [or:bacillus subtilis] [db:pir] |
| 24254437_f1_2 | 1325 | 4979 | 345 | 114 | 76 | 0.16 | [ln:bbu43739] [ac:u43739] [or:borrelia burgdorferi] [sr:lyme disease spirochete strain=b31] [db:genpept-bct] [de:borrelia burgdorferi fosmid clone 31, complete sequence.] [nt:orf19; method: conceptual translation supplied by] [le:17318] [re:17935] [di:com |
| 24256561_f3_26 | 1326 | 4980 | 192 | 63 | 48 | 0.18 | [ac:h69207] [pn:cobalamin biosynthesis protein d] [gn:mth808] [or:methanobacterium thermoautotrophicum] [db:pir] |
| 24257628_f1_15 | 1327 | 4981 | 210 | 69 | 63 | 0.32 | [ac:p39742] [gn:sec72:sec67:sim2:ylr292c:18003.18] [or:saccharomyces cerevisiae] [sr:;baker's yeast] [de:translocation protein sec72 (p23)] [sp:p39742] [db:swissprot] |
| 24257712_c1_59 | 1328 | 4982 | 504 | 167 | 566 | 6.10E-55 | [ln:charpqtou] [ac:z50854] [pn:arpu] [gn:arpu] [fn:muramidase-2 processing; autolysin regulatory] [or:enterococcus hirae] [db:genpept-bct] [de:e.hirae arp[q,r,s,t,u] genes.] [le:1230] [re:1643] [di:direct] |
| 24257802_c3_42 | 1329 | 4983 | 765 | 254 | 827 | 1.30E-82 | [ac:p55339] [gn:eecsa:prst] [or:bacillus subtilis] [de:abc-type transporter atp-binding protein ecsa] [sp:p55339] [db:swissprot] |
| 24258262_c1_36 | 1330 | 4984 | 321 | 106 | 74 | 0.29 | [ac:p56451] [gn:me5r] [or:bos taurus] [sr:,bovine] [de:melanocortin-5 receptor (me5-r)] [sp:p56451] [db:swissprot] |
| 24259577_f1_1 | 1331 | 4985 | 846 | 281 | 637 | 1.80E-62 | [ac:p96051] [or:streptococcus thermophilus] [de:(orf1091)] [sp:p96051] [db:swissprot] |
| 24259677_f1_2 | 1332 | 4986 | 1380 | 459 | 313 | 2.50E-26 | [ac:f69762] [pn:transporter homolog yeli] [gn:yeli] [or:bacillus subtilis] [db:pir] |
| 24260902_c1_25 | 1333 | 4987 | 699 | 232 | 86 | 0.33 | [ln:celf01e11] [ac:u42832] [gn:f01e11.4] [or:caenorhabditis elegans] [sr:caenorhabditis elegans strain=bristol n2] [db:genpept-inv] [de:caenorhabditis elegans cosmid f01e11.] [re:30184:30379:30569] [re:30325:30517:30645] [di:complement|join] |
| 24261275_c1_43 | 1334 | 4988 | 1836 | 611 | 250 | 1.80E-16 | [ac:s52267] [pn:dna polymerase iii] [or:staphylococcus aureus] [dbpir] |
| 24261411_c2_22 | 1335 | 4989 | 969 | 322 | 1112 | 8.50E-113 | [ln:ab007465] [ac:ab007465] [pn:dna gyrase subunit a] [gn:gyra coding region encoding for dna gyrase subunit] [or:streptococcus thermophilus] [sr:streptococcus thermophilus (strain:m-192) dna] [db:genpept-bct] [de:streptococcus thermophilus gene for dna g |

TABLE 2-continued

| Orf | NT Seq ID | AA Seq ID | NT Orf length | AA Orf length | Score | Probability | Description |
|---|---|---|---|---|---|---|---|
| 24265755_f2_9 | 1336 | 4990 | 195 | 64 | 59 | 0.28 | [ln:cef19b10] [ac:af000261] [gn:f19b10.6] [or:caenorhabditis elegans] [sr:caenorhabditis elegans strain=bristol n2] [db:genpept-inv] [de:caenorhabditis elegans cosmid f19b10.] [le:15481:15572] [re:15525:15868] [di:complementjoin] |
| 24266577_f2_41 | 1337 | 4991 | 1113 | 370 | 95 | 0.026 | [ac:q58609] [gn:pssa:mj1212] [or:methanococcus jannaschii] [ec:2.7.8.8] [de:(phosphatidyl)serine synthase] [sp:q58609] [db:swissprot] |
| 24266927_f1_22 | 1338 | 4992 | 210 | 69 | 57 | 0.65 | [ln:s66773] [ac:s66773] [pn:adenosine deaminase] [gn:adenosine deaminase] [or:homo sapiens] [sr:human peripheral blood t cells ada deficient patient alne] [db:genpept-pri2] [de:adenosine deaminase {32-bp insertion at residues 13–44, exon 10,exon 11} [huma] |
| 24267017_c1_12 | 1339 | 4993 | 186 | 61 | 60 | 0.23 | [ln:cef59c6] [ac:z79600] [pn:f59c6.7] [or:caenorhabditis elegans] [db:genpept-inv] [de:caenorhabditis elegans cosmid f59c6, complete sequence.] [le:10287:10420:10580] [di:complementjoin] |
| 24273303_c2_24 | 1340 | 4994 | 930 | 309 | 388 | 4.50E-36 | [ac:g69849] [pn:endo-1,4-beta-xylanase homolog yjea] [gn:yjea] [or:bacillus subtilis] [db:pir] |
| 24273430_c3_33 | 1341 | 4995 | 516 | 171 | 133 | 4.70E-09 | [ac:p15081] [gn:gutm:srlm] [or:escherichia coli] [de:glucitol operon activator protein] [sp:p15081] [db:swissprot] |
| 24273437_c1_25 | 1342 | 4996 | 2229 | 742 | 2129 | 3.60E-222 | [ac:p43467] [gn:agar] [or:pediococcus pentosaceus] [ec:3.2.1.22] [de:alpha-galactosidase 1, (melibiase)] [sp:p43467] [db:swissprot] |
| 242750_f3_57 | 1343 | 4997 | 732 | 243 | 269 | 1.80E-23 | [ac:p46903] [gn:nata] [or:bacillus subtilis] [de:atp-binding transport protein nata] [sp:p46903] [db:swissprot] |
| 24277266_f3_54 | 1344 | 4998 | 381 | 126 | 94 | 0.00052 | [ac:16893] [pn:hypothetical protein (insertion sequence is901)] [or:mycobacterium avium] [db:pir] |
| 24296880_f3_144 | 1345 | 4999 | 330 | 109 | 98 | 0.00039 | [ln:cezk945] [ac:z48544] [pn:zk945.10] [or:caenorhabditis elegans] [db:genpept-inv] [de:caenorhabditis elegans cosmid zk945, complete sequence.] [nt:similar to mucin] [sp:q09625] [le:25174:25897:26027] [re:25742:25975:26658] [di:complementjoin] |
| 24298427_f2_17 | 1346 | 5000 | 207 | 68 | 55 | 0.21 | [ac:b64143] [pn:hypothetical protein hi0115] [or:haemophilus influenzae] [db:pir] |
| 24298432_c3_32 | 1347 | 5001 | 2226 | 741 | 490 | 9.50E-45 | [ac:p56255] [gn:pera] [or:bacillus stearothermophilus] [ec:3.6.1.—] [de:atp-dependent helicase pera,] [sp:p56255] [db:swissprot] |
| 24298827_f3_17 | 1348 | 5002 | 2061 | 686 | 141 | 9.90E-06 | [ln:cef12f3] [ac:u80022] [gn:f12f3.3] [or:caenorhabditis elegans] [sr:caenorhabditis elegans strain=bristol n2] [db:genpept-inv] [de:caenorhabditis elegans cosmid f12f3.] [nt:coded for by] |
| 24303552_c1_119 | 1349 | 5003 | 462 | 153 | 88 | 0.00028 | [c. elegans cdna yk41h4.3; coded for by] [le:20991:21682:26148] [re:ac:e69798] [pn:conserved hypothetical protein yeth] [gn:yeth] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 24304187_c3_48 | 1350 | 5004 | 501 | 166 | 673 | 2.80E-66 | [ac:a64533] [pn:conserved hypothetical protein hp0105] [or:*helicobacter pylori*] [db:pir] |
| 24305181_f3_48 | 1351 | 5005 | 399 | 132 | 251 | 1.50E-21 | [ln:msgtewpa] [ac:m15467] [pn:unknown protein] [or:*mycobacterium tuberculosis*] [sr:*mycobacterium tuberculosis* (strain erdman) dna] [db:genpept-bct] [de:*m.tuberculosis* 65 kda antigen (cell wall protein a) gene.] [nt:orf f175; putative] [le:242] [re:769] [d |
| 24307952_f2_14 | 1352 | 5006 | 264 | 87 | 66 | 0.28 | [ac:s57766:s39192] [pn:dioscorin class a precursor:storage protein] [or:*dioscorea cayenensis*] [db:pir] |
| 24308590_c2_75 | 1353 | 5007 | 2871 | 956 | 132 | 4.50E-12 | [ac:p13464] [gn:virid4] [or:*agrobacterium rhizogenes*] [de:virid4 protein] [sp:p13464] [db:swissprot] |
| 24317842_f1_7 | 1354 | 5008 | 966 | 321 | 456 | 2.80E-43 | [ac:p26421] [gn:lacc] [or:*streptococcus mutans*, (phosphotagalokinase)] [ec:2.7.1.—] [de:tagatose-6-phosphate kinase,] [sp:p26421] [db:swissprot] |
| 24319002_c1_88 | 1355 | 5009 | 726 | 241 | 164 | 2.40E-12 | [ac:a57258] [pn:rha protein] [or:phage phi-80] [db:pir] |
| 24319011_c1_91 | 1356 | 5010 | 243 | 80 | 61 | 0.032 | [ln:celc32b5] [ac:u80843] [gn:c32b5.15] [or:*caenorhabditis elegans*] [sr:*caenorhabditis elegans* strain=bristol n2] [db:genpept-inv] [de:*caenorhabditis elegans* cosmid c32b5.] [le:24623;24788:25074] [re:24740:24881:25408] [di:complementjoin] |
| 24319706_f1_3 | 1357 | 5011 | 300 | 99 | 333 | 3.00E-30 | [ac:p39778] [gn:hslu:codx] [or:*bacillus subtilis*] [de:heat shock protein hslu] [sp:p39778] [db:swissprot] |
| 24320153_f1_1 | 1358 | 5012 | 186 | 61 | 57 | 0.41 | [ac:jq0273:s05153] [pn:hypothetical 7k protein (trnh-trnv intergenic region)] [or:chloroplast oryza sativa] [sr:, rice] [db:pir] |
| 24320877_c2_30 | 1359 | 5013 | 1512 | 503 | 1446 | 3.40E-148 | [ac:h69593] [pn:beta-glucosidase bglh] [gn:bglh] [or:*bacillus subtilis*] [db:pir] |
| 24321917_c2_14 | 1360 | 5014 | 240 | 79 | 119 | 1.40E-07 | [ln:ab000222] [ac:ab000222] [or:*staphylococcus capitis*] [sr:*staphylococcus capitis* dna] [db:genpept-bct] [de:*staphylococcus capitis* epr gene ,complete cds.] [nt:orf2] [le:1886] [re:2275] [di:direct] |
| 24328383_c3_50 | 1361 | 5015 | 192 | 63 | 59 | 0.057 | [ac:c30554] [pn:ig heavy chain c region] [cl:immunoglobulin c region:immunoglobulin homology] [or:*ovis orientalis aries:ovis ammon aries*] [sr:,domestic sheep] [db:pir] |
| 24328452_c2_45 | 1362 | 5016 | 330 | 109 | 70 | 0.068 | [ac:p43994] [gn:hi0395] [or:*haemophilus influenzae*] [de:hypothetical protein hi0395] [sp:p43994] [db:swissprot] |
| 24334627_f3_104 | 1363 | 5017 | 294 | 97 | 72 | 0.03 | [ln:rnu65007] [ac:u65007] [pn:hepatocyte growth factor receptor] [or:*rattus norvegicus*] [sr:norway rat] [db:genpept-rod] [de:*rattus norvegicus* hepatocyte growth factor receptor mrna, completeceds.,] [le:1] [re:4149] [di:direct] |

TABLE 2-continued

| Orf | NT Seq ID | AA Seq ID | NT Orf length | AA Orf length | Score | Probability | Description |
|---|---|---|---|---|---|---|---|
| 24335942_c3_34 | 1364 | 5018 | 240 | 79 | 63 | 0.22 | [ac:p70709] [gn:rnase3:rns3] [or:*rattus norvegicus*] [sr:,rat] [ec:3.1.27.—] [de:(ribonuclease 3) (rnase 3)] [sp:p70709] [db:swissprot] |
| 24335952_f2_6 | 1365 | 5019 | 951 | 316 | 1025 | 1.40E-103 | [lh:efu03756] [ac:u03756] [pn:endocarditis specific antigen] [or:*enterococcus faecalis*] [db:genpept-bct] [de:*enterococcus faecalis* endocarditis specific antigen gene, completeds.] [le:139] [re:1065] [di:direct] |
| 24336088_c3_281 | 1366 | 5020 | 570 | 189 | 505 | 1.80E-48 | [ln:efgls24b] [ac:aj000042] [gn:gls24] [or:*enterococcus faecalis*] [db:genpept-bct] [de:*enterococcus faecalis* gls24, glsb genes.] [le:310] [re:852] [di:direct] |
| 24336407_c3_34 | 1367 | 5021 | 339 | 112 | 56 | 0.53 | [ac:p43017] [gn:iagb] [or:*salmonella typhimurium*] [de:invasion protein iagb precursor (fragment)] [sp:p43017] [db:swissprot] |
| 24336563_f1_5 | 1368 | 5022 | 1245 | 414 | 802 | 6.00E-80 | [ac:p46344;p46345;p46346] [gn:yqff] [or:*bacillus subtilis*] [de:hypothetical 79.2 kd protein in phob-dgka intergenic region] [sp:p46344;p46345;p46346] [db:swissprot] |
| 24337567_c1_53 | 1369 | 5023 | 555 | 184 | 359 | 5.30E-33 | [ac:a69708] [pn:signal peptidase i sipv] [gn:sipv] [or:*bacillus subtilis*] [db:pir] |
| 24337805_c1_112 | 1370 | 5024 | 633 | 210 | 811 | 6.70E-81 | [ac:g99728] [pn:uridine kinase udk] [gn:udk] [or:*bacillus subtilis*] [db:pir] |
| 24337827_c3_38 | 1371 | 5025 | 420 | 139 | 80 | 0.054 | [ln:eau67194] [ac:u67194] [pn:pep1] [gn:tnpa] [fn:possible polypeptide cyclase on basis of weak] [or:*enterobacter aerogenes*] [db:genpept-bct] [de:*enterobacter aerogenes* plasmid r751, complete genome.] [nt:orf1] [le:11649] [re:12071] [di:complement] |
| 24337830_c2_113 | 1372 | 5026 | 213 | 70 | 224 | 4.30E-18 | [ac:g70019] [pn:conserved hypothetical protein yurx] [gn:yurx] [or:*bacillus subtilis*] [db:pir] |
| 24339213_f2_7 | 1373 | 5027 | 561 | 186 | 625 | 3.40E-61 | [ac:p39070] [gn:hslv:coodw] [or:*bacillus subtilis*] [ec:3.4.99.—] [de:heat shock protein hslv precursor,] [sp:p39070] [db:swissprot] |
| 24348260_f1_2 | 1374 | 5028 | 210 | 69 | 51 | 0.3 | [ac:p43757] [gn:tkta:hi1023] [or:*haemophilus influenzae*] [ec:2.2.1.1] [de:transketolase, (tk)] [sp:p43757] [db:swissprot] |
| 24350652_f2_12 | 1375 | 5029 | 636 | 211 | 444 | 5.20E-42 | [ac:a69999] [pn:phenylalanyl-trna synthetase (beta subunit) homolog ytpr] [gn:ytpr] [or:*bacillus subtilis*] [db:pir] |
| 24351452_f2_2 | 1376 | 5030 | 540 | 179 | 746 | 5.20E-74 | [ln:af044978] [ac:af044978] [pn:attenuation regulatory protein] [gn:pyrr] [fn:uracil phosphoribosyltransferase] [or:*enterococcus faecalis*] [db:genpept] [de:*enterococcus faecalis* pyr operon:attenuation regulatory protein(pyrr) and putative uracil permease |
| 24351528_c2_108 | 1377 | 5031 | 285 | 94 | 70 | 0.058 | [ac:q02862] [gn:csng] [or:*mus musculus*] [sr:,mouse] [de:gamma casein precursor(pp22)] [sp:q02862] [db:swissprot] |

TABLE 2-continued

| Orf | NT Seq ID | AA Seq ID | NT Orf length | AA Orf length | Score | Probability | Description |
|---|---|---|---|---|---|---|---|
| 24352180_c1_93 | 1378 | 5032 | 504 | 167 | 678 | 8.30E-67 | [ln:eharpqtou] [ac:z50854] [pn:arpu] [gn:arpu] [fn:muramidase-2 processing; autolysin regulatory] [or:*enterococcus hirae*] [db:genpept-bct] [de:*c.hirae* arp[q,r,s,t,u] genes.] [le:1230] [re:1643] [di:direct] |
| 24353377_c2_55 | 1379 | 5033 | 1191 | 396 | 1745 | 7.10E-180 | [ac:p33170] [gn:tuf] [or:*streptococcus oralis*] [de:elongation factor tu (ef-tu)] [sp:p33170] [db:swissprot] |
| 24353430_c1_85 | 1380 | 5034 | 795 | 264 | 393 | 1.30E-36 | [ac:b69852] [pn:nadh dehydrogenase homolog yjlD] [gn:yjld] [or:*bacillus subtilis*] [db:pir] |
| 24353568_f3_24 | 1381 | 5035 | 864 | 287 | 491 | 5.40E-47 | [ac:p39315] [gn:ytfg] [or:*escherichia coli*] [de:hypothetical 29.7 kd protein in rpli-cpdb intergenic region (f286)] [sp:p39315] [db:swissprot] |
| 24390885_f3_17 | 1382 | 5036 | 549 | 182 | 180 | 4.90E-14 | [ac:p44994] [gn:hi1030] [or:*haemophilus influenzae*] [de:hypothetical protein hi1030] [sp:p44994] [db:swissprot] |
| 24392182_c2_57 | 1383 | 5037 | 1497 | 498 | 1027 | 8.60E-104 | [ac:h69626] [pn:pts fructose-specific enzyme iibc component frua] [gn:frua] [or:*bacillus subtilis*] [db:pir] |
| 24392882_c1_114 | 1384 | 5038 | 294 | 97 | 134 | 1.00E-08 | [ac:q03158] [gn:enda] [or:*streptococcus pneumoniae*] [de:dna-entry nuclease (competence-specific nuclease)] [sp:q03158] [db:swissprot] [ec:3.1.30.—] |
| 24392930_c3_192 | 1385 | 5039 | 216 | 71 | 58 | 0.5 | [ln:cc1k11h12] [ac:u88168] [gn:k11h12.6] [or:*caenorhabditis elegans*] [sr:*caenorhabditis elegans* strain=bristol n2] [db:genpept-inv] [de:*caenorhabditis elegans* cosmid k11h12.] [le:10386:10660:10830] [re:10505:10748:10908] [di:complementjoin] |
| 24395012_f1_1 | 1386 | 5040 | 741 | 246 | 421 | 1.40E-39 | [ac:b70009] [pn:two-component response regulator [yufl] homolog yufm] [gn:yufm] [or:*bacillus subtilis*] [db:pir] |
| 24395078_c2_145 | 1387 | 5041 | 1632 | 543 | 916 | 5.00E-92 | [ac:q11046] [gn:mtcy50.09] [or:*mycobacterium tuberculosis*] [de:hypothetical abc transporter atp-binding protein cy50.09] [sp:q11046] [db:swissprot] |
| 24397126_c3_83 | 1388 | 5042 | 243 | 80 | 60 | 0.23 | [ln:ssgm643] [ac:x79528] [pn:m(-like) protein] [gn:emm lg643] [or:group g streptococcus] [db:genpept-bct] [de:streptococcus sp. group g emm lg643 gene.] [nt:type f] [le:<1] [re: |
| 24397686_f2_12 | 1389 | 5043 | 573 | 190 | 137 | 5.70E-08 | [ac:p19834] [or:*streptomyces clavuligerus*] [de:insertion element is116 hypothetical 44.8 kd protein] [sp:p19834] [db:swissprot] |
| 24397952_c1_26 | 1390 | 5044 | 1095 | 364 | 270 | 6.50E-23 | [ln:bacspiiia] [ac:m17445] [or:*bacillus subtilis*] [sr:*b.subtilis*, cdna to mrna] [db:genpept-bct] [de:*b.subtilis* sporulation protein spoiiea and spoiiieb genes,complete cds and open reading frame x, 3' end.] [nt:spoiiea protein] [le:1074] [re:2630] [di:d |
| 24398400_c1_50 | 1391 | 5045 | 270 | 89 | 76 | 0.1 | [ac:o08365] [gn:mtcy21c12.02] [or:*mycobacterium tuberculosis*] [ec:3.6.1.—] [de:putative cation-transporting atpase cy21c12.02,] [sp:o83365] [db:swissprot] |

TABLE 2-continued

| Orf | NT Seq ID | AA Seq ID | NT Orf length | AA Orf length | Score | Probability | Description |
|---|---|---|---|---|---|---|---|
| 24398500_f2_4 | 1392 | 5046 | 441 | 146 | 344 | 2.10E-31 | [ac:p36921] [or:enterococcus faecalis] [sr:streptococcus faecalis] [de:cell wall enzyme ebsb] [sp:p36921] [db:swissprot] |
| 24399193_c3_63 | 1393 | 5047 | 204 | 67 | 67 | 0.07 | [ac:s76665] [pn:hypothetical protein] [or:synechocystis sp.] [sr:pcc 6803, , pcc 6803] [sp:pcc 6803, ] [db:piri] |
| 24400077_c2_44 | 1394 | 5048 | 1473 | 490 | 809 | 1.10E-80 | [ac:p40714] [gn:esca] [or:escherichia coli] [ec:3.2.1.26] [de:sucrose-6-phosphate hydrolase, (sucrase) (invertase)] [sp:p40714] [db:swissprot] |
| 24400317_c1_21 | 1395 | 5049 | 1035 | 344 | 73 | 0.076 | [ac:q58263] [gn:mtrg:mj0853] [or:methanococcus jannaschii] [ec:2.1.1.86] [de:methyl transferase 13 kd subunit)] [sp:q58263] [db:swissprot] |
| 24401035_c1_48 | 1396 | 5050 | 2343 | 780 | 154 | 3.00E-15 | [ln:pip501aa] [ac:139769] [or:plasmid pip501] [sr:plasmid pip501 (strain pva1702) dna] [dbgenpept-bct] [de:plasmid pip501 (from streptococcus) genes, six complete codingregions.] [nt:orf5] [re:4794] [re:6755] [di:direct] |
| 24406387_c2_57 | 1397 | 5051 | 915 | 304 | 1303 | 4.90E-133 | [ln:efentijo] [ac:y16413] [pn:transposase] [gn:orf4] [or:enterococcus faecium] [db:genpept-bct] [de:enterococcus faecium enti and entj genes and two open reading frames.] [nt:author-given protein sequence is in conflict with] [le:1311] [re:2072] [di:direct |
| 24406502_c1_41 | 1398 | 5052 | 321 | 106 | 377 | 6.50E-35 | [ln:af029727] [ac:af029727] [or:enterococcus faecium] [db:genpept-bct] [de:enterococcus faecium insertion sequence is1485, complete sequence.] [nt:putative; orfa] [le:76] [re:366] [di:direct] |
| 24406667_c3_25 | 1399 | 5053 | 1062 | 353 | 996 | 1.70E-100 | [ac:h69636] [pn:nad(p)h-dependent glycerol-3-phosphate dehydrogenase gpsa] [gn:gpsa] [or:bacillus subtilis] [db:piri] |
| 24406687_c3_20 | 1400 | 5054 | 1326 | 441 | 1420 | 2.00E-145 | [ac:p34038] [gn:pyk] [or:lactobacillus delbrueckii] [sr:subspbulgaricus] [ec:2.7.1.40] [de:pyruvate kinase,] [sp:p34038] [db:swissprot] |
| 24406952_c1_9 | 1401 | 5055 | 603 | 200 | 167 | 1.20E-12 | [ac:p76219,p77229] [gn:ydjx] [or:escherichia coli] [de:hypothetical 27.9 kd protein in xtha-gdha intergenic region] [sp:p76219,p77229] [db:swissprot] |
| 24407318_c1_11 | 1402 | 5056 | 885 | 294 | 890 | 2.80E-89 | [ac:g69879] [pn:1-serine dehydratase homolog ylpa] [gn:ylpa] [or:bacillus subtilis] [db:piri] |
| 24407762_c3_157 | 1403 | 5057 | 321 | 106 | 399 | 3.00E-37 | [ln:af029727] [ac:af029727] [or:enterococcus faecium] [db:genpept-bct] [de:enterococcus faecium insertion sequence is1485, complete sequence.] [nt:putative; orfa] [le:76] [re:366] [di:direct] |
| 24407762_c3_25 | 1404 | 5058 | 321 | 106 | 399 | 3.00E-37 | [ln:af029727] [ac:af029727] [or:enterococcus faecium] [db:genpept-bct] [de:enterococcus faecium insertion sequence is1485, complete sequence.] [nt:putative; orfa] [le:76] [re:366] [di:direct] |

TABLE 2-continued

| Orf | NT Seq ID | AA Seq ID | NT Orf length | AA Orf length | Score | Probability | Description |
|---|---|---|---|---|---|---|---|
| 24407762_f2_16 | 1405 | 5059 | 321 | 106 | 405 | 7.10E-38 | [ln:af029727] [ac:af029727] [or:enterococcus faecium] [db:genpept-bct] [de:enterococcus faecium insertion sequence is1485, complete sequence.] [nt:putative; orfa] [le:76] [re:366] [di:direct] |
| 24407785_f1_4 | 1406 | 5060 | 384 | 127 | 417 | 3.80E-39 | [ac:p46899;p70969] [gn:rplr] [or:bacillus subtilis] [de:50s ribosomal protein 118] [sp:p46899;p70969] [db:swissprot] |
| 24407813_c1_77 | 1407 | 5061 | 1155 | 384 | 1230 | 2.70E-125 | [ac:p39148] [gn:glya:glyc:ipc-34d] [or:bacillus subtilis] [ec:2.1.2.1] [de:(shmt)] [sp:p39148] [db:swissprot] |
| 24407827_f3_5 | 1408 | 5062 | 465 | 154 | 234 | 6.30E-19 | [ac:g69992] [pn:spore cortex protein homolog ytgp] [gn:ytgp] [or:bacillus subtilis] [db:pir] |
| 24407832_f1_9 | 1409 | 5063 | 876 | 291 | 694 | 1.70E-68 | [ac:c70040] [pn:plant-metabolite dehydrogenase homolog yvgn] [gn:yvgn] [or:bacillus subtilis] [db:pir] |
| 24407962_c3_133 | 1410 | 5064 | 1101 | 366 | 1269 | 2.00E-129 | [ac:p76043;p78306] [gn:ycjq] [or:escherichia coli] [de:intergenic region] [sp:p76043;p78306] [db:swissprot] |
| 24408187_c3_34 | 1411 | 5065 | 285 | 94 | 60 | 0.23 | [ac:p39506] [gn:y14c:frd.1] [or:bacteriophage t4] [de:hypothetical 9.5 kd protein in frd-gp32 intergenic region] [sp:p39506] [db:swissprot] |
| 24408212_f1_7 | 1412 | 5066 | 348 | 115 | 262 | 1.00E-22 | [ac:q45399] [gn:cela] [or:bacillus stearothermophilus] [ec:2.7.1.69] [de:(ec 2.7.1.69)] [sp:q45399] [db:swissprot] |
| 24408438_c3_130 | 1413 | 5067 | 2133 | 710 | 263 | 3.40E-19 | [ln:u93872] [ac:u93872] [or:kaposi's sarcoma-associated herpesvirus] [sr:kaposi's sarcoma-associated herpesvirus - human herpesvirus 8] [db:genpept-vrl] [de:kaposi's sarcoma-associated herpesvirus glycoprotein m, dnareplication protein, glycoprotein, dna |
| 24408500_f1_4 | 1414 | 5068 | 552 | 183 | 78 | 0.15 | [ln:af025396] [ac:af025396] [gn:orf15x3] [or:vibrio anguillarum] [db:genpept-bct] [de:vibrio anguillarum rfb region, partial sequence.] [nt:orf15x3: function unknown] [le:11267] [re:11653] [di:direct] |
| 24409642_c2_121 | 1415 | 5069 | 294 | 97 | 364 | 1.60E-33 | [ac:p19775] [gn:tnp] [or:staphylococcus aureus] [de:transposase for insertion sequence element is256 in transposon tn4001] [sp:p19775] [db:swissprot] |
| 24410902_c2_19 | 1416 | 5070 | 315 | 105 | 60 | 0.23 | [ac:p46190] [gn:rpso] [or:mycoplasma hyorhinis] [de:30s ribosomal protein s15 (fragment)] [sp:p46190] [db:swissprot] |
| 24410902_c2_62 | 1417 | 5071 | 816 | 271 | 114 | 0.00019 | [ac:q02150] [or:lactococcus lactis] [sr:subsplactis:streptococcus lactis] [de:hypothetical 31.3 kd protein in hisie 3'region (orf13)] [sp:q02150] [db:swissprot] |
| 24410902_f2_72 | 1418 | 5072 | 762 | 253 | 108 | 0.00082 | [ac:q02150] [or:lactococcus lactis] [sr:subsplactis:streptococcus lactis] [de:hypothetical 31.3 kd protein in hisie 3'region (orf13)] [sp:q02150] [db:swissprot] |

TABLE 2-continued

| Orf | NT Seq ID | AA Seq ID | NT Orf length | AA Orf length | Score | Probability | Description |
|---|---|---|---|---|---|---|---|
| 24410925_c1_203 | 1419 | 5073 | 324 | 107 | 66 | 0.057 | [ac:f47758] [pn:reverse transcriptase (copia-like retrotransposon)] [or:liriodendron chinense] [db:pir] |
| 24412582_c1_170 | 1420 | 5074 | 528 | 175 | 613 | 6.40E-60 | [n:efplsep1g] [ac:x96976] [pn:transposase] [gn:tnp1062] [or:enterococcus faecalis] [db:genpept-bct] [de:e.faecalis plasmid dna sep1 gene, 4068bp.] [le:2496] [re:3455] [di:complement] |
| 24412902_c2_41 | 1421 | 5075 | 315 | 104 | 66 | 0.057 | [ac:c69333] [pn:hypothetical protein af0667] [or:archaeoglobus fulgidus] [db:pir] |
| 24413400_c3_60 | 1422 | 5076 | 1431 | 476 | 178 | 5.60E-13 | [ac:p06153:p15239] [or:bacteriophage phi-105] [de:immunity repressor protein] [sp:p06153:p15239] [db:swissprot] |
| 24414086_c2_35 | 1423 | 5077 | 765 | 254 | 712 | 2.10E-70 | [ac:g69762] [pn:two-component response regulator [yelk] homolog yclj] [gn:yclj] [or:bacillus subtilis] [db:pir] |
| 24414160_c3_151 | 1424 | 5078 | 1179 | 392 | 79 | 0.021 | [ac:s66396] [pn:integrin beta 1 chain isoform d] [cl:integrin beta chain] [or:homo sapiens] [sr:, man] [db:pir] |
| 24414202_f3_26 | 1425 | 5079 | 1560 | 519 | 571 | 1.80E-55 | [ac:s74833] [pn:hypothetical protein s110855] [or:synechocystis sp.] [sr:pcc 6803, , pcc 6803] [sr:pcc 6803, ] [db:pir] |
| 24414207_c2_57 | 1426 | 5080 | 1005 | 334 | 630 | 1.00E-61 | [ac:jc5310] [pn:galactose repressor] [gn:galr] [or:streptococcus mutans] [db:pir] |
| 24414717_c1_52 | 1427 | 5081 | 612 | 203 | 814 | 3.20E-81 | [ac:p12047] [gn:purb:pure] [or:bacillus subtilis] [ec:4.3.2.2] [de:adenylosuccinate lyase, (adenylosuccinase) (asl)] [sp:p12047] [db:swissprot] |
| 24414717_f3_124 | 1428 | 5082 | 1497 | 498 | 608 | 2.20E-59 | [ac:p39301] [gn:sgat] [or:escherichia coli] [de:sgat protein] [sp:p39301] [db:swissprot] |
| 24414818_c1_40 | 1429 | 5083 | 1971 | 656 | 1218 | 5.00E-124 | [ln:vfu65014] [ac:u65014] [pn:pts permease for n-acetylglucosamine and] [gn:nage] [or:vibrio furnissii] [db:genpept-bct] [de:vibrio furnissii pts permease for n-acetylglucosamine and glucose(nage) gene, complete cds.] [nt:pts enzyme iinag] [le:115] [re:16 |
| 24415701_c3_40 | 1430 | 5084 | 1125 | 374 | 840 | 5.70E-84 | [ac:c70009] [pn:abc transporter (lipoprotein) homolog yufn] [gn:yufn] [or:bacillus subtilis] [db:pir] |
| 24415875_f3_73 | 1431 | 5085 | 318 | 105 | 130 | 9.80E-09 | [ac:q45399] [gn:ccela] [or:bacillus stearothermophilus] [ec:2.7.1.69] [det(ec 2.7.1.69)] [sp:q45399] [db:swissprot] |
| 24415878_f2_7 | 1432 | 5086 | 390 | 129 | 58 | 0.47 | [ac:a54525] [pn:major female-specific polypeptide (frame 1)] [or:schistosoma mansoni] [db:pir] |
| 24415887_c1_53 | 1433 | 5087 | 1338 | 445 | 290 | 4.90E-24 | [ln:scmalrefg] [ac:y07706] [pn:putative maltose-binding pootein] [gn:male] [or:streptomyces coelicolor] [db:genpept-bct] [de:s.coelicolor malr, male, malf and malg genes.] [le:1620] [re:2891] [di:direct] |
| 24415907_c1_40 | 1434 | 5088 | 534 | 177 | 349 | 6.10E-32 | [ac:p37574] [gn:yacp] [or:bacillus subtilis] [de:hypothetical 19.7 kd protein in cyss 3'region] [sp:p37574] [db:swissprot] |

TABLE 2-continued

| Orf | NT Seq ID | AA Seq ID | NT Orf length | AA Orf length | Score | Probability | Description |
|---|---|---|---|---|---|---|---|
| 24415932_c1_105 | 1435 | 5089 | 1128 | 375 | 1020 | 4.80E-103 | [ln:sau81973] [ac:u81973] [pn:cap5g] [gn:cap5g] [or:staphylococcus aureus] [db:genpept-bct] [de:staphylococcus aureus capsule gene cluster cap5a through cap5pgenes, complete cds.] [le:6500] [re:7624] [di:direct] |
| 24415936_c2_111 | 1436 | 5090 | 345 | 114 | 400 | 2.40E-37 | [ac:p18007] [or:enterococcus faecalis] [sr:streptococcus faecalis] [de:hypothetical 13 kd protein in asa1 gene region (orf1)] [sp:p18007] [db:swissprot] |
| 24415937_c1_28 | 1437 | 5091 | 1092 | 363 | 1137 | 1.90E-115 | [ac:p25548] [gn:chve] [or:agrobacterium tumefaciens] [de:multiple sugar-binding periplasmic receptor chve precursor] [sp:p25548] [db:swissprot] |
| 24415942_c1_14 | 1438 | 5092 | 513 | 170 | 97 | 0.019 | [ln:celm60] [ac:u39995] [gn:m60.5] [or:caenorhabditis elegans] [sr:caenorhabditis elegans strain=bristol n2] [db:genpept-inv] [de:caenorhabditis elegans cosmid m60,] [nt:coded for by c. elegans cdna yk25b9.3; coded for by] [le:11804:12026:12459] [re:11972 acp:36920] [gn:ebsa] [or:enterococcus faecalis] |
| 24415942_c3_14 | 1439 | 5093 | 435 | 144 | 251 | 1.50E-21 | [ac:p36920] [gn:ebsa] [or:enterococcus faecalis] [sr:streptococcus faecalis] [de:pore forming protein ebsa] [sp:p36920] [db:swissprot] |
| 24415953_c2_34 | 1440 | 5094 | 2103 | 700 | 331 | 2.50E-26 | [ln:trbr272p] [ac:104603] [pn:r27-2 protein] [or:trypanosoma cruzi] [sr:trypanosoma cruzi (strain sylvio x-10) dna] [db:genpept-inv] [de:trypanosoma cruzi r27-2 protein gene, complete cds.] [le:361] [re:3747] [di:direct] |
| 24416067_c3_66 | 1441 | 5095 | 1578 | 525 | 1935 | 5.20E-200 | [ac:p13692] [or:enterococcus faecium] [sr:streptococcus faecium] [de:p54 protein precursor] [sp:p13692] [db:swissprot] |
| 24417160_c1_83 | 1442 | 5096 | 2217 | 738 | 573 | 1.10E-55 | [ac:c69791] [pn:conserved hypothetical protein yeba] [gn:yeba] [or:bacillus subtilis] [db:pir] |
| 24417177_f3_13 | 1443 | 5097 | 240 | 79 | 58 | 0.65 | [ac:p20963] [gn:cd3z:t3z:ctcrz] [or:homo sapiens] [sr:human] [de:t3 zeta chain)] [sp:p20963] [db:swissprot] |
| 24417202_c3_33 | 1444 | 5098 | 1293 | 430 | 619 | 1.50E-60 | [ac:c69991] [pn:conserved hypothetical protein ytel] [gn:ytel] [or:bacillus subtilis] [db:pir] |
| 24417342_c2_35 | 1445 | 5099 | 363 | 120 | 127 | 6.60E-08 | [ln:bsy09476] [ac:y09476] [pn:yitl] [or:bacillus subtilis] [db:genpept-bct] [de:b.subtilis 54kb genomic dna fragment.] [nt:putative] [le:38747] [re:39595] [di:direct] |
| 24417543_c2_178 | 1446 | 5100 | 495 | 164 | 363 | 2.00E-33 | [ln:instranspo] [ac:l34675] [pn:transposase] [or:insertion sequence is1251] [sr:insertion sequence is1251 dna] [db:genpept-bct] [de:insertion sequence is1251 from enterococcus faecium transposasegene, complete cds.] [nt:putative] [le:128] [re: 1417] [di:direct] |
| 24417687_f3_33 | 1447 | 5101 | 1293 | 430 | 1040 | 3.60E-105 | [ac:p23630] [gn:lys:a:lys] [or:bacillus subtilis] [ec:4.1.1.20] [de:diaminopimelate decarboxylase, (dap decarboxylase)] [sp:p23630] [db:swissprot] |
| 24417803_c1_185 | 1448 | 5102 | 741 | 246 | 212 | 2.00E-17 | [ac:p54607] [gn:yhew] [or:bacillus subtilis] [de:hypothetical 24.7 kd protein in cspb-glpp intergenic region] [sp:p54607] [db:swissprot] |

TABLE 2-continued

| Orf | NT Seq ID | AA Seq ID | NT Orf length | AA Orf length | Score | Probability | Description |
|---|---|---|---|---|---|---|---|
| 24417842_c2_98 | 1449 | 5103 | 570 | 189 | 282 | 7.60E-25 | [ac:p31465] [gn:yief] [or:escherichia coli] [de:hypothetical 20.4 kd protein in tnab-bglb intergenic region] [sp:p31465] [db:swissprot] |
| 24417842_c3_38 | 1450 | 5104 | 2658 | 885 | 2397 | 1.30E-259 | [ac:c69663] [pn:dna mismatch repair (recognition) muts] [gn:muts] [or:bacillus subtilis] [db:pir] |
| 24422063_c3_62 | 1451 | 5105 | 1152 | 383 | 215 | 3.70E-15 | [nt:bsaralmmp] [ac:x89810] [pn:putative sugar-binding protein] [gn:aran] [fn:component of a high affinity transport system] [or:bacillus subtilis] [db:genpept-bct] [de:b.subtilis dna for araabdlnmpq-abfa operon.] [le:2022] [re:3323] [di:direct] |
| 24423143_c1_50 | 1452 | 5106 | 306 | 101 | 74 | 0.013 | [ac:s60647] [pn:nadh dehydrogenase (ubiquinone), chain 6] [gn:nd-6] [or:mitochondrion artemia franciscana] [sr:; brine shrimp] [ec:1.6.5.3] [db:pir] |
| 24423588_f3_7 | 1453 | 5107 | 1293 | 430 | 1243 | 1.10E-126 | [ac:p46538] [gn:pyrc] [or:bacillus caldolyticus] [ec:3.5.2.3] [de:dihydroorotase, (dhoase)] [sp:p46538] [db:swissprot] |
| 24424182_c3_49 | 1454 | 5108 | 1053 | 350 | 581 | 1.60E-56 | [ac:g70003] [pn:hypothetical protein ytxk] [gn:ytxk] [or:bacillus subtilis] [db:pir] |
| 24425463_c1_40 | 1455 | 5109 | 900 | 299 | 815 | 2.50E-81 | [ac:b69870] [pn:3-hydroxyisobutyrate dehydrogenase homolog ykwc] [gn:ykwc] [or:bacillus subtilis] [db:pir] |
| 24426562_c3_31 | 1456 | 5110 | 1830 | 609 | 73 | 0.6 | [ac:p14512] [gn:tet] [or:bacillus subtilis] [de:tetracycline resistance protein] [sp:p14512] [db:swissprot] |
| 24427137_c2_76 | 1457 | 5111 | 483 | 160 | 62 | 0.3 | [ac:s66648] [gn:tyrl] [or:homo sapiens] [sr:human j1-11 somatic hybrid] [db:genpept-pri2] [de:tyrl=tyrosinase related gene {exon v} human,j1-11 somatic hybrid,genomic, 320 nt]. [le:68] [re:291] [di:direct] |
| 24427192_f3_15 | 1458 | 5112 | 213 | 70 | 65 | 0.3 | [ac:p29732 ] [gn:cpcg2] [or:mastigocladus laminosus] [sr:fischerella sp.] [de:phycobilisome rod-core linker polypeptide cpcg2 (1-rc 28.7)] [sp:p29732] [db:swissprot] |
| 24427317_c2_74 | 1459 | 5113 | 849 | 282 | 504 | 2.30E-48 | [ac:p09997-p76737] [gn:yida] [or:escherichia coli] [de:hypothetical 29.7 kd protein in ipa-gyrb intergenic region] [sp:p09997:p76737] [db:swissprot] |
| 24428125_c3_148 | 1460 | 5114 | 837 | 278 | 342 | 3.30E-31 | [n:vfu65015] [ac:u65015] [pn:pts permease for mannose subunit iipman] [gn:many] [or:vibrio furnissii] [db:genpept-bct] [de:vibrio furnissii pts permease for mannose subunits iiiman cterminal domain (manx), iipman (many), iibman (manz), and iiimann-termin |
| 24428138_c1_201 | 1461 | 5115 | 189 | 62 | 59 | 05 | [n:mfu89668] [ac:u89668] [gn:11] [or:macaca fasicularis papillomavirus] [db:genpept-vrl] [de:macaca fasicularis papillomavirus strain mfpv-a 11 gene, partialcds.] [nt:my09/11 segment] [le:<1] [re: |

TABLE 2-continued

| Orf | NT Seq ID | AA Seq ID | NT Orf length | AA Orf length | Score | Probability | Description |
|---|---|---|---|---|---|---|---|
| 24428150_c3_139 | 1462 | 5116 | 321 | 106 | 75 | 0.0066 | [ln:mdu81553] [acu81553] [gn:g2] [or:mycobacteriophage d29] [db:genpept-phg] [de:mycobacteriophage d29 dcmp deaminase (g1) gene, partial cds, g2,excisase (xis) and integrase (int) genes, complete cds.] [nt:similar to mycobacteriophage 15 gene 36 protein] |
| 24428387_c2_78 | 1463 | 5117 | 1068 | 355 | 146 | 9.90E-08 | [ac:p39776] [gn:codv] [or:bacillus subtilis] [de:probable integrase/recombinase codv] [sp:p39776] [db:swissprot] |
| 24428387_c3_201 | 1464 | 5118 | 2061 | 686 | 1656 | 1.90E-170 | [ac:c69621] [pn:fructose-1,6-bisphosphatase fbp] [gn:fbp] [or:bacillus subtilis] [db:pir] |
| 24429032_f3_20 | 1465 | 5119 | 1413 | 470 | 1283 | 6.40E-131 | [ac:f69806] [pn:rna methyltransferase homolog yfjo] [gn:yfjo] [or:bacillus subtilis] [db:pir] |
| 24429068_f3_11 | 1466 | 5120 | 198 | 65 | 50 | 0.13 | [ac:s04917;p10076] [pn:t-cell receptor delta chain precursor v-d-j region (clone kt041)] [cl:immunoglobulin v region:immunoglobulin homology] [or:homo sapiens] [sr:, man] [db:pir] |
| 24429177_c2_16 | 1467 | 5121 | 255 | 84 | 95 | 5.00E-05 | [ln:bpmrna] [ac:m86637] [pn:unknown] [or:brugia pahangi] [sr:brugia pahangi mixed adult cdna to mrna] [db:genpept-inv] [de:brugia pahangi mrna, orfl.] [nt:orf1; putative] [le:1] [re:459] [di:direct] |
| 24429637_c1_58 | 1468 | 5122 | 960 | 319 | 100 | 0.032 | [ln:af040720] [ac:af040720] [pn:xylosidase/arabinosidase] [gn:xsa] [or:selenomonas ruminantium] [db:genpept-bct] [de:selenomonas ruminantium xylosidase/arabinosidase (xsa) gene,complete cds.] [le:110] [re:1726] [di:direct] |
| 24429677_c3_56 | 1469 | 5123 | 1002 | 333 | 460 | 1.00E-43 | [ln:spcps14e] [ac:x85787] [pn:sss-1,4-galactosyltransferase] [gn:eps14] [fn:capsular polysaccharide synthesis] [or:streptococcus pneumoniae] [db:genpept-bct] [de:s.pneumoniae cps14 locus.] [le:9524 ] [re:10480] [di:direct] |
| 24429707_c2_37 | 1470 | 5124 | 246 | 82 | 60 | 0.23 | [ac:p14739] [gn:ugi] [or:bacteriophage pbs2] [de:uracil-dna glycosylase inhibitor] [sp:p14739] [db:swissprot] |
| 24429838_c3_84 | 1471 | 5125 | 312 | 103 | 117 | 2.30E-07 | [ac:p37188;p76412] [gn:gatb] [or:escherichia coli] [ec:2.7.1.69] [de:(ec 2.7.1.69)] [sp:p37188;p76412] [db:swissprot] |
| 24429838_f1_3 | 1472 | 5126 | 222 | 73 | 245 | 6.40E-21 | [ac:b56085] [pn:regulatory protein copz] [gn:copz] [cl:mercuric resistance operon regulatory protein] [or:enterococcus hirae] [db:pir] |
| 24430277_f2_13 | 1473 | 5127 | 207 | 68 | 58 | 0.07 | [ac:p10868] [gn:gamt] [or:rattus norvegicus] [sr:rat] [ec:2.1.1.2] [de:guanidinoacetate n-methyltransferase,] [sp:p10868] [db:swissprot] |
| 24430437_c1_38 | 1474 | 5128 | 453 | 150 | 72 | 0.44 | [ac:p06952] [gn:4] [or:bacteriophage pza] [de:early protein gp4] [sp:p06952] [db:swissprot] |
| 24430437_c2_37 | 1475 | 5129 | 486 | 161 | 432 | 9.70E-41 | [ln:lla j109] [ac:aj000109] [pn:gluthatione peroxidase] [gn:gpo] [or:lactococcus lactis] [db:genpept-bct] [de:lactococcus lactis carb and gpo genes.] [le:163] [re:636] [di:direct] |

TABLE 2-continued

| Orf | NT Seq ID | AA Seq ID | NT Orf length | AA Orf length | Score | Probability | Description |
|---|---|---|---|---|---|---|---|
| 24431511_c1_89 | 1476 | 5130 | 345 | 114 | 60 | 0.23 | [ln:walestcyb] [ac:t15560] [pn:acetyl-coa synthetase] [gn:faca] [or:macropus eugenii] [sr:macropus eugenii mammary gland cdna to mrna] [db:genpept-est1] [de:macropus eugenii expressed sequence tag of acetyl-coenzyme asynthetase (faca) mrna, 3' end.] [nt:p |
| 24431512_c1_38 | 1477 | 5131 | 921 | 306 | 782 | 7.90E-78 | [ac:g69657] [pn:trna isopentenylpyrophosphate transferase miaa] [gn:miaa] [or:bacillus subtilis] [db:pir] |
| 24431552_c3_145 | 1478 | 5132 | 1074 | 357 | 101 | 0.01 | [ac:p94475] [gn:yead] [or:bacillus subtilis] [de:hypothetical 30.5 kd protein in gabp-guaa intergenic region] [sp:p94475] [db:swissprot] |
| 24431567_f3_58 | 1479 | 5133 | 912 | 303 | 322 | 4.40E-29 | [ac:f69795] [pn:conserved hypothetical protein yerq] [gn:yerq] [or:bacillus subtilis] [db:pir] |
| 24431587_f3_65 | 1480 | 5134 | 2022 | 673 | 2685 | 1.70E-279 | [ac:p39046] [or:enterococcus hirae] [ec:3.5.1.28] [de:(muramidase-2)] [sp:p39046] [db:swissprot] |
| 24431590_c2_47 | 1481 | 5135 | 1311 | 436 | 811 | 6.70E-81 | [ac:p29822] [gn:lacе] [or:agrobacterium radiobacter] [de:lactose-binding protein precursor (lbp)] [sp:p29822] [db:swissprot] |
| 24432140_c3_179 | 1482 | 5136 | 591 | 196 | 421 | 1.40E-39 | [ac:e69999] [pn:hypothetical protein ytqb] [gn:ytqb] [or:bacillus subtilis] [db:pir] |
| 24432312_c1_21 | 1483 | 5137 | 186 | 61 | 46 | 0.5 | [ac:p05642] [gn:petb] [or:zea mays] [sr:,maize] [ec:1.10.99.1] [de:cytochrome b6,] [sp:p05642] [db:swissprot] |
| 24432837_c2_45 | 1484 | 5138 | 579 | 192 | 68 | 0.35 | [ac:p07079] [gn:y04e:55.5] [or:bacteriophage f4] [de:hypothetical 11.8 kd protein in gpS5-nrdg intergenic region] [sp:p07079] [db:swissprot] |
| 24432937_c1_116 | 1485 | 5139 | 330 | 109 | 295 | 3.20E-26 | [ln:eftu09422] [ac:u09422] [or:enterococcus faecalis] [db:genpept-bct] [de:enterococcus faecalis ds16 transposon tn916, (tet(m)). (xis-tn),(int-tn) genes, orfs 1–24, complete cds, complete sequence.] [nt:orf23] [le:336] [re:650] [di:direct] |
| 24432952_c3_36 | 1486 | 5140 | 2145 | 714 | 321 | 1.60E-26 | [ln:hvu95372] [ac:u95372] [pn:hydantoinase] [or:haloferax volcanii] [db:genpept-bct] [de:haloferax volcanii plasmid phv3 aminotransferase gene, partial cds,dehydrogenase and hydantoinase genes, complete cds, andoligopeptide abc transporter gene, partial c |
| 24433188_c3_20 | 1487 | 5141 | 2379 | 793 | 499 | 2.70E-47 | [ln:d85082] [ac:d85082] [pn:yffx] [or:bacillus subtilis] [sr:bacillus subtilis dna] [db:genpept-bct] [de:bacillus subtilis dna, genome sequence, 79 to 81 degree region.] [le:7094] [re:8926] [di:direct] |
| 24433407_c3_26 | 1488 | 5142 | 741 | 246 | 683 | 2.50E-67 | [ac:q46938] [gn:kdui] [or:escherichia coli] [ec:5.3.1.17] [de:(5-keto-4-deoxyuronate isomerase) (dki isomerase)] [sp:q46938] [db:swissprot] |

TABLE 2-continued

| Orf | NT Seq ID | AA Seq ID | NT Orf length | AA Orf length | Score | Probability | Description |
|---|---|---|---|---|---|---|---|
| 24433468_c3_123 | 1489 | 5143 | 834 | 277 | 340 | 5.40E-31 | [n:vfu65015] [ac:u65015] [pn:pts permease for mannose subunit iipman] [gn:many] [or:vibrio furnissii] [db:genpept-bct] [de:vibrio furnissii pts permease for mannose subunits iiiman cterminal domain (manx), iipman (many), iibman (manz), and iiimann-termin |
| 244390_c2_34 | 1490 | 5144 | 1020 | 339 | 1533 | 2.10E-157 | [ac:f64626] [pn:gmp reductase] [or:helicobacter pylori] [db:pir] |
| 24470375_f3_24 | 1491 | 5145 | 261 | 86 | 72 | 0.039 | [n:ecorhsd] [ac:m29719] [or:escherichia coli] [sr:e.coli (k12) cell line ch1330 dna, clone pas3122] [db:genpept-bct] [de:e.coli rhsd gene encoding rshd protein, 3' end.] [nt:rhsd protein] [ec:<1] [re:589] [di:direct] |
| 24473400_c1_40 | 1492 | 5146 | 726 | 241 | 182 | 3.00E-14 | [ac:o06995] [gn:yvdm] [or:bacillus subtilis] [ec:5.4.2.6] [de:putative beta-phosphoglucomutase,] [sp:o06995] [db:swissprot] |
| 24475937_c3_26 | 1493 | 5147 | 495 | 164 | 162 | 1.20E-11 | [ac:jc2110] [pn:tropomyosin-related protein:strp protein] [or:saccharomyces cerevisiae] [db:pir] |
| 24476592_f2_17 | 1494 | 5148 | 3204 | 1067 | 1537 | 7.80E-158 | [n:af034786] [ac:af034786] [pn:restriction subunit] [gn:hsdr] [fn:lldi type i restriction modification] [or:lactococcus lactis bv. diacetylactis] [db:genpept-bct] [de:lactococcus lactis bv. diacetylactis, plasmid pnd861, lldi type irestriction subunit(h |
| 24476713_c1_190 | 1495 | 5149 | 255 | 84 | 179 | 6.30E-14 | [ac:b69770] [pn:conserved hypothetical protein ydas] [gn:ydas] [or:bacillus subtilis] [db:pir] |
| 24478402_c2_61 | 1496 | 5150 | 3696 | 1231 | 3608 | 0 | [ac:s01997:s01836:s35903 :s21414:a04461:s36947] [pn:pyruvate (flavodoxin) dehydrogenase,] [gn:nifj] [cl:pyruvate (flavodoxin) dehydrogenase:ferredoxin 2[4fe-4s] homology] [or:klebsiella pneumoniae] [ec:1.2.99.—] [db:pir] |
| 24478417_f2_36 | 1497 | 5151 | 525 | 174 | 310 | 8.20E-28 | [ac:p45862] [gn:ywjb] [or:bacillus subtilis] [de:hypothetical 19.6 kd protein in acda 5'region] [sp:p45862] [db:swissprot] |
| 24480062_c1_33 | 1498 | 5152 | 876 | 291 | 832 | 4.00E-83 | [ac:p77834] [gn:deod:puna] [or:bacillus stearothermophilus] [ec:2.4.2.1] [de:(pnp)] [sp:p77834] [db:swissprot] |
| 24484390_c1_26 | 1499 | 5153 | 885 | 294 | 606 | 3.50E-59 | [ac:p52998] [gn:panc] [or:bacillus subtilis] [ec:6.3.2.1] [de:[pantoate activating enzyme]] [sp:p52998] [db:swissprot] |
| 24484432_f1_22 | 1500 | 5154 | 345 | 114 | 109 | 1.60E-06 | [n:bphiadh] [ac:z97974] [pn:rad protein] [gn:rad] [fn:transcriptional repressor protein] [or:bacteriophage phiadh] [db:genpept-una] [de:bacteriophage phiadh lys, hol, intg, rad,and tec genes.] [le:5308] [re:5634] [di:complement |
| 24484461_f1_4 | 1501 | 5155 | 189 | 62 | 56 | 0.088 | [n:cey6l68a] [ac:a1021501] [pn:y6l68a.1] [or:caenorhabditis elegans] [db:genpept-inv] [de:caenorhabditis elegans cosmid y6l68a, complete sequence.] [nt:protein predicted using genefinder] [le:4704:5408:6160] [re:5359:5805:6388] [di:complement:join] |

TABLE 2-continued

| Orf | NT Seq ID | AA Seq ID | NT Orf length | AA Orf length | Score | Probability | Description |
|---|---|---|---|---|---|---|---|
| 24485258_c1_43 | 1502 | 5156 | 444 | 147 | 675 | 1.70E-66 | [ac:p43453] [gn:atpc] [or:enterococcus faecalis] [sr:streptococcus faecalis] [de:atp synthase epsilon chain,] [sp:p43453] [db:swissprot] [ec:3.6.1.34] |
| 24485962_f1_2 | 1503 | 5157 | 816 | 271 | 577 | 4.20E-56 | [ac:p54716] [gn:glv:g;lv-1] [or:bacillus subtilis] [ec:3.2.1.86] [de:probable 6-phospho-beta glucosidase,] [sp:p54716] [db:swissprot] |
| 24486693_c2_71 | 1504 | 5158 | 309 | 102 | 477 | 1.70E-45 | [ln:eharp(tou] [ac:z50854] [pn:arpt] [gn:arpt] [or:enterococcus hirae] [dbgenpept-bct] [de:e.hirae arp[q,r,s,t,u] genes,] [le:857] [re:1153] [di:direct] |
| 24487812_c2_156 | 1505 | 5159 | 462 | 153 | 119 | 1.40E-07 | [ln:bc332ab] [ac:y099323] [pn:hypothetical protein] [gn:332b] [fn:unknown] [or:bacillus cereus] [dbgenpept-bct] [de:b.cereus dna, two genes with unknown function.] [le:761] [re:1198] [di:direct] |
| 24488941_f1_1 | 1506 | 5160 | 189 | 62 | 56 | 0.49 | [ln:baccitb] [ac:m16776] [or:bacillus subtilis] [sr:b.subtilis (strain 168) dna, clone pmr41] [dbgenpept-bct] [de:b.subtilis aconitase gene (citb) promoter region and 5' end.] [nt:aconitase] [le:235] [re: |
| 24489176_f1_13 | 1507 | 5161 | 348 | 115 | 481 | 6.20E-46 | [ln:af029727] [ac:af029727] [or:enterococcus faecium] [dbgenpept-bct] [de:enterococcus faecium insertion sequence is1485, complete sequence.] [nt:putative; orfa] [le:76] [re:366] [di:direct] |
| 24489176_f2_6 | 1508 | 5162 | 348 | 115 | 481 | 6.20E-46 | [ln:af029727] [ac:af029727] [or:enterococcus faecium] [dbgenpept-bct] [de:enterococcus faecium insertion sequence is1485, complete sequence.] [nt:putative; orfa] [le:76] [re:366] [di:direct] |
| 24489176_f3_12 | 1509 | 5163 | 348 | 115 | 481 | 6.20E-46 | [ln:af029727] [ac:af029727] [or:enterococcus faecium] [dbgenpept-bct] [de:enterococcus faecium insertion sequence is1485, complete sequence.] [nt:putative; orfa] [le:76] [re:366] [di:direct] |
| 24489176_f3_20 | 1510 | 5164 | 348 | 115 | 481 | 6.20E-46 | [ln:af029727] [ac:af029727] [or:enterococcus faecium] [dbgenpept-bct] [de:enterococcus faecium insertion sequence is1485, complete sequence.] [nt:putative; orfa] [le:76] [re:366] [di:direct] |
| 24489717_c2_48 | 1511 | 5165 | 717 | 238 | 279 | 4.50E-24 | [ac:s60902:s49238:s44071] [pn:cdp-ribitol pyrophosphorylase] [or:haemophilus influenzae] [db:pir] |
| 24491713_c2_14 | 1512 | 5166 | 480 | 159 | 580 | 2.00E-56 | [ac:af015453] [ac:af015453] [pn:surface located protein] [or:lactobacillus rhamnosus] [dbgenpept-bct] [de:lactobacillus rhamnosus 6-phospho-beta-glucosidase homolog gene,partial cds; gntr transcriptional regulator homolog and surfacelocated protein genes |

TABLE 2-continued

| Orf | NT Seq ID | AA Seq ID | NT Orf length | AA Orf length | Score | Probability | Description |
|---|---|---|---|---|---|---|---|
| 24492178_f3_32 | 1513 | 5167 | 183 | 60 | 74 | 0.0088 | [ac:p32760] [gn:ptn] [or:gallus gallus] [sr:chicken] [de:specific factor 1) (osf-1) (heparin-binding neutrophic factor) (hbnf) [sp:p32760] [db:swissprot] |
| 24492338_c1_23 | 1514 | 5168 | 1158 | 385 | 1495 | 2.20E-153 | [ac:p56069] [gn:metb:hp0106] [or:helicobacter pylori] [sr:campylobacter pylori] [ec:4.2.99.9] [de:(thiol)-lyase)] [sp:p56069] [db:swissprot] |
| 24492338_c2_125 | 1515 | 5169 | 711 | 236 | 548 | 5.00E-53 | [ln:llu93364] [ac:u93364] [pn:epsb] [gn:epsb] [or:lactococcus lactis cremoris] [db:genpept-bct] [de:lactococcus lactis cremoris plasmid pnz4000 insertion sequenceis982 putative transposase gene and eps gene cluster(epsrxabcdefghijk), complete cds.] [le:3 |
| 24493750_c2_42 | 1516 | 5170 | 660 | 219 | 62 | 0.47 | [ln:hivjgv96] [ac:z68613] [pn:vpu protein] [gn:vpu] [or:human immunodeficiency virus type 1] [dbgenpept-vr1] [de:hiv-1 dna vpu gene. (patient 4663, intravenous drug user,scottish).] [le:16 [re:261] [di:direct] |
| 24494012_c2_28 | 1517 | 5171 | 744 | 247 | 578 | 3.30E-56 | [ac:j06612] [pn:trna-pseudouridine synthase i.] [gn:hist] [or:bacillus sp.] [ec:5.4.99.12] [db:pir] |
| 24495251_c1_39 | 1518 | 5172 | 225 | 74 | 77 | 0.013 | [ac:s49039] [pn:hypothetical protein 2] [or:legionella pneumophila] [db:pir] |
| 24495256_c2_34 | 1519 | 5173 | 225 | 74 | 71 | 0.047 | [ac:p50730] [gn:ypbd] [or:bacillus subtilis] [de:hypothetical 22.0 kd protein in recq-cmk intergenic region] [sp:p50730] [db:swissprot] |
| 24495303_f1_4 | 1520 | 5174 | 720 | 239 | 413 | 1.00E-38 | [ac:p54501] [gn:yqgx] [or:bacillus subtilis] [de:hypothetical 23.2 kd protein in soda-comga intergenic region] [sp:p54501] [db:swissprot] |
| 24495443_c3_100 | 1521 | 5175 | 1164 | 387 | 1291 | 9.10E-132 | [ac:c39435] [pn:mannitol-1-phosphate 5-dehydrogenase, mtld] [or:enterococcus faecalis] [ec:1.1.1.17] [db:pir] |
| 24495467_c2_65 | 1522 | 5176 | 360 | 119 | 147 | 1.50E-10 | [ac:p33645] [gn:chpa:mazf:chpak] [or:escherichia coli] [de:pemk-like protein 1 (mazf protein)] [sp:p33645] [db:swissprot] |
| 24495902_c3_132 | 1523 | 5177 | 660 | 219 | 115 | 1.40E-05 | [ac:p56296] [gn:atpf] [or:chlorella vulgaris] [ec:3.6.1.34] [de:atp synthase b chain, (subunit i)] [sp:p56296] [db:swissprot] |
| 24500300_c2_68 | 1524 | 5178 | 225 | 74 | 69 | 0.13 | [ln:lpatovgns] [ac:x94434] [pn:plni] [gn:plni] [fn:immunity protein] [or:lactobacillus plantarum] [db:genpept-bct] [de:l.plantarum pln[a,b,c,d,e,f,g,h,i,j,k,l,m,n,o,p,r,s,t,u,v] genesand orf1.] [nt:putative] [le:9372] [re:10145] [di:complement] |
| 24500962_c1_61 | 1525 | 5179 | 1065 | 354 | 577 | 4.20E-56 | [ac:a69991] [pn:conserved hypothetical protein yter] [gn:yter] [or:bacillus subtilis] [db:pir] |
| 24502061_f2_14 | 1526 | 5180 | 837 | 278 | 124 | 2.50E-05 | [ac:h69873] [pn:conserved hypothetical protein ylbc] [gn:ylbc] [or:bacillus subtilis] [db:pir] |
| 24504625_f3_7 | 1527 | 5181 | 201 | 66 | 49 | 0.042 | [ln:ab001437] [ac:ab001437] [pn:motor domain of kif9] [or:mus musculus] [sr:mus musculus (strain:ier) 4 week cdna to mrna] [db:genpept-rod] [de:mus musculus mrna for motor domain of kif9, partial cds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 24507937_f2_11 | 1528 | 5182 | 861 | 287 | 756 | 4.50E-75 | [ln:palrgene] [acc:y08941] [pn:*alanine racemase*] [gn:alr] [or:*lactobacillus plantarum*] [db:genpept-bct] [ec:5.1.1.1] [de:*l.plantarum* alr gene.] [le:226] [re:1353] [di:direct] |
| 24508437_c3_46 | 1529 | 5183 | 528 | 175 | 107 | 3.80E-05 | [acc:s07658] [pn:hypothetical protein 5] [or:*salmonella typhimurium*] [db:pir] |
| 24508502_c2_21 | 1530 | 5184 | 1185 | 394 | 707 | 7.00E-70 | [acc:p42907] [gn:agas] [or:*escherichia coli*] [de:agas protein] [sp:p42907] [db:swissprot] |
| 24508562_c2_139 | 1531 | 5185 | 240 | 79 | 63 | 0.14 | [ln:cel.c06g3] [acc:u61947] [gn:c06g3.12] [or:*caenorhabditis elegans*] [sr:*caenorhabditis elegans* strain=bristol n2] [db:genpept-inv] [de:*caenorhabditis elegans* cosmid c06g3.] [le:40173:41889] [re:40505:41939] [di:complementjoin] |
| 24508562_f1_14 | 1532 | 5186 | 693 | 230 | 330 | 6.30E-30 | [acc:p54439] [gn:ytkl] [or:*bacillus subtilis*] [de:hypothetical nad(p)h oxidoreductase in bltr-spoiic intergenic region] [sp:p54439] [db:swissprot] |
| 24509706_f3_15 | 1533 | 5187 | 549 | 182 | 283 | 6.00E-25 | [ln:pau45309] [acc:u45309] [pn:2-phosphonoacetaldehyde hydrolase] [or:*pseudomonas aeruginosa*] [db:genpept-bct] [de:*pseudomonas aeruginosa* 2-phosphonoacetaldehyde hydrolase gene,complete cds.] [nt:phosphonatase] [le:98] [re:925] [di:direct] |
| 24510787_c2_10 | 1534 | 5188 | 354 | 117 | 247 | 3.90E-21 | [acc:d70065] [pn:hydroxymyristoyl-(acyl carrier protein) de homolog ywpb] [gn:ywpb] [or:*bacillus subtilis*] [db:pir] |
| 245188_c3_37 | 1535 | 5189 | 393 | 130 | 163 | 3.10E-12 | [acc:p20370] [gn:pcaC] [or:*acinetobacter calcoaceticus*] [ec:4.1.1.44] [de:4-carboxymuconolactone decarboxylase, (cmd)] [sp:p20370] [db:swissprot] |
| 245287_c1_37 | 1536 | 5190 | 288 | 95 | 65 | 0.15 | [ln:yeinvaflx] [acc:z48169] [gn:flgm] [or:*yersinia enterocolitica*] [db:genpept-bct] [de:*y.enterocolitica* inva gene and flagellar gene cluster.] [le:7679] [re:7978] [di:complement] |
| 2457082_f2_57 | 1537 | 5191 | 1098 | 365 | 395 | 8.10E-37 | [acc:p42975] [gn:bira] [or:*bacillus subtilis*] [ec:6.3.4.15] [de:coa-carboxylase) synthetase). (biotin--protein ligase)] [sp:p42975] [db:swissprot] |
| 24609427_c1_23 | 1538 | 5192 | 912 | 303 | 631 | 7.90E-62 | [acc:s42927] [pn:probable transport protein] [or:*staphylococcus epidermidis*] [db:pir] |
| 24615637_c3_72 | 1539 | 5193 | 381 | 126 | 418 | 3.00E-39 | [acc:p94556] [gn:race] [or:*bacillus subtilis*] [ec:5.1.1.3] [de:glutamate racemase,] [sp:p94556] [db:swissprot] |
| 24616000_c2_54 | 1540 | 5194 | 849 | 282 | 117 | 3.60E-05 | [acc:p44052] [gn:hi0787] [or:*haemophilus influenzae*] [de:hypothetical protein hi0787] [sp:p44052] [db:swissprot] |
| 24616302_c3_81 | 1541 | 5195 | 537 | 178 | 192 | 2.60E-15 | [ln:bssppl] [acc:x67865] [or:bacteriophage sppl] [db:genpept-phg] [de:*b.subtilis* phage sppl dna sequence coding for products required for replication initiation.] [nt:orf36.1] [le:3263] [re:3754] [di:direct] |
| 24617188_c3_48 | 1542 | 5196 | 621 | 206 | 485 | 2.30E-46 | [acc:p54570] [gn:yqkg] [or:*bacillus subtilis*] [de:hypothetical 21.0 kd protein in glnq-ansr intergenic region] [sp:p54570] [db:swissprot] |

TABLE 2-continued

| Orf | NT Seq ID | AA Seq ID | NT Orf length | AA Orf length | Score | Probability | Description |
|---|---|---|---|---|---|---|---|
| 24619030_c1_45 | 1543 | 5197 | 513 | 170 | 153 | 3.60E-11 | [ac:q01467] [gn:mred:rodb] [or:*bacillus subtilis*] [de:rod shape-determining protein mred] [sp:q01467] [db:swissprot] |
| 24620250_c1_59 | 1544 | 5198 | 837 | 278 | 81 | 0.41 | [ac:p45076] [gn:hi1151] [or:*haemophilus influenzae*] [de:hypothetical protein hi1151] [sp:p45076] [db:swissprot] |
| 24620414_c3_6 | 1545 | 5199 | 660 | 219 | 572 | 1.40E-55 | [ln:ecouw82] [ac:110328] [gn:f270] [fn:unknown] [or:*escherichia coli*] [sr:*escherichia coli* k12 strain mg1655; lambda clones ec14–52] [db:genpept-bct] [de.*e. coli*; the region from 81.5 to 84.5 minutes.] [le:65538] [re:66350] [di:complement] |
| 24620461_f1_8 | 1546 | 5200 | 2205 | 734 | 1994 | 2.90E-206 | [ac:p28903] [gn:nrdd] [or:*escherichia coli*] [ec:1.17.4.2] [de:anaerobic ribonucleoside-triphosphate reductase,] [sp:p28903] [db:swissprot] |
| 24620955_c1_28 | 1547 | 5201 | 273 | 90 | 226 | 6.60E-19 | [ln:mtv004] [ac:a1009198] [pn:hypothetical protein mtv004.15] [gn:mtv004.15] [or:*mycobacterium tuberculosis*] [db:genpept-bct] [de:*mycobacterium tuberculosis* sequence v004.] [nt:mtv004.15, unknown, len:85 aa] [le:31648] [re:31905] [di:direct] |
| 24625702_c3_143 | 1548 | 5202 | 378 | 125 | 49 | 1 | [ln:styflga] [ac:d25292] [pn:flgb protein] [gn:flgb] [fn:rod protein] [or:*salmonella typhimurium*] [sr:*salmonella typhimurium* (strain:lt2) dna] [db:genpept-bct] [de:*salmonella typhimurium* flg (a,b,m,n) and orf of (2,3) genes forflagella.] [nt:author-given pro |
| 24634687_c1_74 | 1549 | 5203 | 642 | 213 | 721 | 2.30E-71 | [ac:p47848] [gn:tdk] [or:*streptococcus gordonii challis*] [ec:2.7.1.21] [de:thymidine kinase,] [sp:p47848] [db:swissprot] |
| 24636442_c1_123 | 1550 | 5204 | 216 | 71 | 52 | 0.075 | [ln:llhpttma] [ac:x69123] [or:*lactococcus lactis*] [db:genpept-bct] [de:*l.lactis* genes hpt and tma.] [nt:partial orf] [le:<1] [re:598] [di:direct] |
| 24636592_c3_37 | 1551 | 5205 | 2091 | 696 | 1619 | 1.60E-166 | [ac:p54381] [gn:glys] [or:*bacillus subtilis*] [ec:6.1.1.14] [de:beta chain) (g|yrs)] [sp:p54381] [db:swissprot] |
| 24640707_c2_56 | 1552 | 5206 | 336 | 111 | 331 | 4.90E-30 | [ac:p37538] [gn:yaaq] [or:*bacillus subtilis*] [de:hypothetical 12.0 kd protein in xpac-abrb intergenic region] [sp:p37538] [db:swissprot] |
| 24640875_c1_130 | 1553 | 5207 | 687 | 228 | 126 | 5.30E-06 | [ac:jh0204] [pn:hypothetical 30.5k protein] [or:*enterococcus faecalis*] [db:pir] |
| 24640875_f2_18 | 1554 | 5208 | 2151 | 716 | 488 | 1.90E-46 | [ac:p13692] [or:*enterococcus faecium*] [sr:*streptococcus faecium*] [de:p54 protein precursor] [sp:p13692] [db:swissprot] |
| 24641015_c1_66 | 1555 | 5209 | 363 | 120 | 75 | 0.0066 | [ac:g69441] [pn:glutaredoxin (grx-1) homolog] [or:*archaeoglobus fulgidus*] [db:pir] |
| 24641250_f1_3 | 1556 | 5210 | 435 | 144 | 189 | 5.50E-15 | [ln:lbphigle] [ac:x98106] [gn:1orf143] [or:bacteriophage phigle] [db:genpept-phg] [de:lactobacillus bacteriophage phigle complete genomic dna.] [le:1153] [re:1584] [di:direct] |
| 24641407_c1_47 | 1557 | 5211 | 510 | 169 | 63 | 0.27 | [ln:bormajospr] [ac:119702] [or:*borrelia burgdorferi*] [sr:*borrelia burgdorferi* (strain g2) dna] [db:genpept-bct] [de:*borrelia burgdorferi* outer surface protein a (ospa) and outersurface protein b (ospb) genes, complete cds.] [nt:orf4] [le:1388] [re:1597] |

TABLE 2-continued

| Orf | NT Seq ID | AA Seq ID | NT Orf length | AA Orf length | Score | Probability | Description |
|---|---|---|---|---|---|---|---|
| 24641942_c3_67 | 1558 | 5212 | 558 | 185 | 525 | 1.40E-50 | [ac:p11100] [gn:lacd] [or:*staphylococcus aureus*] [ec:4.1.—.—] [de:tagatose 1,6-diphosphate aldolase.] [sp:p11100] [db:swissprot] |
| 24642162_c1_46 | 1559 | 5213 | 561 | 186 | 232 | 1.50E-19 | [ac:p43641] [gn:mnim] [or:mycoplasma sp] [ec:2.1.1.72] [de:*methyltransferase muni*] (*m.muni*)] [sp:p43641] [db:swissprot] |
| 24642333_c2_60 | 1560 | 5214 | 618 | 205 | 72 | 0.78 | [ln:ss282017] [ac:z82017] [gn:unknown] [or:*sus scrofa*] [sr:pig] [db:genpept-est7] [de:*s.scrofa* mrna; expressed sequence tag (5'; clone c12c06).] [nt:similar to eukaryotic initiation factor 4 gamma] [le:<1] [re: |
| 24645157_f3_3 | 1561 | 5215 | 639 | 212 | 277 | 2.60E-24 | [ac:g69838] [pn:hypothetical protein yisx] [gn:yisx] [or:*bacillus subtilis*] [db:pir] |
| 24645311_f2_2 | 1562 | 5216 | 732 | 243 | 356 | 1.10E-32 | [ln:stalacr] [ac:m32103] [or:*staphylococcus aureus*] [sr:*staphylococcus aureus* (strain 8325-4) dna] [db:genpept-bct] [de:*staphylococcus aureus* lac repressor (lacr) gene, complete cds and *laca* repressor (laca), partial cds.] [nt:orf-27] [le:76] [re:807] [di: |
| 24645328_f2_5 | 1563 | 5217 | 1734 | 577 | 691 | 3.50E-68 | [ac:p46921] [gn:opuab] [or:*bacillus subtilis*] [de:glycine betaine transport system permease protein opuab] [sp:p46921] [db:swissprot] |
| 24647250_c1_41 | 1564 | 5218 | 969 | 322 | 791 | 8.80E-79 | [ln:bmgluckin] [ac:aj000005] [pn:glucose kinase] [gn:glk] [or:*bacillus megaterium*] [db:genpept-bct] [ec:2.7.1.2] [de:*bacillus megaterium* glk gene.] [le:270] [re:1244] [di:direct] |
| 24647826_f3_62 | 1565 | 5219 | 1464 | 487 | 755 | 5.70E-75 | [ln:cpu15027] [ac:u15027] [pn:tnpx] [gn:tnpx] [fn:site-specific recombinase involved in the] [or:*clostridium perfringens*] [db:genpept-bct] [de:*clostridium perfringens* transposon tn4451 site-specific recombinase(tnpx), chloramphenicol acetyltransferase (ca |
| 24648265_c1_69 | 1566 | 5220 | 813 | 270 | 317 | 1.50E-28 | [ac:p45247] [gn:thi1549] [or:*haemophilus influenzae*] [de:hypothetical abc transporter atp-binding protein hi1549] [sp:p45247] [db:swissprot] |
| 24648381_c1_69 | 1567 | 5221 | 636 | 211 | 650 | 7.70E-64 | [ac:p25972] [gn:pyre:pyrx] [or:*bacillus subtilis*] [ec:2.4.2.10] [de:orotate phosphoribosyltransferase, (oprt) (optase)] [sp:p25972] [db:swissprot] |
| 24648438_c3_201 | 1568 | 5222 | 1011 | 336 | 1112 | 8.50E-113 | [ln:efti09422] [ac:u09422] [or:*enterococcus faecalis*] [db:genpept-bct] [de:*enterococcus faecalis* ds16 transposon tn916, (tet(m)), (xis-tn),(int-tn) genes, orfs 1–24, complete cds, complete sequence.] [nt:orf14] [le:9816] [re:10817] [di:direct] |
| 24648438_f2_36 | 1569 | 5223 | 768 | 255 | 151 | 6.00E-09 | [ac:p39842] [gn:bltr:bmtr:bmr2r] [or:*bacillus subtilis*] [de:multidrug-efflux transporter 2 regulator] [sp:p39842] [db:swissprot] |
| 24648452_c2_19 | 1570 | 5224 | 891 | 296 | 119 | 0.00012 | [ln:phn25682] [ac:u25682] [pn:lpp38] [or:*pasteurella haemolytica*] [db:genpept-bct] [de:*pasteurella haemolytica* 38 kda lipoprotein (lpp38) gene, completecds.] [nt:38 kda lipoprotein] [le:123] [re:1217] [di:direct] |

TABLE 2-continued

| Orf | NT Seq ID | AA Seq ID | NT Orf length | AA Orf length | Score | Probability | Description |
|---|---|---|---|---|---|---|---|
| 24648452_f1_1 | 1571 | 5225 | 906 | 301 | 963 | 5.20E-97 | [ac:h69643] [pn:isoleucyl-trna synthetase iles] [gn:iles] [or:*bacillus subtilis*] [db:pir] |
| 24648552_c2_63 | 1572 | 5226 | 801 | 266 | 662 | 4.10E-65 | [ac:a70001] [pn:abc transporter (atp-binding protein) homolog ytsc] [gn:ytsc] [or:*bacillus subtilis*] [db:pir] |
| 24648563_f3_32 | 1573 | 5227 | 780 | 259 | 315 | 2.40E-28 | [n:ac001181] [ac:ae001181:ae000783] [pn:xylose operon regulatory protein (xylr-2)] [gn:bb0831] [or:*borrelia burgdorferi*] [sr:lyme disease spirochete] [db:genpept-bct] [de:*borrelia burgdorferi* (section 67 of 70) of the complete genome.] [nt:similar to pid |
| 24648591_f3_24 | 1574 | 5228 | 1368 | 455 | 1890 | 3.10E-195 | [n:ehy13922] [ac:y13922:y15222] [gn:murd] [or:*enterococcus hirae*] [db:genpept-bct] [de:*enterococcus hirae* mraz, pbp3s, mray, murd, murg, ftsq and ftsagenes, mraw, yllc and ftsz partial genes.] [le:5073] [re:6455] [di:direct] |
| 24649055_c3_32 | 1575 | 5229 | 3135 | 1044 | 618 | 2.50E-57 | [ac:p13458] [gn:sbcc] [or:*escherichia coli*] [de:exonuclease sbcc] [sp:p13458] [db:swissprot] |
| 24649187_c2_36 | 1576 | 5230 | 534 | 177 | 141 | 6.70E-10 | [ac:p54396] [gn:ypmb] [or:*bacillus subtilis*] [de:hypothetical 17.9 kd protein in ding-aspb intergenic region] [sp:p54396] [db:swissprot] |
| 24650186_c1_43 | 1577 | 5231 | 474 | 157 | 242 | 1.30E-20 | [ac:p70063] [pn:hypothetical protein ywna] [gn:ywna] [or:*bacillus subtilis*] [db:pir] |
| 24650288_c3_34 | 1578 | 5232 | 225 | 75 | 101 | 1.20E-05 | [ac:e70043] [pn:hypothetical protein yvlc] [gn:yvlc] [or:*bacillus subtilis*] [db:pir] |
| 24650302_f2_20 | 1579 | 5233 | 1173 | 390 | 891 | 2.20E-89 | [ac:c33496] [pn:hisc homolog] [or:*bacillus subtilis*] [db:pir] |
| 24650313_f1_8 | 1580 | 5234 | 2157 | 718 | 1396 | 6.80E-143 | [ac:p10524] [gn:pena] [or:*streptococcus pneumoniae*] [de:penicillin-binding protein 2b] [sp:p10524] [db:swissprot] |
| 24650462_f3_19 | 1581 | 5235 | 699 | 232 | 128 | 1.40E-06 | [ac:c69696] [pn:hypothetical protein yoak] [gn:yoak] [or:*bacillus subtilis*] [db:pir] |
| 24651535_c2_67 | 1582 | 5236 | 1479 | 492 | 1596 | 4.40E-164 | [ac:d70008] [pn:nicotinate phosphoribosyltransferase homolog yuek] [gn:yuek] [or:*bacillus subtilis*] [db:pir] |
| 24651587_c2_96 | 1583 | 5237 | 828 | 275 | 542 | 2.10E-52 | [ac:p26382] [gn:levg] [or:*bacillus subtilis*] [de:(p30)] [sp:p26382] [db:swissprot] |
| 24662501_f3_31 | 1584 | 5238 | 693 | 230 | 146 | 1.70E-08 | [ac:p77245] [gn:yfel] [or:*escherichia coli*] [de:hypothetical 31.2 kd protein in cysp-amia intergenic region] [sp:p77245] [db:swissprot] |
| 24664000_f1_5 | 1585 | 5239 | 1023 | 340 | 412 | 1.30E-38 | [ac:p39325] [gn:yftq] [or:*escherichia coli*] [de:32.1 kd protein in ppa-fbp intergenic region precursor] [sp:p39325] [db:swissprot] |
| 24664217_f3_36 | 1586 | 5240 | 678 | 225 | 715 | 1.00E-70 | [ac:f69670] [pn:glycine betaine/carnitine/choline abc transporter (membrane p) opucd] [gn:opucd] [or:*bacillus subtilis*] [db:pir] |
| 24664692_c3_68 | 1587 | 5241 | 3729 | 1242 | 2078 | 3.70E-215 | [ac:p23478] [gn:adda] [or:*bacillus subtilis*] [de:atp-dependent nuclease subunit a] [sp:p23478] [db:swissprot] |

TABLE 2-continued

| Orf | NT Seq ID | AA Seq ID | NT Orf length | AA Orf length | Score | Probability | Description |
|---|---|---|---|---|---|---|---|
| 24664812_c1_175 | 1588 | 5242 | 756 | 251 | 137 | 3.50E-09 | [ln:celc06g1] [ac:u41014] [gn:c06g1.2] [or:caenorhabditis elegans] [sr:caenorhabditis elegans strain=bristol n2] [db:genpept-inv] [de:caenorhabditis elegans cosmid c06g1.] [le:12433:12856] [re:12799:13037] [di:direct|join] |
| 24666026_c2_23 | 1589 | 5243 | 627 | 208 | 567 | 4.80E-55 | [ac:p46340] [gn:yvgil] [or:bacillus subtilis] [de:region (orf73)] [sp:p46340] [db:swissprot] |
| 24666031_f1_1 | 1590 | 5244 | 1602 | 533 | 739 | 2.90E-73 | [ac:b70033] [pn:transporter homolog yvdb] [gn:yvdb] [or:bacillus subtilis] [db:pir] |
| 24667017_c3_15 | 1591 | 5245 | 291 | 96 | 71 | 0.18 | [ln:hsu46571] [ac:u46571] [pn:tetratricopeptide repeat protein] [gn:tpr2] [or:homo sapiens] [sr:human] [db:genpept-pri2] [de:human tetratricopeptide repeat protein (tpr2) mrna, complete cds.] [nt:related to p58] [le:27] [re:1481] [di:direct] |
| 24667087_c3_200 | 1592 | 5246 | 1281 | 426 | 470 | 9.10E-45 | [ac:o07523] [gn:yhap] [or:bacillus subtilis] [de:hypothetical 45.4 kd protein in sspb-prsa intergenic region] [sp:o07523] [db:swissprot] |
| 24667250_c2_20 | 1593 | 5247 | 1431 | 476 | 661 | 5.30E-65 | [ac:d69159] [pn:methyl coenzyme m reductase system, component a2 homolog] [gn:mth454] [or:methanobacterium thermoautotrophicum] [db:pir] |
| 24667313_c2_104 | 1594 | 5248 | 1695 | 564 | 1215 | 1.00E-123 | [ac:h69884] [pn:conserved hypothetical protein ymfa] [gn:ymfa] [or:bacillus subtilis] [db:pir] |
| 24687551_c1_38 | 1595 | 5249 | 630 | 209 | 255 | 5.50E-22 | [ac:c70006] [pn:conserved hypothetical protein yuaj] [gn:yuaj] [or:bacillus subtilis] [db:pir] |
| 24693800_c3_154 | 1596 | 5250 | 1125 | 374 | 472 | 5.60E-45 | [ac:g69774] [pn:transposon protein homolog ydcr] [gn:ydcr] [or:bacillus subtilis] [db:pir] |
| 24694075_f1_7 | 1597 | 5251 | 204 | 67 | 49 | 0.086 | [ac:a37363] [pn:histone h2b, testis] [cl:histone h2b] [or:mus musculus] [sr:, house mouse] [db:pir] |
| 24695162_c1_51 | 1598 | 5252 | 924 | 307 | 708 | 5.50E-70 | [ln:sthsth] [ac:y11213] [pn:hypothetical protein] [gn:orf 1] [or:streptococcus thermophilus] [db:genpept-bct] [de:s.thermophilus hsth gene.] [le:<1] [re:844] [di:direct] |
| 24709713_f1_2 | 1599 | 5253 | 582 | 193 | 387 | 5.70E-36 | [ac:p35155] [gn:ypuh] [or:bacillus subtilis] [de:hypothetical 22.0 kd protein in ribt-dacb intergenic region (orfx8)] [sp:p35155] [db:swissprot] |
| 24714063_f2_3 | 1600 | 5254 | 255 | 85 | 160 | 1.30E-10 | [ac:h69877] [pn:calcium-transpoting atpase homolog ylob] [gn:ylob] [or:bacillus subtilis] [db:pir] |
| 24719200_c1_8 | 1601 | 5255 | 1047 | 348 | 359 | 5.30E-33 | [ac:f69119] [pn:cation efflux system protein (zinc/cadmium)] [db:pir] [or:methanobacterium thermoautotrophicum] |
| 24725002_c2_17 | 1602 | 5256 | 3345 | 1114 | 2038 | 6.40E-211 | [ac:d69617] [pn:dna polymerase iii (alpha subunit) dnae] [gn:dnae] [or:bacillus subtilis] [db:pir] |
| 24726517_f1_5 | 1603 | 5257 | 330 | 109 | 55 | 0.6 | [ln:hsy15227] [ac:y15227] [gn:leu1] [or:homo sapiens] [sr:human] [db:genpept-pri2] [de:homo sapiens mrna for leukemia associated gene 1.] [le:268] [re:486] [di:direct] |
| 24726542_c2_26 | 1604 | 5258 | 918 | 305 | 144 | 1.10E-09 | [ac:i53641] [pn:mucin] [gn:muc5ac] [or:homo sapiens] [sr:, man] [db:pir] [mp:11p15.5—11p15.5] |

TABLE 2-continued

| Orf | NT Seq ID | AA Seq ID | NT Orf length | AA Orf length | Score | Probability | Description |
|---|---|---|---|---|---|---|---|
| 24729542_c1_177 | 1605 | 5259 | 879 | 292 | 462 | 6.40E-44 | [ac:p45579:p77632] [gn:ybdh] [or:escherichia coli] [de:hypothetical 39.1 kd protein in csta-ahpc intergenic region] [sp:p45579:p77632] [db:swissprot] |
| 24736693_c2_240 | 1606 | 5260 | 576 | 191 | 86 | 0.18 | [ln:celc09g12] [ac:aff038608] [gn:c09g12.2] [or:caenorhabditis elegans] [sr:caenorhabditis elegans strain=bristol n2] [db:genpept-inv] [de:caenorhabditis elegans cosmid c09g12.] |
| 24738763_f1_6 | 1607 | 5261 | 1542 | 513 | 725 | 8.70E-72 | [ie:20310:20522:20693:21029] [re:20474:20637:20981:21181] [di:directjoin] [ac:d70041] [pn:heavy metal-transporting atpase homolog yvgw] [gn:yvgw] [or:bacillus subtilis] [db:pir] |
| 24740936_c1_37 | 1608 | 5262 | 1539 | 512 | 1207 | 7.30E-123 | [ac:f69763] [pn:multidrug resistance protein homolog ycnb] [gn:ycnb] [or:bacillus subtilis] [db:pir] |
| 24741301_f1_2 | 1609 | 5263 | 198 | 65 | 56 | 0.097 | [ln:ac002481] [ac:ac002481] [gn:wugsc:h_luca12.3] [or:homo sapiens] [sr:information] [db:genpept-pri2] [de:human cosmid clone luca12 from 3p21.3, complete sequence.] [nt:similar to nitrogen permease regulator; similar to] [le:8239:8869:9058:9397] [re:8316 |
| 24781287_c3_55 | 1610 | 5264 | 468 | 155 | 147 | 1.50E-10 | [ln:sau52961] [ac:u52961] [pn:holin-like protein lrga] [gn:lrga] [or:staphylococcus aureus] [sr:staphylococcus aureus strain=nctc 8325-4] [db:genpept-bct] [de:staphylococcus aureus holin-like protein lrga (lrga) and lrgb(lrgb) genes, complete cds.] [nt:ly |
| 24781312_f3_19 | 1611 | 5265 | 729 | 242 | 842 | 3.50E-84 | [ac:p44865] [gn:gpma:hi0757] [or:haemophilus influenzae] [ec:5.4.2.1] [de:(bpg-dependent pgam)] [sp:p44865] [db:swissprot] |
| 24786411_f3_11 | 1612 | 5266 | 1035 | 344 | 999 | 8.00E-101 | [ac:c69669] [pn:oligopeptide abc transporter (atp-binding protein) (initiation of sporulation, competence development) oppf] [gn:oppf] [or:bacillus subtilis] [db:pir] |
| 24787526_c1_118 | 1613 | 5267 | 981 | 326 | 1055 | 9.30E-107 | [ac:69999] [pn:conserved hypothetical protein ytqa] [gn:ytqa] [or:bacillus subtilis] [db:pir] |
| 24792062_c2_86 | 1614 | 5268 | 1113 | 370 | 126 | 0.00011 | [ac:33420:q08917] [gn:nip80:nip100:yp11174c] [or:saccharomyces cerevisiae] [sr:baker's yeast] [de:nip80 protein (nip100 protein)] [sp:p33420:q08917] [db:swissprot] |
| 24792127_c1_49 | 1615 | 5269 | 186 | 61 | 63 | 0.27 | [ac:p25150] [gn:ywae:ipa-10r] [or:bacillus subtilis] [de:(orf3)] [sp:p25150] [db:swissprot] |
| 24797258_c3_75 | 1616 | 5270 | 1110 | 369 | 449 | 1.50E-42 | [ac:p05149] [gn:mro] [or:acinetobacter calcoaceticus] [ec:5.1.3.3] [de:aldose 1-epimerase precursor, (mutarotase)] [sp:p05149] [db:swissprot] |
| 24797313_c2_24 | 1617 | 5271 | 297 | 98 | 71 | 0.14 | [ac:p23306:p76757] [gn:yigb] [or:escherichia coli] [de:hypothetical 27.1 kd protein in xerc-uvrd intergenic region (orf 238)] [sp:p23306:p76757] [db:swissprot] |
| 24797800_c2_18 | 1618 | 5272 | 525 | 174 | 82 | 0.11 | [ac:q40608] [gn:atpg] [or:ochrosphaera neapolitana] [ec:3.6.1.34] [de:atp synthase b' chain, (subunit ii)] [sp:q40608] [db:swissprot] |
| 24798262_c2_247 | 1619 | 5273 | 1494 | 497 | 125 | 0.00011 | [ac:s43609] [pn:rofa protein] [or:streptococcus pyogenes] [db:pir] |

TABLE 2-continued

| Orf | NT Seq ID | AA Seq ID | NT Orf length | AA Orf length | Score | Probability | Description |
|---|---|---|---|---|---|---|---|
| 24798312_c2_65 | 1620 | 5274 | 252 | 83 | 64 | 0.099 | [ln:celc46c10] [ac:af039710] [gn:c46e10.2] [or:caenorhabditis elegans] [sr:caenorhabditis elegans strain=bristol n2] [db:genpept-inv] [de:caenorhabditis elegans cosmid c46e10.] [le:13886;14234] [re:14086;14404] [di:directjoin] |
| 24798312_f1_10 | 1621 | 5275 | 366 | 121 | 80 | 0.89 | [ln:cru62943] [ac:u62943] [pn:unknown] [or:chloroplast chlamydomonas reinhardtii] [sr:chlamydomonas reinhardtii] [db:genpept-pln] [de:chlamydomonas reinhardtii orf2971 unknown protein gene, chloroplastgene encoding chloroplast protein, complete cds.] [nt: |
| 24798462_f2_16 | 1622 | 5276 | 996 | 331 | 1569 | 3.20E-161 | [ln:ehy13922] [ac:y13922;y15222] [gn:mray] [or:enterococcus hirae] [db:genpept-bct] [de:enterococcus hirae mraa, pbp3s, mray, murd, murg, ftsq and ftsagenes, mraw, yllc and ftsz partial genes.] [le:4104] [re:5069] [di:direct] |
| 24799001_c2_25 | 1623 | 5277 | 369 | 122 | 70 | 0.77 | [ac:jq1611] [pn:nonstructural protein c] [gn:c] [cl:measles virus nonstructural protein c] [or:phocine distemper virus] [db:pir] |
| 24801437_f1_5 | 1624 | 5278 | 195 | 64 | 63 | 0.1 | [ac:s16893] [pn:hypothetical protein (insertion sequence is901)] [or:mycobacterium avium] [db:pir] |
| 24801555_c2_145 | 1625 | 5279 | 1494 | 497 | 1448 | 8.70E-160 | [ac:h69593] [pn:beta-glucosidase bglh] [gn:bglh] [or:bacillus subtilis] [db:pir] |
| 24801702_f3_34 | 1626 | 5280 | 909 | 302 | 586 | 4.70E-57 | [ac:q57695] [gn:dapa;mj0244] [or:methanococcus jannaschii] [ec:4.2.1.52] [de:dihydrodipicolinate synthase, (dhdps)] [sp:q57695] [db:swissprot] |
| 24803437_c3_68 | 1627 | 5281 | 255 | 84 | 65 | 0.34 | [ac:q58267] [gn:mj0857] [or:methanococcus jannaschii] [de:hypothetical protein mj0857] [sp:q58267] [db:swissprot] |
| 24803816_f2_8 | 1628 | 5282 | 1086 | 361 | 555 | 9.00E-54 | [ac:h69162] [pn:conserved hypothetical protein mth48] [gn:mth48] [or:methanobacterium thermoautotrophicum] [db:pir] |
| 24804700_c1_71 | 1629 | 5283 | 705 | 234 | 273 | 6.90E-24 | [ln:af040381] [ac:af040381] [pn:carbonic anhydrase] [gn:cah] [or:erwinia carotovora] [db:genpept-bct] [de:erwinia carotovora ribosomal protein 111 methyltransferase (prma)gene, partial cds; and carbonic anhydrase (cah), yhdg homolog, andsmall dna binding |
| 24804702_c3_24 | 1630 | 5284 | 2703 | 900 | 584 | 9.70E-73 | [ac:p54746;p75753] [gn:ybgg] [or:escherichia coli] [de:hypothetical 100.0 kd protein in hrsa-cyda intergenic region] [sp:p54746;p75753] [db:swissprot] |
| 24804712_c2_164 | 1631 | 5285 | 612 | 203 | 130 | 5.50E-09 | [ln:mtcy10g2] [ac:z92539] [pn:unknown] [gn:mtcy10g2.30c] [or:mycobacterium tuberculosis] [db:genpept-bct] [de:mycobacterium tuberculosis cosmid scy10g2.] [nt:mtcy10g2.30c, unknown, len: 197 aa, some similarity] [le:32828] [re:33421] [di:complement] |
| 24804786_f2_3 | 1632 | 5286 | 213 | 70 | 306 | 2.20E-27 | [ac:q47744] [gn:vanrb] [or:enterococcus faecalis] [sr:streptococcus faecalis] [de:regulatory protein vanrb] [sp:q47744] [db:swissprot] |

TABLE 2-continued

| Orf | NT Seq ID | AA Seq ID | NT Orf length | AA Orf length | Score | Probability | Description |
|---|---|---|---|---|---|---|---|
| 24804838_c1_117 | 1633 | 5287 | 387 | 128 | 376 | 8.30E-35 | [ln:efu09422] [ac:u09422] [or:*enterococcus faecalis*] [db:genpept-bct] [de:*enterococcus faecalis* ds16 transposon tn916, (tet(m)), (xis-tn),(int-tn) genes, orfs 1–24, complete cds, complete sequence.] [nt:orf22] [le:666] [re:1052] [di:direct] |
| 24805312_c3_32 | 1634 | 5288 | 1887 | 628 | 1499 | 8.30E-154 | [ln:cloabg] [ac:149336] [pn:pts-dependent enzyme ii] [gn:abgf] [fn:transmembrane transport of] [or:*clostridium longisporum*] [sr:*clostridium longisporum* (strain b6405) (clone: pbg11) dna] [db:genpept-bct] [de:*clostridium longisporum* methyl-accepting chemot |
| 24805312_f2_7 | 1635 | 5289 | 225 | 74 | 155 | 2.20E-11 | [ln:d78257] [ac:d78257] [pn:baca] [gn:baca] [or:*enterococcus faecalis*] [sr:*enterococcus faecalis* plasmid:pyi17 dna] [db:genpept-bct] [de:*enterococcus faecalis* plasmid pyi17 genes for baca, bacb, orf3,orf4, orf5, orf6, orf7, orf8, orf9, orf10, orf11,partia |
| 24805468_c3_75 | 1636 | 5290 | 795 | 264 | 79 | 0.52 | [ln:ammtdnacg] [ac:y13113] [pn:nadh dehydrogenase subunit 6] [or:mitochondrion alligator mississippiensis] [sr:american alligator] [db:genpept] [de:a.mississippiensis mitochondrial dna, complete genome.] [le:13643] [re:14158] [di:complement] |
| 24806575_f3_30 | 1637 | 5291 | 300 | 99 | 246 | 5.00E-21 | [ac:h69993] [pn:hypothetical protein ytja] [gn:ytja] [or:*bacillus subtilis*] [db:pir] |
| 24806653_c2_48 | 1638 | 5292 | 894 | 297 | 757 | 3.50E-75 | [ac:p26497] [gn:spo0j] [or:*bacillus subtilis*] [de:stage 0 sporulation protein j] [sp:p26497] [db:swissprot] |
| 24807092_c1_19 | 1639 | 5293 | 1002 | 333 | 63 | 0.6 | [ac:a35333] [pn:glucose-6-phosphate isomerase,] [gn:gpi] [cl:glucose-6-phosphate isomerase] [or:homo sapiens] [sr:, man] [ec:5.3.1.9] [db:pir] [mp:19q13.1–19q13.1] |
| 24807807_c2_80 | 1640 | 5294 | 240 | 79 | 107 | 7.00E-06 | [ac:p29112] [or:*agrobacterium tumefaciens*] [de:24.9 kd protein in pica locus (orf1)] [sp:p29112] [db:swissprot] |
| 24807943_c1_102 | 1641 | 5295 | 237 | 78 | 87 | 0.00035 | [ln:bpdp1orfs] [ac:z93946] [pn:holin] [gn:dph] [fn:pore formation] [or:bacteriophage dp-1] [db:genpept-phg] [de:bacteriophage dp-1 dph and pa1 genes and 5 open reading frames.] [le:3463] [re:3687] [di:direct] |
| 24808438_f1_7 | 1642 | 5296 | 450 | 149 | 130 | 9.80E-09 | [ac:s76982] [pn:hypothetical protein] [or:synechocystis sp.] [sr:pcc 6803, , pcc 6803] [sr:pcc 6803,] [db:pir] |
| 24814717_c3_26 | 1643 | 5297 | 1416 | 471 | 1231 | 2.10E-125 | [ac:p46320] [gn:celf:celd] [or:*bacillus subtilis*] [ec:3.2.1.86] [de:probable 6-phospho-beta-glucosidase,] [sp:p46320] [db:swissprot] |
| 24814813_f2_4 | 1644 | 5298 | 384 | 127 | 181 | 3.80E-14 | [ac:p41024] [or:*bacillus methanolicus*] [de:hypothetical 14.0 kd protein in lysa 3'region (orf3)] [sp:p41024] [db:swissprot] |
| 24817912_c3_144 | 1645 | 5299 | 372 | 123 | 51 | 0.98 | [ln:hstbporf2] [ac:x93512] [pn:telomeric dna binding protein] [gn:orf2] [or:homo sapiens] [sr:human] [db:genpept-pri1] [de:h.sapiens mrna for telomeric dna binding protein (orf2).] [le:<1] [re: 92] [di:direct] |

TABLE 2-continued

| Orf | NT Seq ID | AA Seq ID | NT Orf length | AA Orf length | Score | Probability | Description |
|---|---|---|---|---|---|---|---|
| 24820278_c2_36 | 1646 | 5300 | 582 | 193 | 367 | 7.50E-34 | [ac:q02169:p37576] [gn:maf] [or:*bacillus subtilis*] [de:maf protein] [sp:q02169:p37576] [db:swissprot] |
| 24821002_f1_5 | 1647 | 5301 | 696 | 231 | 97 | 0.0029 | [ac:h69762] [pn:two-component sensor histidine kinase [yel homolog yelk] [gn:yelk] [or:*bacillus subtilis*] [db:pir] |
| 24822150_c2_29 | 1648 | 5302 | 735 | 244 | 1230 | 2.70E-125 | [ac:p29079] [or:*streptococcus thermophilus*] [ec:5.1.1.13] [de:aspartate racemase,] [sp:p29079] [db:swissprot] |
| 24822153_f1_2 | 1649 | 5303 | 444 | 147 | 213 | 1.60E-17 | [ac:f69891] [pn:conserved hypothetical protein ynep] [gn:ynep] [or:*bacillus subtilis*] [db:pir] |
| 24822318_f2_5 | 1650 | 5304 | 1407 | 468 | 620 | 1.20E-60 | [ac:h69777] [pn:transcriptional regulator (gntr family)/homolog ydef] [gn:ydef] [or:*bacillus subtilis*] [db:pir] |
| 24823376_c2_23 | 1651 | 5305 | 1047 | 348 | 181 | 1.30E-11 | [ac:p50728] [gn:ypbb] [or:*bacillus subtilis*] [de:hypothetical 40.7 kd protein in fer-recq intergenic region] [sp:p50728] [db:swissprot] |
| 24823385_f1_5 | 1652 | 5306 | 890 | 297 | 440 | 1.40E-41 | [ac:q02469] [or:*shewanella putrefaciens*] [ec:1.3.99.1] [de:(flavocytochrome c)] [sp:q02469] [db:swissprot] |
| 24823432_f2_5 | 1653 | 5307 | 243 | 80 | 142 | 5.20E-10 | [ac:p22938] [gn:xsseb] [or:*escherichia coli*] [ec:3.11.6] [de:small subunit)] [sp:p22938] [db:swissprot] |
| 24844760_c3_77 | 1654 | 5308 | 213 | 70 | 58 | 0.39 | [ac:p01887] [gn:b2m] [or:mus musculus] [sr:mouse] [de:beta-2-microglobulin precursor] [sp:p01887] [db:swissprot] |
| 24845322_c2_52 | 1655 | 5309 | 432 | 143 | 287 | 2.30E-25 | [ac:q10081] [gn:spac11d3.02c] [or:*schizosaccharomyces pombe*] [sr:fission yeast] [de:hypothetical 17.4 kd protein c11d3.02c in chromosome i] [sp:q10081] [db:swissprot] |
| 24848465_c2_232 | 1656 | 5310 | 879 | 292 | 253 | 9.00E-22 | [ac:p37082] [gn:sora] [or:*klebsiella pneumoniae*] [de:permease iic component) (phosphotransferase enzyme ii, c component)] [sp:p37082] [db:swissprot] |
| 24848891_c3_16 | 1657 | 5311 | 723 | 240 | 893 | 1.40E-89 | [ac:p49668] [gn:rpsb] [or:*pediococcus acidilactici*] [de:30s ribosomal protein s2] [sp:p49668] [db:swissprot] |
| 24855307_c1_32 | 1658 | 5312 | 564 | 188 | 596 | 4.10E-58 | [ac:p19670:q03225] [gn:mura:murz] [or:*bacillus subtilis*] [ec:2.5.1.7] [de:enolpyruvyl transferase) (ept)] [sp:p19670:q03225] [db:swissprot] |
| 24860083_c2_106 | 1659 | 5313 | 1365 | 454 | 1178 | 8.60E-120 | [ac:a69998] [pn:hypothetical protein ytoi] [gn:ytoi] [or:*bacillus subtilis*] [db:pir] |
| 24861267_c2_61 | 1660 | 5314 | 1623 | 540 | 857 | 2.70E-88 | [ln:sopgm] [ac:x75898] [pn:phosphoglucomutase] [gn:pgm] [or:*spinacia oleracea*] [db:genpept-pln] [ec:5.4.2.2] [de:*s.oleracea* pgm mrna.] [le:131] [re:1882] [di:direct] |
| 24875006_f3_35 | 1661 | 5315 | 774 | 257 | 590 | 1.80E-57 | [ac:f69726] [pn:pseudouridylate synthase i trua] [gn:trua] [or:*bacillus subtilis*] [db:pir] |
| 24879218_c2_23 | 1662 | 5316 | 189 | 62 | 72 | 0.014 | [ln:ypis285] [ac:x78303] [gn:lcrka] [or:*yersinia pestis*] [db:genpept-bct] [de:*y.pestis* (358) genomic dna is285 element transposed into lcrplasmid.] [nt:orf1] [le:1162] [re:1428] [di:direct] |

TABLE 2-continued

| Orf | NT Seq ID | AA Seq ID | NT Orf length | AA Orf length | Score | Probability | Description |
|---|---|---|---|---|---|---|---|
| 24879712_c2_155 | 1663 | 5317 | 1548 | 515 | 211 | 1.80E-16 | [ac:b37397] [pn:promoter inhibitor protein bpl] [or:lactococcus lactis phage bk5-t] [db:pir] |
| 24882682_c3_38 | 1664 | 5318 | 1155 | 384 | 112 | 0.0011 | [ac:s75232] [pn:hypothetical protein sll1830] [or:synechocystis sp.] [sr:pcc 6803, , pcc 6803] [sr:pcc 6803, ] [db:pir] |
| 24882832_c1_25 | 1665 | 5319 | 795 | 264 | 1057 | 5.70E-107 | [ac:p54321] [gn:pyrdA] [or:lactococcus lactis] [sr:subspcremoris:streptococcus cremoris] [ec:1.3.3.1] [de:(dhodehase a) (dhoda)] [sp:p54321] [dbs:swissprot] |
| 24882925_f1_5 | 1666 | 5320 | 1299 | 432 | 101 | 0.093 | [ln:rofu81495] [acu:81495:m15835:m13034:139898:m12073:m13033] [pn:unknown] [or:oxytricha fallax] [db:genpept-inv] [de:oxytricha fallax putative mitochondrial solute carrier cr-msc gene,complete cds.] [nt:rich in glutamine and charged amino acids; shows] [1 |
| 24882937_c1_9 | 1667 | 5321 | 408 | 135 | 83 | 0.015 | [ln:staf001386] [ac:af001386] [or:salmonella typhimurium] [db:genpept-bct] [de:salmonella typhimurium prophage-like element gifsy-1, partialsequence.] [nt:orf-1] [le:513] [re:923] [di:direct] |
| 24882943_c1_37 | 1668 | 5322 | 273 | 90 | 64 | 0.36 | [ac:a69854] [pn:hypothetical protein yiqa] [gn:yiqa] [or:bacillus subtilis] [db:pir] |
| 24883387_c3_57 | 1669 | 5323 | 1686 | 561 | 131 | 2.80E-05 | [ac:s39886] [pn:virr protein] [or:streptococcus pyogenes] [db:pir] |
| 24883443_c1_49 | 1670 | 5324 | 327 | 108 | 274 | 5.40E-24 | [ac:p54454] [gn:yyqei] [or:bacillus subtilis] [de:hypothetical 10.8 kd protein in arod-comer intergenic region] [sp:p54454] [dbs:swissprot] |
| 24883575_f1_5 | 1671 | 5325 | 852 | 283 | 446 | 3.20E-42 | [ac:p31054:p39203] [gn:baca] [or:escherichia coli] [ec:2.7.1.66] [de:(ec:2.7.1.66)] [sp:p31054:p39203] [dbs:swissprot] |
| 24884838_c2_18 | 1672 | 5326 | 1056 | 351 | 648 | 1.30E-63 | [ln:bshrca] [ac:y09446] [pn:repressor protein of class i heat shock genes [gn:hrca] [or:bacillus stearothermophilus] [db:genpept-bct] [de:b.stearothermophilus hemn gene (partial) and hrca gene.] [le:1051] [re:2085] [di:direct] |
| 24886312_f3_18 | 1673 | 5327 | 1311 | 436 | 1076 | 5.50E-109 | [ac:p40800] [gn:ygik] [or:salmonella typhimurium] [de:hypothetical 46.1 kd protein in plsc 3'region] [sp:p40800] [dbs:swissprot] |
| 24886500_c2_50 | 1674 | 5328 | 234 | 77 | 325 | 2.10E-29 | [ac:p26682] [gn:atpe] [or:enterococcus faecalis] [sr:streptococcus faecalis] [ec:3.6.1.34] [de:(dicyclohexylcarbodiimide-binding protein)] [sp:p26682] [dbs:swissprot] |
| 24886550_c1_22 | 1675 | 5329 | 339 | 112 | 238 | 3.50E-20 | [ac:p20928] [or:proteus vulgaris] [de:suge protein homolog] [sp:p20928] [dbs:swissprot] |
| 24886563_f1_1 | 1676 | 5330 | 369 | 122 | 320 | 7.20E-29 | [ac:p71447] [or:lactococcus lactis] [sr:subsplactis:streptococcus lactis] [ec:5.4.2.6] [de:beta-phosphoglucomutase,] [sp:p71447] [dbs:swissprot] |
| 24886662_c2_56 | 1677 | 5331 | 1527 | 508 | 348 | 3.00E-30 | [ac:s52348] [pn:hypothetical protein 2] [or:lactobacillus leichmannii] [db:pir] |
| 24892763_c3_17 | 1678 | 5332 | 504 | 167 | 472 | 5.60E-45 | [ac:a69881] [pn:conserved hypothetical protein y1ua] [gn:y1ua] [or:bacillus subtilis] [db:pir] |
| 24892887_c3_86 | 1679 | 5333 | 276 | 91 | 68 | 0.38 | [ac:q12315] [gn:gle1:brr3:yd1207w:d1049] [or:saccharomyces cerevisiae] [sr:baker's yeast] [de:rna export factor gle1] [sp:q12315] [dbs:swissprot] |

TABLE 2-continued

| Orf | NT Seq ID | AA Seq ID | NT Orf length | AA Orf length | Score | Probability | Description |
|---|---|---|---|---|---|---|---|
| 24895642_c1_12 | 1680 | 5334 | 1140 | 379 | 501 | 4.70E-48 | [ac:o05241] [gn:yugs] [or:bacillus subtilis] [de:hypothetical 49.5 kd protein in tgl-rgi intergenic region] [sp:o05241] [db:swissprot] |
| 24897342_c2_58 | 1681 | 5335 | 768 | 255 | 659 | 8.60E-65 | [ac:a70001] [pn:abc transporter (atp-binding protein) homolog ytsc] [gn:ytsc] [or:bacillus subtilis] [db:pir] |
| 24898436_c1_8 | 1682 | 5336 | 375 | 124 | 306 | 6.20E-27 | [ac:a70006] [pn:epidermal surface antigen homolog yuag] [gn:yuag] [or:bacillus subtilis] [db:pir] |
| 24898562_c1_181 | 1683 | 5337 | 531 | 176 | 188 | 7.00E-15 | [ac:370081] [gn:sorb] [or:klebsiella pneumoniae] [ec:2.7.1.69] [de:(ec 2.7.1.69) (eiii-b-sor) sp:p37081] [db:swissprot] |
| 24899062_f2_17 | 1684 | 5338 | 507 | 168 | 370 | 3.60E-34 | [ac:p23875] [gn:kdb] [or:escherichia coli] [de:lipopolysaccharide core biosynthesis protein kdb] [sp:p23875] [db:swissprot] |
| 24899175_c1_4 | 1685 | 5339 | 732 | 244 | 927 | 3.40E-93 | [ac:f69694] [pn:ribosomal protein 12 (b12) rplb] [gn:rplb] [or:bacillus subtilis] [db:pir] |
| 24901712_c3_71 | 1686 | 5340 | 705 | 234 | 583 | 9.70E-57 | [ac:f69633] [pn:glutamine abc transporter (membrane protein) glnp] [gn:glnp] [or:bacillus subtilis] [db:pir] |
| 25058_f1_5 | 1687 | 5341 | 507 | 168 | 252 | 1.20E-21 | [ac:c69874] [pn:conserved hypothetical protein ylbf] [gn:ylbf] [or:bacillus subtilis] [db:pir] |
| 251555_f2_12 | 1688 | 5342 | 213 | 70 | 52 | 0.18 | [ln:rnu18293] [ac:u18293] [pn:protein tyrosine phosphatase 2e1] [gn:ptp2e1] [or:rattus norvegicus] [sr:norway rat] [db:genpept-rod] [de:rattus norvegicus protein tyrosine phosphatase 2e1 (ptp2e1) mrna,complete cds.] [le:304] [re:1314] [di:direct] |
| 252036_f1_13 | 1689 | 5343 | 186 | 61 | 69 | 0.0027 | [ac:p44585] [gn:hi0230] [or:haemophilus influenzae] [de:hypothetical protein hi0230] [sp:p44585] [db:swissprot] |
| 2525042_c3_84 | 1690 | 5344 | 318 | 105 | 58 | 0.91 | [ac:b64705] [pn:hypothetical protein hp1482] [or:helicobacter pylori] [db:pir] |
| 2525311_c2_22 | 1691 | 5345 | 246 | 81 | 62 | 0.15 | [ac:q06943] [gn:hmgz] [or:drosophila melanogaster] [sr:fruit fly] [de:high mobility group protein z (hmg-z)] [sp:q06943] [db:swissprot] |
| 2525311_f1_3 | 1692 | 5346 | 246 | 81 | 70 | 0.022 | [ac:q06943] [gn:hmgz] [or:drosophila melanogaster] [sr:fruit fly] [de:high mobility group protein z (hmg-z)] [sp:q06943] [db:swissprot] |
| 2530762_c1_37 | 1693 | 5347 | 189 | 62 | 57 | 0.013 | [ln:sivgp1] [ac:m37866] [pn:transmembrane glycoprotein 120] [gn:gp120] [or:simian immunodeficiency virus] [sr:simian immunodeficiency virus dna from macaca mulatta spleen, clon] [db:genpept-vrl] [de:simian immunodeficiency virus proviral transmembrane gly |
| 25390762_c3_53 | 1694 | 5348 | 231 | 76 | 63 | 0.11 | [ln:chioon1] [ac:179944] [pn:reverse transcriptase] [or:chironomus tentans] [sr:chironomus tentans larva salivary gland dna] [db:genpept-inv] [de:chironomus tentans (clone p62) reverse transcriptase and orf1 ofnon-1tr retrotransposon genes, complete cds.] |

TABLE 2-continued

| Orf | NT Seq ID | AA Seq ID | NT Orf length | AA Orf length | Score | Probability | Description |
|---|---|---|---|---|---|---|---|
| 25390762_c3_7 | 1695 | 5349 | 285 | 94 | 54 | 0.67 | [ln:siu05093] [ac:u05093] [pn:envelope glycoprotein] [gn:env] [or:simian immunodeficiency virus] [db:genpept-vr1] [de:simian immunodeficiency virus sivhe543 clone 4-20 envelopeglycoprotein (env) gene, v1 region, partial cds.] [nt:v1 region] [le:<1] [re: |
| 25392340_f3_20 | 1696 | 5350 | 783 | 260 | 433 | 7.60E-41 | [ac:q58206] [gn:mj0796] [or:methanococcus jannaschii] [de:hypothetical abc transporter atp-binding protein mj0796] [sp:q58206] [db:swissprot] |
| 25394430_f1_7 | 1697 | 5351 | 207 | 68 | 52 | 0.29 | [ac:i56563] [pn:interleukin-3 receptor beta-subunit] [gn:rtl-3rbeta] [cl:interleukin-3 receptor beta chain:cytokine receptor homology] [or:rattus sp.] [sr:, rat] [db:pir] |
| 25400301_f1_15 | 1698 | 5352 | 1356 | 451 | 645 | 2.60E-63 | [ln:ac00792] [ac:ae000792] [pn:pts system, cellobiose-specific iic component] [gn:bb604] [or:borrelia burgdorferi] [sr:lyme disease spirochete] [db:genpept-bct] [de:borrelia burgdorferi plasmid cp26, complete plasmid sequence.] [nt:similar to gb:u07818 p |
| 25406655_f3_5 | 1699 | 5353 | 228 | 75 | 55 | 0.15 | [ac:jc2288] [pn:nirq protein] [or:pseudomonas aeruginosa] [db:pir] |
| 25408415_c2_100 | 1700 | 5354 | 273 | 90 | 60 | 0.094 | [ac:s51244] [pn:hypothetical protein ydr095c:hypothetical protein yd85557.02c] [or:saccharomyces cerevisiae] [db:pir] [mp:4r] |
| 25412811_f1_1 | 1701 | 5355 | 849 | 282 | 206 | 8.40E-16 | [ac:q50735] [gn:mtcy9c4.05c] [or:mycobacterium tuberculosis] [de:hypothetical 40.2 kd protein cy9c4.05c] [sp:q50735] [db:swissprot] |
| 25414580_f3_1 | 1702 | 5356 | 513 | 170 | 274 | 5.40E-24 | [ac:h70005] [pn:hypothetical protein yuaf] [gn:yuaf] [or:bacillus subtilis] [db:pir] |
| 25417062_c3_93 | 1703 | 5357 | 321 | 106 | 78 | 0.028 | [ac:p38746] [gn:ylt2:yh1014c] [or:saccharomyces cerevisiae] [sr:baker's yeast] [de:putative gtp binding protein ylf2] [sp:p38746] [db:swissprot] |
| 25423887_c1_69 | 1704 | 5358 | 189 | 62 | 62 | 0.045 | [ln:ae001154] [ac:ae001154:ae000783] [pn:conserved hypothetical protein] [gn:bb00527] [or:borrelia burgdorferi] [sr:lyme disease spirochete] [db:genpept-bct] [de:borrelia burgdorferi (section 40 of 70) of the complete genome.] [nt:similar to gb:d26185 sp:p |
| 25424012_c3_59 | 1705 | 5359 | 1434 | 477 | 2305 | 3.20E-239 | [ac:p43451] [gn:atpd] [or:enterococcus faecalis] [sr:,streptococcus faecalis] [ec:3.6.1.34] [de:atp synthase beta chain,] [sp:p43451] [db:swissprot] |
| 25425025_f1_5 | 1706 | 5360 | 1209 | 402 | 1238 | 3.80E-126 | [ac:c69670] [pn:glycine betaine/carnitine/choline abc transporter (atp-bindin) opuca] [gn:opuca] [or:bacillus subtilis] [db:pir] |
| 25428188_f2_12 | 1707 | 5361 | 249 | 82 | 61 | 0.0056 | [ln:ae000793] [ac:ae000793] [pn:conserved hypothetical protein] [gn:bbd14] [or:borrelia burgdorferi] [sr:lyme disease spirochete] [db:genpept-bct] [de:borrelia burgdorferi plasmid lp17, complete plasmid sequence.] [nt:similar to gp:1655797 percent identit |
| 25428212_f1_14 | 1708 | 5362 | 681 | 226 | 182 | 3.00E-14 | [ln:lbphig1e] [ac:x98106] [gn:rorf232] [or:bacteriophage phig1e] [db:genpept-phg] [de:lactobacillus bacteriophage phig1e complete genomic dna.] [le:4579] [re:5277] [di:complement] |

TABLE 2-continued

| Orf | NT Seq ID | AA Seq ID | NT Orf length | AA Orf length | Score | Probability | Description |
|---|---|---|---|---|---|---|---|
| 2542943_f3_18 | 1709 | 5363 | 1521 | 506 | 68 | 0.36 | [ln:hivu79952] [acu79952] [pn:envelope glycoprotein] [gn:env] [or:human immunodeficiency virus type 1] [db:genpept-vrl] [de:hiv-1 clone p6 ln 14v from uk, envelope glycoprotein, v1/v2hypervariable region (env) gene, partial cds.] [nt:gp120; v1/v2 hyperva |
| 25429640_c1_36 | 1710 | 5364 | 192 | 63 | 277 | 2.60E-24 | [ac:jc5007] [pn:transposase (insertion sequence is1297)] [or:lactococcus lactis] [db:pir] |
| 25429640_c1_38 | 1711 | 5365 | 351 | 116 | 576 | 5.30E-56 | [ln:striss1e] [acm18294] [pn:transposase] [or:lactococcus lactis cremoris] [sr:streptococcus lactis (strain m13) (clone: iss/s.) dna] [db:genpept-bct] [des:lactis lactose plasmid insertion element transposases, cloneiss/s..] [le:44] [re:754] [di:direct] |
| 25429640_f1_9 | 1712 | 5366 | 717 | 238 | 1188 | 7.50E-121 | [ac:jc5007] [pn:transposase (insertion sequence is1297)] [or:lactococcus lactis] [db:pir] |
| 25432193_c2_52 | 1713 | 5367 | 234 | 77 | 66 | 0.14 | [ac:s56663] [pn:proteinase inhibitor class ii] [cl:potato proteinase inhibitor pti] [or:nicotiana tabacum] [sr:common tobacco] [db:pir] |
| 25433952_c3_290 | 1714 | 5368 | 294 | 97 | 72 | 0.17 | [ac:s69646] [pn:hypothetical protein ydr479c] [or:saccharomyces cerevisiae] [db:pir] [mp:4r] |
| 25439817_f2_24 | 1715 | 5369 | 1167 | 388 | 327 | 5.20E-39 | [acp54871] [or:caenorhabditis elegans] [ec:4.1.3.5] [de:(3-hydroxy-3-methylglutaryl coenzyme a synthase) (fragment)] [sp:p54871] [dbs:swissprot] |
| 25440966_c1_107 | 1716 | 5370 | 339 | 112 | 61 | 0.18 | [ln:ab001684] [ac:ab001684] [gn:trm] [or:chloroplast chlorella vulgaris] [sr:chlorella vulgaris chloroplast dna] [db:genpept-pln] [de:chlorella vulgaris c-27 chloroplast dna, complete sequence,] [nt:torf49b] [le:45442] [re:45591] [di:direct] |
| 25442187_c1_61 | 1717 | 5371 | 1422 | 473 | 346 | 2.60E-57 | [ac:g64666] [pn:conserved hypothetical integral membrane protein hp1175] [or:helicobacter pylori] [db:pir] |
| 25445786_c3_45 | 1718 | 5372 | 588 | 195 | 498 | 9.80E-48 | [acp32813] [or:bacillus stearothermophilus] [de:hypothetical 18.2 kd protein in glda 3'region (orf3)] [sp:p32813] [dbs:swissprot] |
| 25473781_c1_140 | 1719 | 5373 | 270 | 89 | 66 | 0.22 | [ln:vcu47057] [acu47057] [sr:vibrio cholerae o139 strain-ai1837] [db:genpept-bct] [de:vibrio cholerae o139 orf1 gene, partial cds, and orf2, putativegalactosyl transferase, putative gdp-mannose pyrophosphorylase,put |
| 25484692_c1_30 | 1720 | 5374 | 423 | 140 | 118 | 1.80E-07 | [ac:c69801] [pn:hypothetical protein yfhl] [gn:yfhl] [or:bacillus subtilis] [db:pir] |
| 25488282_c3_109 | 1721 | 5375 | 576 | 191 | 354 | 1.80E-32 | [acp45873] [gn:ywke] [or:bacillus subtilis] [de:henk protein homolog] [sp:p45873] [dbs:swissprot] |
| 25488765_c3_118 | 1722 | 5376 | 252 | 83 | 82 | 0.0012 | [ln:af0345741] [ac:af0345741] [pn:putative cruciform dna binding protein] [gn:gv1] [or:glomus versiforme] [db:genpept-pln] [de:glomus versiforme putative cruciform dna binding protein (gv1)mrna, complete cds.] [nt:similar to ustilago maydis hmp1, encoded by |

TABLE 2-continued

| Orf | NT Seq ID | AA Seq ID | NT Orf length | AA Orf length | Score | Probability | Description |
|---|---|---|---|---|---|---|---|
| 25494702_c3_150 | 1723 | 5377 | 312 | 103 | 84 | 0.021 | [ac:q09733] [gn:spac31a2.16] [or:schizosaccharomyces pombe] [sr:fission yeast] [de:hypothetical 126.5 kd protein c31a2.16 in chromosome i] [sp:q09733] [db:swissprot] |
| 25500286_c3_52 | 1724 | 5378 | 264 | 87 | 78 | 0.023 | [ac:p51862] [gn:rom2:yli371w:18039.3] [or:saccharomyces cerevisiae] [sr:baker's yeast] [de:rho1 gdp-gtp exchange protein 2] [sp:p51862] [db:swissprot] |
| 25500312_c1_25 | 1725 | 5379 | 246 | 81 | 66 | 0.057 | [ln:charpqtou] [ac:z50854] [pn:arpt] [or:enterococcus hirae] [db:genpept-bct] [de:e.hirae arp[q,r,s,t,u] genes.] [le:857] [re:1153] [di:direct] |
| 25507801_c2_42 | 1726 | 5380 | 378 | 125 | 269 | 1.80E-23 | [ac:p32731] [gn:rbfa] [or:bacillus subtilis] [de:ribosome-binding factor a (p15b protein)] [sp:p32731] [db:swissprot] |
| 25507827_c3_185 | 1727 | 5381 | 240 | 79 | 92 | 0.0001 | [ln:a47218] [ac:a47218] [or:lactococcus lactis] [db:genpept-pat] [de:sequence 3 from patent wo9531563.] [nt:unnamed protein product] [le:1] [re:336] [di:complement] |
| 25509652_c2_24 | 1728 | 5382 | 576 | 191 | 315 | 2.40E-28 | [ac:p80725] [or:listeria innocua] [de:non-heme iron-containing ferritin] [sp:p80725] [db:swissprot] |
| 25509676_f3_23 | 1729 | 5383 | 963 | 320 | 1512 | 3.50E-155 | [ln:ehy13922] [ac:y13922;y15222] [gn:mraw] [or:enterococcus hirae] [db:genpept-bct] [de:enterococcus hirae mraz, pbp3s, mray, murd, murg, ftsq and ftsagenes, mraw, yllc and ftsz partial genes.] [le:524] [re:14483] [di:direct] |
| 25552188_c1_17 | 1730 | 5384 | 1026 | 341 | 234 | 1.30E-17 | [ac:s52348] [pn:hypothetical protein 2] [or:lactobacillus leichmannii] [db:pir] |
| 25546881_c1_40 | 1731 | 5385 | 1746 | 581 | 117 | 3.00E-05 | [ln:mtv017] [ac:a10218977] [pn:hypothetical protein mtv017.16c] [gn:mtv017.16c] [or:mycobacterium tuberculosis] [db:genpept] [de:mycobacterium tuberculosis sequence v017.] [nt:mtv017.16c, len: 360. unknown but similar to] [le:14107] [re:15189] [di:compleme |
| 25554211_f1_3 | 1732 | 5386 | 861 | 286 | 601 | 1.20E-58 | [ac:p44697] [gn:thid:hi0416] [or:haemophilus influenzae] [ec:2.7.4.7] [de:(hmp-p kinase)] [sp:p44697] [db:swissprot] |
| 25552318_f1_16 | 1733 | 5387 | 243 | 80 | 68 | 0.036 | [ac:p43566] [gn:yfl1032w] [or:saccharomyces cerevisiae] [sr:baker's yeast] [de:hypothetical 12.4 kd protein in rim15-hac1 intergenic region] [sp:p43566] [db:swissprot] |
| 25554555_c1_50 | 1734 | 5388 | 336 | 111 | 281 | 9.70E-25 | [ac:a69984] [pn:endo-1,4-beta-glucanase homolog ysdc] [gn:ysdc] [or:bacillus subtilis] [db:pir] |
| 25555411_c2_61 | 1735 | 5389 | 438 | 145 | 77 | 0.053 | [ac:s24195] [pn:dopamine receptor d4] [or:homo sapiens] [sr:, man] [db:pir] |
| 25556527_c3_7 | 1736 | 5390 | 300 | 99 | 216 | 2.30E-17 | [ac:t69813] [pn:multidrug-efflux transporter homolog yfmo] [gn:yfmo] [or:bacillus subtilis] [db:pir] |
| 25571062_f1_1 | 1737 | 5391 | 258 | 85 | 70 | 0.066 | [ln:celzk84] [acu23181] [gn:zk84.3] [or:caenorhabditis elegans] [sr:caenorhabditis elegans strain=bristol n2] [db:genpept-inv] [de:caenorhabditis elegans cosmid zk84.] [le:200:3969:4322] [re:2216:4267:4401] [di:direction] |

TABLE 2-continued

| Orf | NT Seq ID | AA Seq ID | NT Orf length | AA Orf length | Score | Probability | Description |
|---|---|---|---|---|---|---|---|
| 25578127_f1_2 | 1738 | 5392 | 363 | 120 | 263 | 3.40E-22 | [ln:af045552] [ac:af045552] [pn:xylulokinase] [gn:xylb] [or:lactobacillus brevis] [db:genpept] [de:lactobacillus brevis xyl operon and xylose isomerase (xyla),xylulokinase (xylb), and d-xylose proton-symporter (xylt) genes,complete cds.] [le:2724] [re:423 |
| 25579687_f2_8 | 1739 | 5393 | 735 | 244 | 275 | 4.20E-24 | [acc:d69778] [pn:hypothetical protein ydej] [gn:ydej] [or:bacillus subtilis] [db:pir] |
| 25579827_f3_25 | 1740 | 5394 | 345 | 114 | 391 | 2.10E-36 | [ac:p42060] [gn:rplv] [or:bacillus subtilis] [de:50s ribosomal protein l22] [sp:p42060] [db:swissprot] |
| 25580012_c1_86 | 1741 | 5395 | 324 | 107 | 81 | 0.045 | [ac:p40818] [gn:kiaa0055] [or:homo sapiens] [sr:;human] [ec:3.1.2.15] [det(deubiquitinating enzyme) (kiaa0055)] [sp:p40818] [db:swissprot] |
| 25580017_c2_63 | 1742 | 5396 | 324 | 107 | 71 | 0.25 | [ln:s60954] [acc:s60954] [gn:orf1] [or:rabbit hemorrhagic disease virus] [sr:rabbit hemorrhagic disease virus ast/89 isolate] [db:genpept-vr1] [de:vp60 [rabbit hemorrhagic disease virus rhdv, ast/89 isolate,genomic rna, 445 nt].] [nt:putative polyprotein; |
| 25580342_f1_15 | 1743 | 5397 | 741 | 246 | 410 | 2.10E-38 | [acp13131] [gn:agra:agr] [or:staphylococcus aureus] [de:accessory gene regulator protein a] [sp:p13131] [db:swissprot] |
| 25581552_c3_55 | 1744 | 5398 | 900 | 299 | 826 | 1.70E-82 | [acp29823] [gn:lacf] [or:agrobacterium radiobacter] [de:lactose transport system permease protein lacf] [sp:p29823] [db:swissprot] |
| 25584407_f1_9 | 1745 | 5399 | 627 | 208 | 317 | 1.50E-28 | [acp45080] [gn:nrdg:hi1155] [or:haemophilus influenzae] [ec:1.97.1.—] [de:(ec 1.97.1.—)] [sp:p45080] [db:swissprot] |
| 25584676_c2_18 | 1746 | 5400 | 1125 | 375 | 978 | 1.30E-98 | [ln:lmu40604] [acc:u40604] [or:listeria monocytogenes] [db:genpept-bct] [de:listeria monocytogenes clpc atpase (mec) gene, complete cds.] [nt:orf6; putative glutamyl-trna-transferase; similar] [le:6359] [re:7432] [di:direct] |
| 25584688_c1_116 | 1747 | 5401 | 633 | 210 | 96 | 0.038 | [acs76584] [pn:hypothetical protein] [or:synechocystis sp.] [sr:pcc 6803; , pcc 6803] [sr:pcc 6803;] [db:pir] |
| 25585008_c1_11 | 1748 | 5402 | 279 | 92 | 69 | 0.24 | [ac:q01560] [gn:nop3:np13:mts1:ydr432w:d9461.19] [or:saccharomyces cerevisiae] [sr:;baker's yeast] [de:nucleolar protein 3 (mitochondrial targeting supressor 1 protein)] [sp:q01560] [db:swissprot] |
| 25585025_f2_18 | 1749 | 5403 | 981 | 326 | 275 | 4.20E-24 | [ln:ab005215] [ac:ab005215] [pn:301aa long hypothetical abba] [gn:phaa019] [or:pyrococcus horikoshii] [sr:pyrococcus horikoshii] (strain:ot3) dna, clone:aa] [db:genpept-bct] [de:pyrococcus horikoshii ot3 phaa001–phaa055 genes, complete cds.] [nt:similar to |
| 25585900_c1_56 | 1750 | 5404 | 744 | 247 | 127 | 1.60E-06 | [acc:c69796] [pn:conserved hypothetical protein yesl] [gn:yesl] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 25587817_f2_41 | 1751 | 5405 | 1218 | 405 | 1032 | 2.50E-104 | [ln:eftu09422] [ac:u09422] [or:*enterococcus faecalis* [db:genpept-bct] [de:*enterococcus faecalis* ds16 transposon tn916, (tet(m)), (xis-tn),(int-tn) genes, orfs1–24, complete sequence.] [nt:orf20] [le:2861] [re:3850] [di:direct] |
| 25594751_c3_52 | 1752 | 5406 | 201 | 67 | 72 | 0.16 | [ln:hsu79745] [ac:u79745] [pn:monocarboxylate transporter homologue mct6] [or:*homo sapiens*] [sr:human] [db:genpept-pri2] [de:*homo sapiens* monocarboxylate transporter homologue mct6 mrna,complete cds.] [le:166] [re:1737] [di:direct] |
| 25595907_c2_60 | 1753 | 5407 | 360 | 119 | 76 | 0.24 | [ln:d38486] [ac:d38486] [or:*bombyx mori*] [sr:*bombyx mori* (strain:kinshu x showa, isolate:xin xu) early 36 hou] [db:genpept-inv] [de:*bombyx mori* even-skipped pair-rule mrna, complete cds.] [nt:even-skipped pair-rule gene] [le:245] [re:889] [di:direct] |
| 25596051_c2_57 | 1754 | 5408 | 645 | 214 | 248 | 3.10E-21 | [ln:eftu09422] [ac:u09422] [or:*enterococcus faecalis* [db:genpept-bct] [de:*enterococcus faecalis* ds16 transposon tn916, (tet(m)), (xis-tn),(int-tn) genes, orfs 1–24, complete cds, complete sequence.] [nt:orf14] [le:9816] [re:10817] [di:direct] |
| 25601562_c1_27 | 1755 | 5409 | 270 | 89 | 56 | 0.49 | [ln:musptkd] [ac:m33424] [or:*mus musculus*] [sr:mouse haemopoietic cell line fdc-p1, cdna to mrna, clone fd19] [db:genpept-rod] [de:mouse protein-tyrosine kinase (ptk) mrna, partial cds, clone fd19.] [nt:protein-tyrosine kinase (ec 2.7.1.112)] [le:<1] [re:acp11959] [gn:pdhd] [or:*bacillus stearothermophilus*] [ec:1.8.1.4] [de:complex, |
| 25604715_c3_25 | 1756 | 5410 | 1221 | 406 | 1304 | 3.80E-133 | (dihydrolipoamide dehydrogenase)] [sp:p11959] [db:swissprot] |
| 25605092_c2_137 | 1757 | 5411 | 465 | 154 | 534 | 1.50E-51 | [ac:p37503] [gn:yyba] [or:*bacillus subtilis*] [de:hypothetical transcriptional regulator in cotf-tetb intergenic region] [sp:p37503] [db:swissprot] |
| 25629817_c1_24 | 1758 | 5412 | 198 | 65 | 68 | 0.18 | [ac:p47488] [gn:mg246] [or:*mycoplasma genitalium*] [de:hypothetical protein mg246] [sp:p47488] [db:swissprot] |
| 25630342_c2_33 | 1759 | 5413 | 195 | 64 | 61 | 0.62 | [ln:ce35c5] [ac:z78417] [pn:c35c5.7] [or:*caenorhabditis elegans*] [db:genpept-inv] [de:*caenorhabditis elegans* cosmid c35c5, complete sequence.] [le:5775:5977:6251:6406] [re:5925:6025:6359:6545] [di:direct;join] |
| 25633562_c1_100 | 1760 | 5414 | 753 | 250 | 62 | 0.54 | [ln:cfrbc1] [ac:x62349] [pn:small subunit of rubisco] [gn:rbcs] [or:chloroplast cryptomonas sp.] [sr:*cryptomonas* sp] [db:genpept-pln] [de:*cryptomonas* f chloroplast rbcl and 3u rbcs genes.] [sp:p14960] [le:1973] [re: |
| 25636087_f1_17 | 1761 | 5415 | 270 | 89 | 77 | 0.0057 | [ac:p50849] [gn:pnpa:comr] [or:*bacillus subtilis*] [de:phosphorylase) (pnpase) (vegetative protein 15) (veg15)] [sp:p50849] [db:swissprot] [ec:2.7.7.8] |
| 25657135_c1_96 | 1762 | 5416 | 330 | 109 | 97 | 3.10E-05 | [ac:a69764] [pn:conserved hypothetical protein ycne] [gn:ycne] [or:*bacillus subtilis*] [db:pir] |

TABLE 2-continued

| Orf | NT Seq ID | AA Seq ID | NT Orf length | AA Orf length | Score | Probability | Description |
|---|---|---|---|---|---|---|---|
| 25659450_f2_59 | 1763 | 5417 | 300 | 99 | 71 | 0.67 | [ac:s75351] [pn:hypothetical protein] [or:synechocystis sp.] [sr:pcc 6803, , pcc 6803] [sr:pcc 6803, ] [db:pir] |
| 25660055_c2_14 | 1764 | 5418 | 852 | 283 | 287 | 1.60E-24 | [ac:c69975] [pn:acyltransferase homolog yrhl] [gn:yrhl] [or:bacillus subtilis] [db:pir] |
| 25660952_c3_169 | 1765 | 5419 | 717 | 238 | 705 | 1.10E-69 | [ac:p18156] [gn:glpf] [or:bacillus subtilis] [de:glycerol uptake facilitator protein] [sp:p18156] [db:swissprot] |
| 25662577_f3_14 | 1766 | 5420 | 723 | 240 | 204 | 1.40E-16 | [ac:p37545] [gn:yabd] [or:bacillus subtilis] [de:hypothetical 29.2 kd protein in mets-ksga intergenic region] [sp:p37545] [db:swissprot] |
| 25666062_c1_49 | 1767 | 5421 | 1047 | 348 | 1211 | 2.70E-123 | [ac:a69688] [pn:s-adenosylmethionine trna ribosyltransferase] [gn:quea] [or:bacillus subtilis] [db:pir] |
| 25666577_f3_5 | 1768 | 5422 | 744 | 247 | 1154 | 3.00E-117 | [ac:h64906] [pn:hypothetical protein b1525] [or:escherichia coli] [db:pir] |
| 25667765_c2_128 | 1769 | 5423 | 1041 | 346 | 1351 | 4.00E-138 | [ln:sau73374] [ac:u73374] [pn:cap8e] [gn:cap8e] [or:staphylococcus aureus] [db:genpept-bct] [de:staphylococcus aureus type 8 capsule genes, cap8a, cap8b, cap8c , cap8d, cap8e, cap8f, cap8g, cap8h, cap8i, cap8j, cap8k, cap8l,cap8m, cap8n, cap8o, cap8p, compl |
| 25667817_c2_171 | 1770 | 5424 | 915 | 304 | 672 | 3.60E-66 | [ac:c69819] [pn:abc transporter (atp-binding protein) homolog yhaq] [gn:yhaq] [or:bacillus subtilis] [db:pir] |
| 25673202_c1_27 | 1771 | 5425 | 996 | 331 | 1121 | 9.40E-114 | [ln:cbaj2527] [ac:aj002527] [pn:guta2] [gn:guta2] [fn:enzyme iibcgut of the glucitol pts. polypeptide] [or:clostridium beijerinckii] [db:genpept-bct] [de:clostridium beijerinckii glucitol transport gene system.] [le:706] [re:1716] [di:direct] |
| 25673512_c3_27 | 1772 | 5426 | 978 | 326 | 990 | 7.20E-100 | [ac:p25745;p75964] [gn:yefb] [or:escherichia coli] [de:hypothetical 42.6 kd protein in purb-icda intergenic region (orf-15)] [sp:p25745:p75964] [db:swissprot] |
| 25674042_f3_46 | 1773 | 5427 | 2202 | 733 | 2974 | 0 | [ac:p32113] [gn:copa] [or:enterococcus faecalis] [sr:streptococcus faecalis] [ec:3.6.1.36] [de:potassium/copper-transporting atpase a,] [sp:p32113] [db:swissprot] |
| 25675277_c3_15 | 1774 | 5428 | 225 | 74 | 68 | 0.036 | [ln:mlcb2052] [ac:z98604] [pn:hypothetical protein mlcb2052.25c] [gn:mlcb2052.25c] [or:mycobacterium leprae] [db:genpept-bct] [de:mycobacterium leprae cosmid b2052.] [nt:mlcb2052.25c, unknown, len: 117 aa; weak similarity] [le:19203] [re:19556] [di:comple |
| 25677312_c1_95 | 1775 | 5429 | 2388 | 795 | 149 | 4.30E-07 | [ac:s31806] [pn:temp3 protein] [or:plasmodium falciparum] [db:pir] |
| 25682001_f3_2 | 1776 | 5430 | 594 | 197 | 787 | 2.30E-78 | [ac:p42920] [gn:rplc] [or:bacillus subtilis] [de:50s ribosomal protein 13 (b13)] [sp:p42920] [db:swissprot] |
| 25782092_c3_23 | 1777 | 5431 | 264 | 87 | 113 | 6.90E-07 | [ac:h69472] [pn:iron-dependent repressor homolog] [or:archaeoglobus fulgidus] [db:pir] |
| 25784467_c3_276 | 1778 | 5432 | 246 | 81 | 69 | 0.028 | [ac:d69773] [pn:hypothetical protein ydef] [gn:ydef] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 25789092_c1_7 | 1779 | 5433 | 201 | 66 | 63 | 0.12 | [ln:hiv1u37039] [ac:u37039] [pn:envelope glycoprotein] [gn:env] [or:human immunodeficiency virus type 1] [dbgenpept-vr1] [de:human immunodeficiency virus type 1 isolate ar33 envelopeglycoprotein (env) gene, partial cds.] [nt:v3 region] [le:<1] [re: |
| 25814693_c2_72 | 1780 | 5434 | 726 | 241 | 635 | 3.00E-62 | [ac:b69693] [pn:ribonuclease iii rnes] [gn:rnes] [or:bacillus subtilis] [db:pir] |
| 25814702_f3_152 | 1781 | 5435 | 246 | 81 | 106 | 3.40E-06 | [ln:strinte] [ac:129324] [pn:repressor protein] [or:streptococcus pneumoniae] [db:genpept-bct] [de:streptococcus pneumoniae putative integrase, putative orf2,putative excisionase, putative orf7, putative repressor protein,putative orf8, putative dna relax |
| 25820187_c1_82 | 1782 | 5436 | 462 | 153 | 87 | 0.011 | [ln:1cu28163] [ac:u28163] [pn:eiia-man] [gn:mana] [or:lactobacillus curvatus] [db:genpept-bct] [de:lactobacillus curvatus phosphoenolpyruvate:mannosephosphotransferase eiia-man (mana), eiib-man (manb), and eiic-man(manc) genes, complete cds and eiid-man ( |
| 25822212_c2_24 | 1783 | 5437 | 1254 | 417 | 957 | 2.30E-96 | [ac:p46317] [gn:celb] [or:bacillus subtilis] [de:permease iic component) (phosphotransferase enzyme ii, c component)] [sp:p46317] [db:swissprot] |
| 25828133_c2_14 | 1784 | 5438 | 936 | 312 | 430 | 1.60E-40 | [ac:s54177] [pn:psr protein] [or:enterococcus faecium] [db:pir] |
| 25832951_f2_15 | 1785 | 5439 | 258 | 85 | 196 | 9.90E-16 | [ac:p52999] [gn:pand] [or:bacillus subtilis] [ec:4.1.1.11] [de:decarboxylase)] [sp:p52999] [db:swissprot] |
| 2584411_f1_3 | 1786 | 5440 | 774 | 257 | 660 | 6.70E-65 | [ln:stproba] [ac:x92418] [pn:gamma-glutamyl phosphate reductase gn:proa] [or:streptococcus thermophilus] [db:genpept-bct] [de:s.thermophilus prob and proa genes.] [le:946] [re:2196] [di:direct] |
| 2586500_c2_241 | 1787 | 5441 | 189 | 62 | 50 | 0.14 | [ac:p42397] [or:buchnera aphidicola] [de:hypothetical 21.4 kd protein in trpa 3region] [sp:p42397] [db:swissprot] |
| 25891562_c2_35 | 1788 | 5442 | 960 | 319 | 782 | 7.90E-78 | [ac:p75089] [gn:fba:tsr] [or:mycoplasma pneumoniae] [ec:4.1.2.13] [de:fructose-bisphosphate aldolase,] [sp:p75089] [db:swissprot] |
| 25892126_c2_125 | 1789 | 5443 | 243 | 80 | 59 | 0.45 | [ac:p32616] [gn:ye1045c:sygp-orf33] [or:saccharomyces cerevisiae] [sr:;baker's yeast] [de:hypothetical 16.5 kd protein in gly1-gda1 intergenic region] [sp:p32616] [db:swissprot] |
| 25892156_c3_68 | 1790 | 5444 | 813 | 270 | 107 | 6.40E-09 | [ac:q0377] [gn:mj0066] [or:methanococcus jannaschii] [de:hypothetical protein mj0066] [sp:q0377] [db:swissprot] |
| 25892183_c2_26 | 1791 | 5445 | 183 | 60 | 55 | 0.58 | [ln:gru49696] [ac:u49696] [pn:nucleocapsid protein] [gn:n] [or:groundnut ringspot virus] [sr:groundnut ringspot virus strain=m23] [db:genpept-vr1] [de:groundnut ringspot virus nucleocapsid protein (n) mma, partialcds.] [nt:s rna] [le:152] [re: |
| 25900376_c2_67 | 1792 | 5446 | 312 | 103 | 53 | 0.76 | [ac:p05040] [gn:atp8] [or:candida glabrata] [sr:yeast:torulopsis glabrata] [ec:3.6.1.34] [de:atp synthase protein 8,] [sp:p05040] [db:swissprot] |

TABLE 2-continued

| Orf | NT Seq ID | AA Seq ID | NT Orf length | AA Orf length | Score | Probability | Description |
|---|---|---|---|---|---|---|---|
| 25900376_c3_59 | 1793 | 5447 | 411 | 136 | 75 | 0.97 | [ln:ae001171] [ac:ae001171:ac000783] [pn:penicillin-binding protein (pbp-2)] [gn:bb0718] [or:borrelia burgdorferi] [sr:lyme disease spirochete] [db:genpept-bct] [de:borrelia burgdorferi (section 57 of 70) of the complete genome.] [nt:similar to gb:142023 |
| 25938433_c1_44 | 1794 | 5448 | 1434 | 477 | 602 | 9.40E-59 | [ac:s49545] [pn:histidine kinase] [cf:sensor histidine kinase homology] [or:streptococcus pneumoniae] [db:pir] |
| 25940914_c2_69 | 1795 | 5449 | 335 | 111 | 241 | 1.70E-20 | [ac:a69828] [pn:hypothetical protein yhea] [gn:yhea] [or:bacillus subtilis] [db:pir] |
| 25942716_c3_75 | 1796 | 5450 | 510 | 169 | 496 | 1.60E-47 | [ac:p54308] [gn:2] [or:bacteriophage spp1] [de:terminase large subunit (g2p)] [sp:p54308] [db:swissprot] |
| 25954051_f1_10 | 1797 | 5451 | 186 | 61 | 44 | 0.15 | [ac:p53821] [gn:yn1337w:n0172] [or:saccharomyces cerevisiae] [sr:baker's yeast] [de:hypothetical 9.7 kd protein in thi12 5'region] [sp:p53821] [db:swissprot] |
| 25970675_c2_11 | 1798 | 5452 | 288 | 95 | 264 | 1.10E-22 | [ac:g70033] [pn:maltose/maltodextrin-binding protein homolog yvdg] [gn:yvdg] [or:bacillus subtilis] [db:pir] |
| 259711_f2_14 | 1799 | 5453 | 381 | 126 | 304 | 3.60E-27 | [ac:p32156] [gn:yjil] [or:escherichia coli] [de:hypothetical 12.3 kd protein in frva-rhad intergenic region (f104)] [sp:p32156] [db:swissprot] |
| 25971930_c3_50 | 1800 | 5454 | 1209 | 402 | 1280 | 1.30E-130 | [ac:p37877] [gn:acka] [or:bacillus subtilis] [ec:2.7.2.1] [de:acetate kinase, (acetokinase)] [sp:p37877] [db:swissprot] |
| 25975427_c2_46 | 1801 | 5455 | 204 | 67 | 58 | 0.34 | [ln:mmgorfs] [ac:y14607] [pn:hypothetical protein] [or:methanosarcina mazeii] [db:genpept-bct] [de:methanosarcina mazeii genomic dna fragment, orfs 125, 86, 191, 106, 153, 129, 170, 88, 103 and 329.] [nt:orf88] [le:21145] [re:2408] [di:direct] |
| 25975678_c3_289 | 1802 | 5456 | 360 | 119 | 62 | 0.15 | [ac:p34779] [or:astasia longa] [sr:euglenophycean alga] [de:hypothetical 8.7 kd protein in rp122-rp123 intergenic region (orf70)] [sp:p34779] [db:swissprot] |
| 25977263_c2_35 | 1803 | 5457 | 1269 | 422 | 1367 | 8.10E-140 | [ac:p77836] [gn:pyn] [or:bacillus stearothemophilus] [ec:2.4.2.2] [de:pyrimidine-nucleoside phosphorylase,] [sp:p77836] [db:swissprot] |
| 2598452_f2_14 | 1804 | 5458 | 540 | 179 | 791 | 8.80E-79 | [ac:p12877] [gn:rple] [or:bacillus subtilis] [de:50s ribosomal protein 15 (b16)] [sp:p12877] [db:swissprot] |
| 25984702_f1_1 | 1805 | 5459 | 1275 | 424 | 609 | 1.70E-59 | [ac:d70006] [pn:conserved hypothetical protein yuba] [gn:yuba] [or:bacillus subtilis] [db:pir] |
| 25989218_c2_76 | 1806 | 5460 | 972 | 323 | 663 | 3.20E-65 | [ac:c69763] [pn:ferrichrome abc transporter (permease) homolog yclo] [gn:yclo] [or:bacillus subtilis] [db:pir] |
| 25995161_c2_14 | 1807 | 5461 | 936 | 311 | 1160 | 7.00E-118 | [ln:ph4coinjn] [ac:138972] [pn:transposase] [or:plasmid phkk701] [db:genpept-bct] [de:plasmid phkk701 (cointegrate junctional region) orfx, is1252transposase, and is1216v1 transposase genes, complete cds.] [nt:is1252 transposase; is6770 homolog; putative |
| 26015691_c2_19 | 1808 | 5462 | 618 | 205 | 86 | 3.40E-06 | [ac:s26352] [pn:hypothetical protein] [or:staphylococcus aureus] [db:pir] |
| 26022162_c1_147 | 1809 | 5463 | 660 | 219 | 512 | 3.20E-49 | [ac:c53610] [pn:ntpe protein] [or:enterococcus hirae] [db:pir] |

TABLE 2-continued

| Orf | NT Seq ID | AA Seq ID | NT Orf length | AA Orf length | Score | Probability | Description |
|---|---|---|---|---|---|---|---|
| 26026567_c3_53 | 1810 | 5464 | 921 | 306 | 547 | 6.30E-53 | [ac:p43909] [or:lactoccocus lactis] [sr:subsplactis:streptococcus lactis] [ec:4.2.1.51] [de:prephenate dehydratase, (pdt)] [sp:p43909] [db:swissprot] |
| 26040962_f1_27 | 1811 | 5465 | 1374 | 457 | 790 | 1.10E-78 | [ln:spcinrec] [ac:z34303] [pn:dinf protein] [gn:dinf] [or:streptococcus pneumoniae] [db:genpept-bct] [de:streptococcus pneumoniae cin operon encoding the cinA, recA, dinf,lyta genes, and downstream sequences.] [le:2799] [re:4169] [di:direct] |
| 26055312_c2_62 | 1812 | 5466 | 1350 | 449 | 1125 | 3.60E-114 | [ac:p77212] [gn:ykgc] [or:escherichia coli] [de:intergenic region] [sp:p77212] [db:swissprot] |
| 26055443_f3_34 | 1813 | 5467 | 1623 | 540 | 457 | 2.20E-43 | [ln:mtci364] [ac:z93777] [pn:hypothetical protein mtci364.29c] [gn:mtci364.29c] [or:mycobacterium tuberculosis] [db:genpept-bct] [de:mycobacterium tuberculosis cosmid i364 region.] [nt:mtci364.29c, unknown, len: 548 aa, similar to tmb3] [le:274410] [re:29 |
| 26064693_f2_3 | 1814 | 5468 | 723 | 240 | 540 | 3.50E-52 | [ln:llu92974] [acu92974:m90760:m90761] [pn:aldb] [gn:aldb] [or:lactococcus lactis] [db:genpept-bct] [de:lactococcus lactis unknown gene, partial cds, and hisc (hisc),unknown, hisg (hisg), unknown, hisb (hisb), unknown, hish (hish),hisa (hisa), hisf(hisf |
| 26070437_c1_197 | 1815 | 5469 | 630 | 209 | 459 | 1.30E-43 | [ac:h70068] [pn:hypothetical protein ywrf] [gn:ywrf] [or:bacillus subtilis] [db:pir] |
| 260942_c2_147 | 1816 | 5470 | 1530 | 509 | 2145 | 2.90E-222 | [ln:efu94356] [ac:u94356] [pn:glycerol kinase] [gn:glpk] [or:enterococcus faecalis] [db:genpept-bct] [de:enterococcus faecalis glycerol kinase (glpk) gene, complete cds.] [nt:atp-dependent glycerol kinase] [le:17] [re:1522] [di:direct] |
| 261590_f1_1 | 1817 | 5471 | 384 | 127 | 311 | 6.40E-28 | [ac:c69784] [pn:conserved hypothetical protein ydhg] [gn:ydhg] [or:bacillus subtilis] [db:pir] |
| 2617313_c1_91 | 1818 | 5472 | 780 | 259 | 169 | 7.20E-13 | [ac:p54603] [gn:yhes] [or:bacillus subtilis] [de:hypothetical 22.0 kd protein in cspb-glpp intergenic region] [sp:p54603] [db:swissprot] |
| 26174093_c1_62 | 1819 | 5473 | 246 | 81 | 66 | 0.0015 | [ln:pbu78479] [acu78479] [pn:erythrocyte binding-like protein] [gn:ebl] [or:plasmodium berghei] [db:genpept-inv] [de:plasmodium berghei erythrocyte binding-like protein (ebl) gene,partial cds.] [nt:cysteine-rich region] [le:<1] [re:573] [di:direct] |
| 26176375_f2_3 | 1820 | 5474 | 726 | 241 | 1028 | 6.80E-104 | [ac:p80868:p70980] [gn:fusa:fus] [or:bacillus subtilis] [de:elongation factor g (ef-g) (vegetative protein 19) (veg19)] [sp:p80868:p70980] [db:swissprot] |
| 26179658_f3_4 | 1821 | 5475 | 477 | 158 | 445 | 4.10E-42 | [ac:p28368] [gn:yyyd] [or:bacillus subtilis] [de:hypothetical 22.0 kd protein in flt-seca intergenic region] [sp:p28368] [db:swissprot] |
| 26181537_f3_32 | 1822 | 5476 | 462 | 153 | 508 | 8.60E-49 | [ac:p32393] [gn:comeb:come2] [or:bacillus subtilis] [de:come operon protein 2] [sp:p32393] [db:swissprot] |
| 26181542_c2_22 | 1823 | 5477 | 999 | 332 | 980 | 8.30E-99 | [ac:p11100] [gn:lacd] [or:staphylococcus aureus] [ec:4.1.—] [de:tagatose 1,6-diphosphate aldolase,] [sp:p11100] [db:swissprot] |

TABLE 2-continued

| Orf | NT Seq ID | AA Seq ID | NT Orf length | AA Orf length | Score | Probability | Description |
|---|---|---|---|---|---|---|---|
| 26181567_c1_105 | 1824 | 5478 | 192 | 63 | 58 | 0.39 | [ln:pmatpacbd] [ac:x6102:s40551:s40595] [pn:atpase delta subunit] [or:propionigenium modestum] [db:genpept-bct] [de:p.modestum gene for atpase subunits i-gen, a, c, b, delta.] [sp:p29708] [le:2647] [re: |
| 26197962_c1_29 | 1825 | 5479 | 420 | 139 | 65 | 0.11 | [ln:pbu42580] [ac:u42580:u17055:u32570] [gn:a2251] [or:paramecium bursaria chlorella virus 1] [db:genpept-vr1] [de:paramecium bursaria chlorella virus 1, complete genome.] [le:112595] [re:112816] [di:complement] |
| 26204180_c3_161 | 1826 | 5480 | 1290 | 429 | 110 | 0.0028 | [ln:mtcy253] [ac:z81368] [pn:unknown] [gn:mtcy253.04] [or:mycobacterium tuberculosis] [db:genpept-bct] [de:mycobacterium tuberculosis cosmid y253.] [nt:mtcy253.04, unknown, len: 408, similar to g1139577] [le:2294] [re:3520] [di:direct] |
| 26204375_f3_30 | 1827 | 5481 | 348 | 115 | 90 | 0.0011 | [ac:p46572] [gn:srg-3:c18f10.6] [or:caenorhabditis elegans] [de:srg-3 protein] [sp:p46572] [db:swissprot] |
| 26205258_c3_81 | 1828 | 5482 | 1812 | 603 | 986 | 1.90E-99 | [ac:q07741] [gn:oppa] [or:lactococcus lactis] [sr:subsplactis:streptococcus lactis] [de:oligopeptide-binding protein oppa precursor] [sp:q07741] [dbswissprot] |
| 26205312_c3_76 | 1829 | 5483 | 336 | 111 | 90 | 0.00038 | [ln:u00691] [ac:u00691] [pn:g5/d6 orf] [or:dictyostelium discoideum] [db:genpept-pln] [de:dictyostelium discoideum plasmid ddp1 d2 orf, d1/d3 orf, g4/d5 orf,g5/d6 orf, g1 orf, g2/g3/d4 orf, complete cds.] [le:8255] [re:8848] [di:complement] |
| 26210313_c3_155 | 1830 | 5484 | 264 | 87 | 72 | 0.1 | [ln:dmu57758] [ac:u57758] [pn:putative thyroid receptor interacting protein] [gn:alien] [or:drosophila melanogaster] [sr:fruit fly] [db:genpept-inv] [de:drosophila melanogaster putative thyroid receptor interactingprotein (alien) mrna, complete cds.] [le: |
| 26212838_f1_7 | 1831 | 5485 | 438 | 145 | 72 | 0.63 | [ac:s75261] [pn:hypothetical protein] [or:synechocystis sp.] [sr:pcc 6803, , pcc 6803] [sr:pcc 6803, ] [db:pir] |
| 26214818_f1_13 | 1832 | 5486 | 918 | 305 | 342 | 3.30E-31 | [ac:q00753] [gn:msmr] [or:streptococcus mutans] [de:msm operon regulatory protein] [sp:q00753] [dbswissprot] |
| 26218926_f1_20 | 1833 | 5487 | 183 | 60 | 111 | 4.80E-06 | [ln:spbc3d5] [ac:z95620] [pn:unknown] [gn:spbc3d5.14c] [or:schizosaccharomyces pombe] [sr:fission yeast] [db:genpept-pln] [de:s.pombe chromosome ii cosmid c3d5.] [nt:spbc3d5.14c, unknown; partial; serine rich.] [le:31398] [re: |
| 26220058_c3_70 | 1834 | 5488 | 489 | 162 | 548 | 5.00E-53 | [ac:e69633] [pn:glutamine abc transporter (membrane protein) glnm] [gn:glnm] [or:bacillus subtilis] [db:pir] |
| 26225325_c2_51 | 1835 | 5489 | 252 | 83 | 137 | 1.80E-09 | [ac:p374466] [gn:veg] [or:bacillus subtilis] [de:veg protein] [sp:p374466] [dbswissprot] |
| 26254806_c3_135 | 1836 | 5490 | 2283 | 760 | 1699 | 5.30E-175 | [ac:p77154] [gn:ycjt] [or:escherichia coli] [de:hypothetical 84.9 kd protein in pspe-ompg intergenic region] [sp:p77154] [db:swissprot] |

TABLE 2-continued

| Orf | NT Seq ID | AA Seq ID | NT Orf length | AA Orf length | Score | Probability | Description |
|---|---|---|---|---|---|---|---|
| 26257658_f2_11 | 1837 | 5491 | 213 | 70 | 62 | 0.6 | [ln:hcu33332] [ac:u33332] [or:human cytomegalovirus] [db:genpept-vrl] [de:human cytomegalovirus towne strain ul/b' region.] [nt:orf ul153] [le:2501] [re:3337] [di:complement] |
| 26278899_c1_45 | 1838 | 5492 | 220 | 73 | 65 | 0.3 | [ln:mcu60315] [ac:u60315] [pn:mc1401] [gn:mc1401] [or:molluseum contagiosum virus subtype 1] [db:genpept-vrl] [de:molluscum contagiosum virus subtype 1, complete genome.] [nt:putative atpase; description: homolog of vaccinia] [le:160036] [re:160785] [di:c |
| 26281593_c1_49 | 1839 | 5493 | 792 | 263 | 475 | 2.70E-45 | [ac:g69848] [pn:fructose phosphotransferase system enzyme homolog yjdd] [gn:yjdd] [or:bacillus subtilis] [db:pir] |
| 26287505_c1_95 | 1840 | 5494 | 1758 | 585 | 111 | 0.0072 | [ac:q09807] [gn:spac2g11.05c] [or:schizosaccharomyces pombe] [sr:.fission yeast] [de:hypothetical 81.8 kd protein c2g11.05c in chromosome i] [sp:q09807] [db:swissprot] |
| 26291068_c2_43 | 1841 | 5495 | 543 | 180 | 257 | 3.40E-22 | [ac:p54460] [gn:yqet] [or:bacillus subtilis] [ec:2.1.1.—] [de:probable methyltransferase,] [sp:p54460] [db:swissprot] |
| 26292132_c1_46 | 1842 | 5496 | 1029 | 342 | 94 | 0.067 | [ac:o64563] [pn:conserved hypothetical protein hp0347] [or:helicobacter pylori] [db:pir] |
| 26298387_f2_2 | 1843 | 5497 | 285 | 94 | 68 | 0.029 | [ln:ae001166] [ac:ae001166;ae000783] [pn:pts system, glucose-specific iibc component] [gn:bb0645] [or:borrelia burgdorferi] [sr:lyme disease spirochete] [db:genpept-bct] [de:borrelia burgdorferi (section 52 of 70) of the complete genome.] [nt:similar to g |
| 26298501_c1_50 | 1844 | 5498 | 756 | 251 | 272 | 8.80E-24 | [ac:p44013] [gn:hi0552] [or:haemophilus influenzae] [de:hypothetical protein hi0552] [sp:p44013] [db:swissprot] |
| 26306301_c3_132 | 1845 | 5499 | 900 | 299 | 1073 | 1.20E-108 | [ac:p77653;p76840] [gn:ycjo] [or:escherichia coli] [de:hypothetical abc transporter permease protein ycjo] [sp:p77653;p76840] [db:swissprot] |
| 26306312_c3_102 | 1846 | 5500 | 318 | 105 | 51 | 0.92 | [ln:ab001684] [ac:ab001684] [or:chloroplast chlorella vulgaris] [sr:chlorella vulgaris chloroplast dna] [db:genpept-pln] [de:chlorella vulgaris c-27 chloroplast dna, complete sequence.] [nt:orf46a] [le:6803] [re:6943] [di:direct] |
| 26306328_f3_64 | 1847 | 5501 | 474 | 157 | 117 | 1.40E-09 | [ac:p44620] [gn:hofd:hopd:hi0296] [or:haemophilus influenzae] [ec:3.4.99.—] [de:(ec 3.4.99.—)] [sp:p44620] [db:swissprot] |
| 26306562_c2_45 | 1848 | 5502 | 237 | 78 | 61 | 0.18 | [ac:p46179] [gn:rpsn] [or:acythosiphon kondoi symbiotic bacterium] [de:30s ribosomal protein s14] [sp:p46179] [db:swissprot] |
| 26307963_c1_25 | 1849 | 5503 | 225 | 74 | 137 | 1.80E-09 | [ln:ab007844] [ac:ab007844] [gn:uvre] [or:enterococcus faecalis] [sr:enterococcus faecalis plasmid:pad1 dna] [db:genpept-bct] [de:enterococcus faecalis plasmid pad1 gene,] [nt:repressor for uvra] [le:48] [re:272] [di:direct] |
| 26307963_c2_43 | 1850 | 5504 | 228 | 75 | 128 | 1.60E-08 | [ln:ab007844] [ac:ab007844] [gn:uvre] [or:enterococcus faecalis] [sr:enterococcus faecalis plasmid:pad1 dna] [db:genpept-bct] [de:enterococcus faecalis plasmid pad1 gene,] [nt:repressor for uvra] [le:48] [re:272] [di:direct] |
| 2635538_c2_25 | 1851 | 5505 | 264 | 87 | 237 | 4.50E-20 | [ac:q58418] [gn:pstb:mj1012] [or:methanococcus jannaschii] [de:probable phosphate transport atp-binding protein pstb] [sp:q58418] [db:swissprot] |
| 26351077_f1_3 | 1852 | 5506 | 1338 | 445 | 988 | 1.20E-99 | [ac:p54521] [gn:yqib] [or:bacillus subtilis] [ec:3.1.11.6] [de:vii large subunit)] [sp:p54521] [db:swissprot] |
| 26353932_f2_49 | 1853 | 5507 | 1611 | 536 | 802 | 6.00E-80 | [ac:g69992] [pn:spore cortex protein homolog yigp] [gn:yigp] [or:bacillus subtilis] [db:pir] |
| 26354637_c1_12 | 1854 | 5508 | 576 | 191 | 947 | 2.60E-95 | [ln:eneaac] [ac:112710] [gn:aac(6')-ii] [or:enterococcus faecium] [db:genpept-bct] [de:enterococcus faecium (aac(6')-ii) gene, complete cds.] [le:169] [re:717] [di:direct] |
| 26355087_c1_9 | 1855 | 5509 | 1395 | 464 | 1494 | 2.80E-153 | [ac:h70033] [pn:maltodextrin transport system permease homolog yvdh] [gn:yvdh] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 26360427_f3_14 | 1856 | 5510 | 2445 | 814 | 1715 | 1.90E-214 | [ac:p22036] [gn:mgtb] [or:salmonella typhimurium] [ec:3.6.1.—] [de:mg(2+) transport atpase, p-type 2,] [sp:p22036] [dbsswissprot] |
| 26360885_f1_3 | 1857 | 5511 | 552 | 183 | 206 | 8.60E-17 | [ac:b69804] [pn:hypothetical protein yfio] [gn:yfio] [or:bacillus subtilis] [db:pir] |
| 26364077_f2_10 | 1858 | 5512 | 234 | 77 | 159 | 8.60E-11 | [ac:p42359] [or:streptococcus gordonii challis] [ec:3.4.24.—] [de:(orf6) (fragment)] [sp:p42359] [dbsswissprot] |
| 26364818_c1_34 | 1859 | 5513 | 306 | 101 | 240 | 2.20E-20 | [ac:p32728] [gn:ylxr] [or:bacillus subtilis] [de:hypothetical 10.4 kd protein in nusa-infb intergenic region (orf3)] [sp:p32728] [dbsswissprot] |
| 26365925_f3_29 | 1860 | 5514 | 1020 | 339 | 152 | 2.90E-08 | [ln:llu10992] [ac:u10992] [gn:abid] [fn:causes abortive infection of bacteriophage in] [or:lactococcus lactis] [db:genpept-bct] [de:lactococcus lactis kr5 plasmid pbf61 abortive bacteriophageinfection determinant (abid) gene, complete cds.] [le:765 |
| 26365926_f1_26 | 1861 | 5515 | 210 | 69 | 69 | 0.09 | [ac:q00384] [gn:eda:kdga] [or:zymomonas mobilis] [ec:4.1.3.16:4.1.2.14] [de:(2-keto-3-deoxy-6-phosphogluconate aldolase) (kdpg-aldolase)] [sp:q00384] [dbsswissprot] |
| 26365937_c3_25 | 1862 | 5516 | 414 | 137 | 691 | 3.50E-68 | [ln:af029727] [ac:af029727] [pn:transposase] [or:enterococcus faecium] [db:genpept-bct] [de:enterococcus faecium insertion sequence is1485, complete sequence.] [nt:putative transposase] [le:76:330] [re:1238] [di:directjoin] |
| 26366087_f1_3 | 1863 | 5517 | 204 | 67 | 282 | 7.60E-25 | [ln:instran] [ac:128754] [pn:transposase] [or:insertion sequence is6770] [sr:insertion sequence is6770 dna] [db:genpept-bct] [de:enterococcus faecalis (transposable element: is6770) transposasegene, complete cds.] [nt:putative] [le:97] [re:1056] [di:direc |
| 26366307_c1_41 | 1864 | 5518 | 486 | 161 | 147 | 1.50E-10 | [ac:p40762] [gn:yzha] [or:bacillus subtilis] [de:hypothetical 19.7 kd protein] [sp:p40762] [dbsswissprot] |
| 26367202_c2_18 | 1865 | 5519 | 1140 | 379 | 314 | 3.10E-28 | [ac:h69588] [pn:acetylornithine deacetylase arge] [gn:arge] [or:bacillus subtilis] [db:pir] |
| 26367688_c2_31 | 1866 | 5520 | 969 | 322 | 1267 | 3.20E-129 | [ln:llu92974] [ac:u92974:m90760:m90761] [pn:unknown] [or:lactococcus lactis] [db:genpept-bct] [de:lactococcus lactis unknown gene, partial cds, and hisc (hisc), unknown, hisg (hisg), unknown, hisb (hisb), unknown, hish (hish), hisa (hisa), hisf (hisf), hisi |
| 26367817_c3_62 | 1867 | 5521 | 1953 | 650 | 81 | 0.97 | [ac:b69758] [pn:conserved hypothetical protein ycgg] [gn:ycgg] [or:bacillus subtilis] [db:pir] |
| 26368807_f3_12 | 1868 | 5522 | 456 | 151 | 90 | 0.00017 | [ac:q05246] [gn:36] [or:mycobacteriophage 15] [de:gene 36 protein (gp36)] [sp:q05246] [dbsswissprot] |
| 26369063_c1_29 | 1869 | 5523 | 1296 | 431 | 582 | 1.20E-56 | [ac:c69785] [pn:cellobiose phosphotransferase system enzym homolog ydho] [gn:ydho] [or:bacillus subtilis] [db:pir] |
| 26369068_c3_58 | 1870 | 5524 | 1500 | 499 | 1189 | 5.90E-121 | [ac:p50848] [gn:ypwa] [or:bacillus subtilis] [de:hypothetical 58.2 kd protein in kdgr-xpt intergenic region] [sp:p50848] [dbsswissprot] |
| 26369133_c1_72 | 1871 | 5525 | 573 | 190 | 432 | 9.70E-41 | [ln:spu90721] [ac:u90721] [pn:signal peptidase i] [gn:spi] [or:streptococcus pneumoniae] [db:genpept-bct] [de:streptococcus pneumoniae signal peptidase i (spi) gene, completecds.] [nt:leader peptidase] [le:40] [re:654] [di:direct] |
| 26369702_c3_53 | 1872 | 5526 | 306 | 101 | 69 | 0.92 | [ac:p27120] [gn:odc] [or:xenopus laevis] [sr:african clawed frog] [ec:4.1.1.17] [de:ornithine decarboxylase, (odc)] [sp:p27120] [dbsswissprot] |
| 26370938_c3_41 | 1873 | 5527 | 270 | 89 | 59 | 0.1 | [ln:trugtgplaa] [ac:d31778] [pn:phospholipase a2] [gn:gtgpla4] [or:trimeresurus gramineus] [sr:trimeresurus gramineus liver dna, clone_lib:embl3] [db:genpept-vrt] [ec:3.1.1.4] [de:trimeresurus gramineus gtgpla4 gene for phospholipase a2, completecds (exon |

TABLE 2-continued

| Orf | NT Seq ID | AA Seq ID | NT Orf length | AA Orf length | Score | Probability | Description |
|---|---|---|---|---|---|---|---|
| 26371086_c2_26 | 1874 | 5528 | 294 | 97 | 67 | 1 | [ln:mmmaevi1] [ac:a001482] [pn:evi1delta 105] [gn:evi-1] [fn:transcription factor] [or:mus musculus] [sr:house mouse] [db:genpept-rod] [de:mus musculus mrna for evi-1 transcription factor splice variantdelta 105.] [le:9] [re:2858] [di:direct] |
| 26375453_f1_1 | 1875 | 5529 | 735 | 244 | 521 | 3.60E-50 | [ac:a53310] [pn:pheromone cad1 binding protein precursor;trac] [gn:trac] [or:enterococcus faecalis] [dbpir] |
| 26377266_f3_11 | 1876 | 5530 | 1284 | 427 | 581 | 1.60E-56 | [ac:p40739] [gn:bglp:n17c] [or:bacillus subtilis] [ec:2.7.1.69] [de:enzyme ii, abc component), (eii-bgl)] [sp:p40739] [db:swissprot] |
| 26382202_c3_26 | 1877 | 5531 | 1947 | 648 | 2616 | 3.60E-272 | [ln:spgyrborf] [ac:z67740] [pn:dna gyrase] [gn:gyrb] [or:streptococcus pneumoniae] [db:genpept-bct] [de:s.pneumoniae gyrb gene and unknown orf.] [nt:gyrb subunit] [le:452] [re:2398] [di:direct] |
| 26382203_c1_6 | 1878 | 5532 | 201 | 66 | 60 | 0.21 | [ln:af020841] [ac:af020841] [pn:rpb2] [or:magnolia virginiana] [dbgenpept-pln] [de:magnolia virginiana rpb140 (rpb2) mrna, partial cds.] [nt:rna polymerase ii second largest subunit] [le:<1] [re: |
| 26382765_c2_58 | 1879 | 5533 | 270 | 89 | 77 | 0.0074 | [ac:p24513] [gn:cp18:s18] [or:drosophila grimshawi] [sr:,fruit fly:idiomyia grimshawi] [de:chorion protein s18] [sp:p24513] [db:swissprot] |
| 26382812_c2_10 | 1880 | 5534 | 351 | 116 | 76 | 0.34 | [ac:p17224] [gn:prrd] [or:escherichia coli] [ec:3.1.21.3] [de:type i restriction enzyme prrd,] [sp:p17224] [db:swissprot] |
| 26382969_c2_21 | 1881 | 5535 | 320 | 106 | 200 | 3.70E-16 | [ln:sgu81957] [ac:u81957] [pn:putative dna binding protein] [or:streptococcus gordonii] [db:genpept-bct] [de:streptococcus gordonii ma polymerase beta' subunit (rpoc),putative dna binding protein, putative abc transporter subunitcomya (comya), putative a |
| 26385902_c2_26 | 1882 | 5536 | 183 | 60 | 47 | 0.098 | [ac:q58349] [gn:mj0939] [or:methanococcus jannaschii] [de:hypothetical protein mj0939] [sp:q58349] [dbswissprot] |
| 26386088_c2_160 | 1883 | 5537 | 486 | 161 | 54 | 0.68 | [ac:s74747] [pn:hypothetical protein slr0980] [or:synechocystis sp.] [sr:pcc 6803, , pcc 6803] [sr:pcc 6803,] [dbpir] |
| 26386088_c2_29 | 1884 | 5538 | 849 | 282 | 764 | 6.40E-76 | [ac:h69796] [pn:lactose permease homolog yesq] [gn:yesq] [or:bacillus subtilis] [dbpir] |
| 26386567_f2_3 | 1885 | 5539 | 744 | 247 | 225 | 8.40E-19 | [ac:p39147] [gn:comfc:comf3] [or:bacillus subtilis] [de:comf operon protein 3] [sp:p39147] [dbswissprot] |
| 26387200_c2_31 | 1886 | 5540 | 678 | 225 | 482 | 4.90E-46 | [ac:p39815] [gn:gid] [or:bacillus subtilis] [de:gid protein (fragment)] [sp:p39815] [dbswissprot] |
| 26399969_c1_5 | 1887 | 5541 | 819 | 272 | 177 | 1.30E-11 | [ln:ae000792] [ac:ae000792] [pn:outer surface protein, putative] [gn:bb07] [or:borrelia burgdorferi] [sr:lyme disease spirochete] [db:genpept-bct] [de:borrelia burgdorferi plasmid cp26, complete plasmid sequence.] [nt:similar to gb:m88764 sp:q09090 pid:4 |
| 26423152_f1_1 | 1888 | 5542 | 960 | 319 | 1206 | 9.30E-123 | [ln:llu74322] [ac:u74322] [pn:6-phosphogluconate dehydrogenase] [or:lactococcus lactis] [db:genpept-bct] [ec:1.1.1.44] [de:lactococcus lactis 6-phosphogluconate dehydrogenase gene, completecds, and potassium transporter homolog gene, partial cds.] [le:898 |
| 26437811_c3_19 | 1889 | 5543 | 807 | 268 | 245 | 1.50E-33 | [ln:cet04a11] [ac:z83123] [pn:t04a11.2] [or:caenorhabditis elegans] [dbgenpept-inv] [de:caenorhabditis elegans cosmid t04a11, complete sequence.] [le:4853:5007:5814] [re:4960:5351:5867] [di:complement;join] |
| 26437912_c1_37 | 1890 | 5544 | 189 | 62 | 56 | 0.0077 | [ac:s76630] [pn:hypothetical protein] [or:synechocystis sp.] [sr:pcc 6803, , pcc 6803] [sr:pcc 6803,] [dbpir] |
| 26442131_c1_12 | 1891 | 5545 | 603 | 200 | 324 | 2.70E-29 | [ac:p54390] [gn:ypib] [or:bacillus subtilis] [de:hypothetical 21.4 kd protein in qcra 5'region] [sp:p54390] [dbswissprot] |

TABLE 2-continued

| Orf | NT Seq ID | AA Seq ID | NT Orf length | AA Orf length | Score | Probability | Description |
|---|---|---|---|---|---|---|---|
| 26447203_c3_2 | 1892 | 5546 | 1032 | 344 | 1141 | 7.20E-116 | [ln:hiu32714] [ac:u32714:142023] [pn:aspartate aminotransferase (aspc)] [gn:hi0286] [or:*haemophilus influenzae*] [db:genpept-bct] [de:*haemophilus influenzae* from bases 308943 to 320513 (section 29 of 163) of the complete genome.] [nt:similar to gbm59430_1 |
| 26448392_c3_73 | 1893 | 5547 | 384 | 127 | 115 | 3.80E-07 | [ac:p54940] [gn:yxea:hs74a] [or:*bacillus subtilis*] [de:hypothetical 13.0 kd protein in idh-deor intergenic region precursor] [sp:p54940] [db:swissprot] |
| 26449053_c3_54 | 1894 | 5548 | 459 | 152 | 205 | 1.10E-16 | [ac:p37664] [gn:yiac] [or:*escherichia coli*] [de:hypothetical 17.1 kd protein in tag-bisc intergenic region (o146b)] [sp:p37664] [db:swissprot] |
| 26455313_c2_124 | 1895 | 5549 | 795 | 264 | 429 | 2.00E-40 | [ac:t70066] [pn:capsular polysaccharide biosynthesis homolog ywqc] [gn:ywqc] [or:*bacillus subtilis*] [db:pir] |
| 26459687_c3_12 | 1896 | 5550 | 486 | 161 | 58 | 0.65 | [ac:s63976:s63975:s53361] [pn:myosin regulatory light chain] [cl:calmodulin:calmodulin repeat homology] [or:*aphysia californica*] [sr:, california sea hare] [db:pir] |
| 26460925_f1_7 | 1897 | 5551 | 1251 | 416 | 1449 | 1.70E-148 | [ac:p42020] [gn:pep1] [or:*lactococcus lactis*] [sr:,subspcremoris:streptococcus cremoris] [ec:3.4.11.—] [de:peptidase t, (aminotripeptidase) (tripeptidase)] [sp:p42020] [db:swissprot] |
| 26461012_c3_27 | 1898 | 5552 | 921 | 306 | 440 | 1.40E-41 | [ac:d69975] [pn:anti-sigma factor homolog yrhm] [gn:yrhm] [or:*bacillus subtilis*] [db:pir] |
| 26463966_f2_6 | 1899 | 5553 | 849 | 282 | 660 | 6.70E-65 | [ln:ehnapbc] [ac:aj000346] [pn:napc protein] [gn:napc] [fn:putative tetracyclin efflux protein] [or:*enterococcus hirae*] [db:genpept-bct] [de:*enterococcus hirae* napb and napc genes.] [nt:telve predicted transmembranous helices] [le:756] [re:1958] [di:direc |
| 26464800_f2_22 | 1900 | 5554 | 684 | 227 | 363 | 2.00E-33 | [ac:69798] [pn:conserved hypothetical protein yetf] [gn:yetf] [or:*bacillus subtilis*] [db:pir] |
| 26567250_c3_195 | 1901 | 5555 | 1161 | 386 | 102 | 0.08 | [ac:jc5148] [pn:hepatocyte growth factor receptor:c-met] [gn:c-met] [cl:hepatocyte growth factor receptor:protein kinase homology] [or:*xenopus laevis*] [sr:, african clawed frog] [db:pir] |
| 26569552_c2_5 | 1902 | 5556 | 207 | 68 | 160 | 1.00E-11 | [ac:p54947] [gn:yxeh:iplb] [or:*bacillus subtilis*] [de:hypothetical 30.2 kd protein in idh-deor intergenic region] [sp:p54947] [db:swissprot] |
| 26570450_c1_44 | 1903 | 5557 | 603 | 200 | 62 | 0.42 | [ln:hsu64491] [ac:u64491] [pn:immunoglobulin heavy chain variable region] [or:*homo sapiens*] [sr:human] [db:genpept-pri2] [de:human rheumatoid arthritis synovium immunoglobulin heavy chainvariable region mrna, partial cds.] [le:<1] [re: |
| 26571012_c1_39 | 1904 | 5558 | 726 | 241 | 1174 | 2.30E-119 | [ac:p43454] [gn:atpb] [or:*enterococcus faecalis*] [sr:,*streptococcus faecalis*] [ec:3.6.1.34] [de:atp synthase a chain, (protein 6)] [sp:p43454] [db:swissprot] |
| 26573512_c2_49 | 1905 | 5559 | 414 | 137 | 641 | 6.90E-63 | [ac:p43659] [gn:smpb] [or:*enterococcus faecalis*] [sr:,*streptococcus faecalis*] [de:small protein b homolog] [sp:p43659] [db:swissprot] |
| 265762_f2_8 | 1906 | 5560 | 642 | 213 | 564 | 1.00E-54 | [ln:stacadres] [ac:110909] [gn:ds rf] [or:*staphylococcus aureus*] [sr:*staphylococcus aureus* (strain r35) dna] [db:genpept-bct] [de:*staphylococcus aureus* tnpa gene, tnpb gene, tnpc gene, ds rf gene,complete cds's; cadmium resistance (cada) gene, complete cd |
| 26585908_c1_55 | 1907 | 5561 | 189 | 62 | 139 | 1.20E-09 | [ln:lllvsfpep] [ac:x99710] [pn:methyltransferase] [or:*lactococcus lactis*] [db:genpept-bct] [de:*l.lactis* orf, genes homologous to vsf-1 and pepf2 and gene encodingprotein homologous to methyltransferase.] [nt:homology with (d64004)] [le:3803] [re:4486] [di |
| 26587812_c1_27 | 1908 | 5562 | 702 | 233 | 798 | 1.60E-79 | [ac:p44989] [gn:sgbe:hi1025] [or:*haemophilus influenzae*] [ec:5.1.—.—] [de:probable sugar isomerase sgbe,] [sp:p44989] [dbsswissprot] |

TABLE 2-continued

| Orf | NT Seq ID | AA Seq ID | NT Orf length | AA Orf length | Score | Probability | Description |
|---|---|---|---|---|---|---|---|
| 26589437_c2_58 | 1909 | 5563 | 1617 | 538 | 86 | 0.011 | [ln:af019983] [ac:af019983] [gn:r1062] [or:dictyostelium discoideum] [dbgenpept-inv] [de:dictyostelium discoideum r1062 gene, partial cds.] [nt:similar to s. cerevisiae probable membrane protein] [le:<1] [re:1655] [di:direct] |
| 26594051_c2_97 | 1910 | 5564 | 1653 | 550 | 1882 | 2.20E-194 | [ln:kpu95087] [ac:u95087] [pn:mdca] [gn:mdca] [or:klebsiella pneumoniae] [dbgenpept-bct] [de:klebsiella pneumoniae malonate decarboxylase gene cluster (mdca, mdcb, mdcc, mdcd, mdce, mdcf, mdcg, mdch, mdcr) genes, completecds.] [nt:acyl carrier protein tra |
| 26595012_c1_9 | 1911 | 5565 | 264 | 88 | 68 | 0.036 | [ac:p29705] [gn:atp1;unc1] [or:propionigenium modestum] [de:atp synthase protein i, sodium ion specific] [sp:p29705] [dbswissprot] |
| 26595441_c2_15 | 1912 | 5566 | 642 | 213 | 121 | 1.30E-07 | [ac:p06533] [gn:sin1;sin:rfad] [or:bacillus subtilis] [de:sinr protein] [sp:p06533] [dbswissprot] |
| 26596075_f1_6 | 1913 | 5567 | 363 | 120 | 291 | 8.50E-26 | [ln:llu35629] [ac:u35629] [pn:unknown] [or:lactococcus lactis lactis] [dbgenpept-bct] [de:lactococcus lactis plasmid psrq802 abortive infection protein k(abik) gene, complete cds.] [nt:orf3] [le:376] [re:726] [di:direct] |
| 26597151_c1_46 | 1914 | 5568 | 1194 | 397 | 1263 | 8.50E-129 | [ln:s78870] [ac:s78870] [pn:galactokinase] [gn:galk] [or:streptococcus thermophilus] [sr:streptococcus thermophilus f410] [db:genpept-bct] [de:galk=galactokinase [streptococcus thermophilus, f410, genomic, 1500nt].] [nt:this sequence comes from fig. 3. au |
| 26598125_c3_25 | 1915 | 5569 | 195 | 64 | 69 | 0.25 | [ac:s75730;s50064] [pn:biof protein] [or:synechocystis sp.] [sr:pcc 6803, , pcc 6803] [sr:pcc 6803.] [db:pir] |
| 26598388_c2_18 | 1916 | 5570 | 186 | 61 | 46 | 0.026 | [ln:cet22c8] [ac:z49071] [pn:t22c8.5] [or:caenorhabditis elegans] [dbgenpept-inv] [de:caenorhabditis elegans cosmid t22c8, complete sequence.] [nt:similar to c2h2 type zinc finger protein] [le:12937:14103:142861;14608] [re:13133;14201;14396;14701] [di:dir |
| 26598458_c1_6 | 1917 | 5571 | 381 | 126 | 305 | 2.80E-27 | [ac:p37547] [gn:yabf] [or:bacillus subtilis] [de:hypothetical 20.7 kd protein in mets-ksga intergenic region] [sp:p37547] [dbswissprot] |
| 26599213_c2_16 | 1918 | 5572 | 1272 | 423 | 552 | 1.90E-53 | [ac:p54389] [gn:ypia] [or:bacillus subtilis] [de:hypothetical 48.3 kd protein in qcra 5'region] [sp:p54389] [dbswissprot] |
| 26600027_c2_174 | 1919 | 5573 | 411 | 136 | 96 | 0.00038 | [ac:p15935] [gn:uvia] [or:clostridium perfringens] [de:bacteriocin uvia] [sp:p15935] [dbswissprot] |
| 26600328_f2_19 | 1920 | 5574 | 339 | 112 | 278 | 2.00E-24 | [ac:p23532] [gn:lacf] [or:lactococcus lactis] [sr:subsplactis:streptococcus lactis] [ec:2.7.1.69] [de:(ec 2.7.1.69) (eiii-lac)] [sp:p23532] [dbswissprot] |
| 26604061_c2_31 | 1921 | 5575 | 399 | 132 | 226 | 6.60E-19 | [ln:cbaj2527] [ac:aj002527] [pn:gutal] [gn:gutal] [fn:enzyme iibcgut of the glucitol pts. polypeptide] [or:clostridium beijerinckii] [db:genpept-bct] [de:clostridium beijerinckii glucitol transport gene system.] [le:140] [re:688] [di:direct] |
| 26604155_c2_67 | 1922 | 5576 | 231 | 76 | 65 | 0.073 | [ac:q06995] [gn:rfap] [or:salmonella typhimurium] [de:lipopolysaccharide core biosynthesis protein rfap (fragment)] [sp:q06995] [dbswissprot] |
| 26604558_f1_2 | 1923 | 5577 | 309 | 102 | 185 | 1.40E-14 | [ac:d69873] [pn:hypothetical protein ylan] [gn:ylan] [or:bacillus subtilis] [db:pir] |
| 26610278_f3_5 | 1924 | 5578 | 1584 | 527 | 1043 | 1.70E-105 | [ac:d69813] [pn:abc transporter (atp-binding protein) homolog yfmm] [gn:yfmm] [or:bacillus subtilis] [db:pir] |
| 26612780_f2_2 | 1925 | 5579 | 672 | 224 | 570 | 2.30E-55 | [acc:70020] [pn:conserved hypothetical protein yusb] [gn:yusb] [or:bacillus subtilis] [db:pir] |
| 26615760_f2_31 | 1926 | 5580 | 933 | 310 | 639 | 1.10E-62 | [ac:p06567] [gn:dnai] [or:bacillus subtilis] [de:primosomal protein dnai] [sp:p06567] [dbswissprot] |

TABLE 2-continued

| Orf | NT Seq ID | AA Seq ID | NT Orf length | AA Orf length | Score | Probability | Description |
|---|---|---|---|---|---|---|---|
| 26617927_f1_1 | 1927 | 5581 | 642 | 213 | 87 | 0.09 | [ln:dau51579] [ac:u51579] [pn:yolk protein 1] [or:drosophila adunca] [db:genpept-inv] [de:drosophila adunca yolk protein 1 gene, partial cds.] [le:<1:115:270:320:572:727] [re:93:190:295:562:652:768] [di:directjoin] |
| 26620432_c2_28 | 1928 | 5582 | 720 | 239 | 409 | 2.70E-38 | [ac:s77250] [pn:hypothetical protein] [or:synechocystis sp.] [sr:pcc 6803, , pcc 6803.] [sr:pcc 6803.] [db:pir] |
| 26678587_f1_2 | 1929 | 5583 | 372 | 123 | 145 | 2.50E-10 | [ln:mtccgnme] [ac:z47547] [gn:putative orf79.1] [fn:unknown] [or:mitochondrion chondrus crispus] [sr:carragheen] [db:genpept-pln] [de:c.crispus complete mitochondrial genome.] [nt:unique orf] [le:5713] [re:5952] [di:direct] |
| 26678587_f3_18 | 1930 | 5584 | 372 | 123 | 145 | 2.50E-10 | [ln:mtccgnme] [ac:z47547] [gn:putative orf79.1] [fn:unknown] [or:mitochondrion chondrus crispus] [sr:carragheen] [db:genpept-pln] [de:c.crispus complete mitochondrial genome.] [nt:unique orf] [le:5713] [re:5952] [di:direct] |
| 26679682_c2_51 | 1931 | 5585 | 912 | 303 | 774 | 5.60E-77 | [ac:a69879] [pn:conserved hypothetical protein yloq] [gn:yloq] [or:bacillus subtilis] [db:pir] |
| 26679687_c3_29 | 1932 | 5586 | 231 | 76 | 59 | 0.065 | [ln:yscgcn4b] [ac:k02649] [gn:gcn4] [or:saccharomyces cerevisiae] [sr:s. cerevisiae dna, clone c101-1] [db:genpept-pln] [de:yeast (s. cerevisiae) general control regulatory gene gcn4 andarg-trna-3a gene.] [nt:general control protein (gcn4)] [le:962] [re:1 |
| 26679688_c3_54 | 1933 | 5587 | 582 | 193 | 142 | 5.20E-10 | [ac:q01620] [gn:jag] [or:bacillus subtilis] [de:jag protein (spoiiij associated protein)] [sp:q01620] [db:swissprot] |
| 26679693_f3_9 | 1934 | 5588 | 243 | 80 | 98 | 2.40E-05 | [ac:ps0053] [pn:hypothetical protein 65 (ahrc 5' region)] [or:bacillus subtilis] [db:pir] |
| 26680342_c2_74 | 1935 | 5589 | 729 | 242 | 89 | 0.036 | [ln:mdu94956] [ac:u94956] [pn:rna polymerase beta-subunit] [gn:rpoc2] [or:chloroplast merxmuellera disticha] [sr:merxmuellera disticha] [db:genpept-pln] [de:merxmuellera disticha rna polymerase beta-subunit (rpoc2) gene, chloroplast gene encoding chloropla |
| 26682812_f1_2 | 1936 | 5590 | 660 | 219 | 281 | 9.70E-25 | [ac:a69070] [pn:sugar fermentation stimulation protein] [gn:mth1521] [or:methanobacterium thermoautotrophicum] [db:pir] |
| 26682937_f2_11 | 1937 | 5591 | 555 | 184 | 93 | 0.01 | [ln:mtcy6g11] [ac:z92774] [pn:unknown] [gn:mtcy06g11.04c] [or:mycobacterium tuberculosis] [db:genpept-bct] [de:mycobacterium tuberculosis cosmid scy06g11.] [nt:mtcy06g11.04c, probable transcriptional repressor,] [le:3544] [re:4146] [di:complement] |
| 26689067_c3_55 | 1938 | 5592 | 1068 | 355 | 814 | 3.20E-81 | [ac:i69626] [pn:pts fructose-specific enzyme iibc component frua] [gn:frua] [or:bacillus subtilis] [db:pir] |
| 26689825_c3_77 | 1939 | 5593 | 354 | 117 | 89 | 0.00022 | [ac:a69469] [pn:conserved hypothetical protein af1754] [or:archaeoglobus fulgidus] [db:pir] |
| 26695887_f2_12 | 1940 | 5594 | 606 | 201 | 171 | 4.40E-13 | [ac:f69065] [pn:hypothetical protein mth1490] [gn:mth1490] [or:methanobacterium thermoautotrophicum] [db:pir] |
| 26740942_c2_6 | 1941 | 5595 | 261 | 86 | 296 | 2.50E-26 | [ac:p50855] [gn:riba] [or:actinobacillus pleuropneumoniae] [sr:haemophilus pleuropneumoniae] [ec:3.5.4.25] [de:phosphate synthase (dhbp synthase)] [sp:p50855] [db:swissprot] |
| 26744002_c2_81 | 1942 | 5596 | 954 | 317 | 976 | 2.20E-98 | [ac:q59935] [gn:pmi] [or:streptococcus mutans] [ec:5.3.1.8] [de:(pmi) (phosphohexomutase)] [sp:q59935] [db:swissprot] |
| 26744715_f3_8 | 1943 | 5597 | 417 | 139 | 542 | 2.10E-51 | [ln:llaj109] [ac:aj000109] [pn:carbamoylphosphate synthetase] [gn:carb] [or:lactococcus lactis] [db:genpept-bct] [de:lactococcus lactis carb and gpo genes.] [le:986] [re:4180] [di:direct] |
| 26745337_c1_13 | 1944 | 5598 | 972 | 323 | 651 | 6.00E-64 | [ac:f69795] [pn:conserved hypothetical protein yerq] [gn:yerq] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 26750183_c3_21 | 1945 | 5599 | 246 | 81 | 68 | 0.41 | [ln:cele24h12] [ac:caf025451] [gn:c24h12.1] [or:caenorhabditis elegans] [sr:caenorhabditis elegans strain=bristol n2] [db:genpept-inv] [de:caenorhabditis elegans cosmid c24h12.] [le:35668:35794:36104:36476] [re:35742:35870: 36361:36791] [di:directjoin] |
| 26751552_c1_100 | 1946 | 5600 | 294 | 97 | 69 | 0.27 | [ln:ae000791] [ac:ae000791] [pn:conserved hypothetical protein] [gn:bbc02] [or:borrelia burgdorferi] [sr:lyme disease spirochete] [db:genpept-bct] [de:borrelia burgdorferi plasmid cp9, complete plasmid sequence.] [nt:similar to gb:u03641 pid:458217 percen |
| 26752187_f2_29 | 1947 | 5601 | 885 | 294 | 724 | 1.10E-71 | [ac:b69853] [pn:transcriptional regulator (laci family) homolog yjmh] [gn:yjmh] [or:bacillus subtilis] [db:pir] |
| 26753802_c1_62 | 1948 | 5602 | 645 | 214 | 782 | 7.90E-78 | [ac:h69627] [pn:signal recognition particle ftsy] [gn:ftsy] [or:bacillus subtilis] [db:pir] |
| 26756512_c3_75 | 1949 | 5603 | 1548 | 515 | 1400 | 2.60E-143 | [ac:p54547] [gn:zwf] [or:bacillus subtilis] [ec:1.1.1.49] [de:glucose-6-phosphate 1-dehydrogenase, (g6pd)] [sp:p54547] [db:swissprot] |
| 26756677_f2_7 | 1950 | 5604 | 612 | 203 | 523 | 2.20E-50 | [ac:c69777] [pn:glyceraldehyde 3-phosphate dehydrogenase () homolog ydea] [gn:ydea] [or:bacillus subtilis] [db:pir] |
| 26757836_c2_116 | 1951 | 5605 | 330 | 109 | 52 | 0.88 | [ac:jh0116:b32162] [pn:protein-tyrosine kinase-related protein (clone fd22)] [cl:unassigned ser/thr or tyr-specific protein kinases:protein kinase homology] [or:mus musculus] [sr:,house mouse] [db:pir] |
| 26757837_f1_3 | 1952 | 5606 | 456 | 151 | 178 | 8.00E-14 | [ac:q57951] [gn:mj0531] [or:methanococcus jannaschii] [de:hypothetical protein mj0531] [sp:q57951] [db:swissprot] |
| 26757885_c1_149 | 1953 | 5607 | 1803 | 600 | 2750 | 2.30E-286 | [ac:q08636] [gn:tnpa] [or:enterococcus hirae] [ec:3.6.1.34] [de:translocating atpase subunit a)] [sp:q08636] [db:swissprot] |
| 26757937_c1_15 | 1954 | 5608 | 558 | 185 | 394 | 1.00E-36 | [ac:p50838] [gn:ypsa] [or:bacillus subtilis] [de:hypothetical 21.1 kd protein in cotd-kdud intergenic region] [sp:p50838] [db:swissprot] |
| 26758262_f3_42 | 1955 | 5609 | 684 | 227 | 119 | 2.90E-05 | [ac:i40868] [pn:hypothetical protein 3] [or:clostridium perfringens] [db:pir] |
| 26758418_c2_23 | 1956 | 5610 | 525 | 174 | 263 | 7.90E-23 | [ac:o05404] [gn:sigv] [or:bacillus subtilis] [de:rna polymerase sigma factor sigv] [sp:o05404] [db:swissprot] |
| 26758462_c2_168 | 1957 | 5611 | 567 | 188 | 288 | 1.80E-25 | [ac:b69985] [pn:hypothetical protein yshb] [gn:yshb] [or:bacillus subtilis] [db:pir] |
| 26760762_f1_3 | 1958 | 5612 | 2115 | 704 | 359 | 7.20E-30 | [ac:a69768] [pn:transcriptional antiterminator (bglg famil) homolog ydaa] [gn:ydaa] [or:bacillus subtilis] [db:pir] |
| 26761300_f2_11 | 1959 | 5613 | 291 | 96 | 368 | 5.90E-34 | [ac:o05991:s11367:h69700] [pn:ribosomal protein s17:ribosomal protein bs16] [gn:rpsq] [cl:escherichia coli ribosomal protein s17] [or:bacillus subtilis] [db:pir] |
| 26761305_c2_9 | 1960 | 5614 | 240 | 79 | 69 | 0.12 | [ac:g69352] [pn:branched-chain amino acid abc transporter, atp-binding protein (brag-2) homolog] [or:archaeoglobus fulgidus] [db:pir] |
| 26761575_f2_19 | 1961 | 5615 | 831 | 276 | 485 | 2.30E-46 | [ac:f69841] [pn:conserved hypothetical protein yitu] [gn:yitu] [or:bacillus subtilis] [db:pir] |
| 26767767_c2_16 | 1962 | 5616 | 519 | 172 | 471 | 7.20E-45 | [ac:p08186] [gn:manxptsl:gptb] [or:escherichia coli] [ec:2.7.1.69] [de:(ec 2.7.1.69) (eiii-man)] [sp:p08186] [db:swissprot] |
| 26767800_f3_14 | 1963 | 5617 | 429 | 142 | 113 | 3.90E-06 | [ln:af026542] [ac:af026542:i11653] [pn:tnpa] [gn:tnpa] [or:streptococcus pyogenes] [db:genpept-bct] [de:streptococcus pyogenes ff22 lantibiotic (scn) gene cluster region containing: scnk, scnr, streptococcin a-ff22 precursor (scna), scnai, scnm, scnt, scnf, |
| 26772260_f3_14 | 1964 | 5618 | 215 | 72 | 150 | 2.70E-10 | [ac:p43472] [gn:scrr] [or:pediococcus pentosaceus] [de:sucrose operon regulatory protein] [sp:p43472] [db:swissprot] |
| 26774187_f1_3 | 1965 | 5619 | 453 | 150 | 102 | 4.20E-05 | [ac:q10548] [gn:mtcy31.15c] [or:mycobacterium tuberculosis] [de:hypothetical 16.1 kd protein cy31.15c precursor] [sp:q10548] [db:swissprot] |

TABLE 2-continued

| Orf | NT Seq ID | AA Seq ID | NT Orf length | AA Orf length | Score | Probability | Description |
|---|---|---|---|---|---|---|---|
| 26775050_c3_29 | 1966 | 5620 | 1398 | 465 | 795 | 3.30E-79 | [ac:p54104] [gn:brnq] [or:lactobacillus delbrueckii] [sr:,subsp.lactis] [de:branched chain amino acid transport system carrier protein] [sp:p54104] [db:swissprot] |
| 26775051_f3_165 | 1967 | 5621 | 456 | 151 | 259 | 2.10E-22 | [ac:d69843] [pn:conserved hypothetical protein yjbd] [gn:yjbd] [or:bacillus subtilis] [db:pir] |
| 26775312_c3_19 | 1968 | 5622 | 876 | 291 | 450 | 1.20E-42 | [ac:p26298] [or:lactobacillus plantarum] [ec:1.1.1.28] [de:d-lactate dehydrogenase, (d-ldh)] [sp:p26298] [db:swissprot] |
| 26775936_c3_145 | 1969 | 5623 | 237 | 78 | 91 | 0.0011 | [ac:h70041] [pn:transcriptional regulator homolog yvhj] [gn:yvhj] [or:bacillus subtilis] [db:pir] |
| 26776461_c1_24 | 1970 | 5624 | 903 | 300 | 809 | 1.10E-80 | [ac:g69796] [pn:lactose permease homolog yesp] [gn:yesp] [or:bacillus subtilis] [db:pir] |
| 26776580_c2_21 | 1971 | 5625 | 699 | 232 | 472 | 5.60E-45 | [ac:p31547] [gn:yaee] [or:escherichia coli] [de:hypothetical abc transporter permease protein yaee] [sp:p31547] [db:swissprot] |
| 26776700_c1_49 | 1972 | 5626 | 1305 | 434 | 994 | 2.70E-100 | [ac:af000658] [pn:putative serine protease] [gn:sphtra] [or:streptococcus pneumoniae] [db:genpept-bct] [de:streptococcus pneumoniae r801 trna-arg gene, partial sequence, andputative serine protease (sphtra), spspoj (spspoj), initiatorprotein |
| 26777217_c1_15 26801875_f2_6 | 1973 1974 | 5627 5628 | 2028 306 | 676 101 | 1958 37 | 1.90E-202 0.35 | [ac:s71016] [pn:helicase recg homolog] [or:streptococcus pneumoniae] [db:pir] [ln:rat.thypomu] [acc:m57705] [pn:truncated thyroid peroxidase] [de:thyroid peroxidase] [or:rattus norvegicus] [sr:rat thyroid stimulating hormone (tsh) stimulated frt15 cell, cdn] [db:genpept-rod] [de:rat truncated thyroid peroxidase mrna, 3' end.] [le:1] |
| 26803192_f3_5 | 1975 | 5629 | 507 | 168 | 283 | 6.00E-25 | [ac:p35154] [gn:ypug] [or:bacillus subtilis] [de:hypothetical 29.6 kd protein in ribt-dacb intergenic region (orfx7)] [sp:p35154] [db:swissprot] |
| 26803817_c3_108 | 1976 | 5630 | 216 | 71 | 55 | 0.064 | [ac:s66773] [pn:hypothetical protein yo1080c:hypothetical protein ol101] [or:saccharomyces cerevisiae] [db:pir] [mp:151] |
| 26804838_c1_180 | 1977 | 5631 | 870 | 289 | 315 | 2.40E-28 | [ac:p08188] [gn:manz;ptsm;gptb] [or:escherichia coli] [de:(eii-m-man)] [sp:p08188] [db:swissprot] |
| 26808437_c3_26 | 1978 | 5632 | 753 | 250 | 92 | 0.048 | [ln:cmblab] [acc:x96858] [pn:beta-lactamase] [gn:blab] [or:chryseobacterium meningosepticum] [db:genpept-una] [ec:3.5.2.6] [de:c.meningosepticum blab gene.] [le:114] [re:863] [di:direct] |
| 26813830_c1_51 | 1979 | 5633 | 540 | 179 | 520 | 4.60E-50 | [ac:a69984] [pn:endo-1,4-beta-glucanase homolog ysdc] [gn:ysdc] [or:bacillus subtilis] [db:pir] |
| 26820337_c1_39 | 1980 | 5634 | 213 | 70 | 360 | 4.10E-33 | [ln:stiss1sa] [acc:x94761] [pn:transposase] [or:streptococcus thermophilus] [db:genpept-bct] [de:s.thermophilus iss1sa dna for transposase.] [le:113] [re:793] [di:direct] |
| 26822142_c1_8 | 1981 | 5635 | 909 | 302 | 258 | 2.70E-22 | [ln:llpflmg13] [ac:aj000325] [pn:putative membrane protein] [gn:orfa] [or:lactococcus lactis] [db:genpept-bct] [de:lactococcus lactis pfl gene (strain mg1363).] [le:270] [re:1187] [di:direct] |
| 26828200_c3_66 | 1982 | 5636 | 225 | 74 | 68 | 0.015 | [ln:s:crcs1] [acc:s53046] [pn:rcs1 protein] [gn:rcs1] [or:saccharomyces cerevisiae] [sr:baker's yeast] [db:genpept-pln] [de:yeast rcs1 gene involved in cell size control.] [sp:p22149] [le:262] [re:1227] [di:direct] |
| 26829502_c1_27 | 1983 | 5637 | 378 | 125 | 173 | 2.70E-13 | [ac:d69843] [pn:conserved hypothetical protein yjbd] [gn:yjbd] [or:bacillus subtilis] [db:pir] |
| 26835942_c2_55 | 1984 | 5638 | 603 | 200 | 252 | 1.20E-21 | [ln:cef39b2] [acc:z92834] [pn:f39b2.3] [or:caenorhabditis elegans] [db:genpept-inv] [de:caenorhabditis elegans cosmid f39b2, complete sequence.] [le:6055:6490:t6768] [re:6406:6572:7319] [di:directjoin] |
| 26836055_c1_11 | 1985 | 5639 | 1020 | 339 | 246 | 5.00E-21 | [ac:q46125] [gn:hisj] [or:campylobacter jejuni] [de:histidine-binding protein precursor (hbp) (p29)] [sp:q46125] [db:swissprot] |

TABLE 2-continued

| Orf | NT Seq ID | AA Seq ID | NT Orf length | AA Orf length | Score | Probability | Description |
|---|---|---|---|---|---|---|---|
| 26837762_f1_1 | 1986 | 5640 | 198 | 65 | 50 | 0.96 | [ac:p43556] [gn:yfl047w] [or:saccharomyces cerevisiae] [sr:;baker's yeast] [de:hypothetical 82.2 kd protein in emp47-sec53 intergenic region] [sp:p43556] [db:swissprot] |
| 26839508_f3_9 | 1987 | 5641 | 198 | 65 | 258 | 2.70E-22 | [ac:d69701] [pn:ribosomal protein s21 rpsu] [gn:rpsu] [or:bacillus subtilis] [db:pir] |
| 26839637_c2_71 | 1988 | 5642 | 882 | 293 | 575 | 6.80E-56 | [ac:a56641] [pn:probable membrane transport protein] [or:clostridium perfringens] [db:pir] |
| 26839688_f3_27 | 1989 | 5643 | 453 | 150 | 613 | 6.40E-60 | [ac:p14577] [gn:rplp] [or:bacillus subtilis] [de:50s ribosomal protein 116] [sp:p14577] [db:swissprot] |
| 26850840_c2_45 | 1990 | 5644 | 552 | 183 | 345 | 1.60E-31 | [ac:b69804] [pn:hypothetical protein yfio] [gn:yfio] [or:bacillus subtilis] [db:pir] |
| 26852187_c3_128 | 1991 | 5645 | 2109 | 702 | 146 | 1.00E-06 | [ac:i48951] [pn:oncofetal antigen] [or:mus musculus] [sr:, house mouse] [db:pir] |
| 26852307_c3_109 | 1992 | 5646 | 2568 | 855 | 778 | 1.30E-151 | [ac:h69877] [pn:calcium-transporting atpase homolog ylob] [gn:ylob] [or:bacillus subtilis] [db:pir] |
| 26854677_c2_25 | 1993 | 5647 | 723 | 240 | 345 | 1.60E-31 | [ac:p29284] [gn:flp] [or:lactobacillus casei] [de:probable transcriptional regulator flp] [sp:p29284] [db:swissprot] |
| 271068_f3_81 | 1994 | 5648 | 1626 | 541 | 841 | 4.40E-84 | [ln:cpu15027] [ac:u15027] [pn:tnpx] [gn:tnpx] [fn:site-specific recombinase involved in the] [or:clostridium perfringens] [db:genpept-bct] [de:clostridium perfringens transposon tn4451 site-specific recombinase(tnpx), chloramphenicol acetyltransferase (ca |
| 2735302_f3_13 | 1995 | 5649 | 390 | 129 | 82 | 0.08 | [ac:q06081] [gn:mxij] [or:shigella flexneri] [de:lipoprotein mxij precursor] [sp:q06081] [db:swissprot] |
| 2736437_c2_85 | 1996 | 5650 | 1452 | 483 | 564 | 1.00E-54 | [ac:d69852] [pn:na+galactoside symporter homolog yjmb] [gn:yjmb] [or:bacillus subtilis] [db:pir] |
| 2751636_f2_57 | 1997 | 5651 | 204 | 67 | 59 | 0.28 | [ac:ph1573] [pn:t-cell receptor beta chian v region (clone a, clone b and clone c)] [cl:immunoglobulin v region:immunoglobulin homology] [or:homo sapiens] [sr:, man] [db:pir] |
| 275262_c2_11 | 1998 | 5652 | 972 | 323 | 164 | 7.40E-12 | [ln:mtv036] [ac:al021931] [pn:hypothetical protein mtv036.01c] [gn:mtv036.01c] [or:mycobacterium tuberculosis] [db:genpept] [de:mycobacterium tuberculosis sequence v036.] [nt:mtv036.01c. len: 197. unknown, weak similarity to] [le:117] [re:710] [di:complem |
| 2774087_c1_16 | 1999 | 5653 | 927 | 308 | 1120 | 1.20E-113 | [ln:instranspo] [ac:1346675] [pn:transposase] [or:insertion sequence is1251] [sr:insertion sequence is1251 dna] [db:genpept-bct] [de:insertion sequence is1251 from enterococcus faecium transposasegene, complete cds.] [nt:putative] [le:128] [re:1417] [di: |
| 2813125_c3_18 | 2000 | 5654 | 654 | 217 | 249 | 2.40E-21 | [ln:lah222725] [ac:aj222725] [pn:hypothetical protein] [gn:orf-195a] [fn:unknown] [or:lactobacillus helveticus] [db:genpept-bct] [de:lactobacillus helveticus plasmid plh1 complete sequence, strainatcc 15009.] [le:4951] [re:5538] [di:complement |
| 2813788_c2_29 | 2001 | 5655 | 960 | 319 | 1456 | 3.00E-149 | [ac:p23496] [gn:lacx] [or:lactococcus lactis] [sr:,subsplactis:streptococcus lactis] [de:lacx protein, plasmid] [sp:p23496] [db:swissprot] |
| 2819186_c3_48 | 2002 | 5656 | 441 | 146 | 57 | 0.67 | [ac:c64692] [pn:hypothetical protein hp1381] [or:helicobacter pylori] [db:pir] |
| 282903_c3_206 | 2003 | 5657 | 1110 | 369 | 1824 | 3.00E-188 | [ac:q08637] [gn:ntpb] [or:enterococcus hirae] [ec:3.6.1.34] [de:translocating atpase subunit b)] [sp:q08637] [db:swissprot] |
| 2834687_c2_20 | 2004 | 5658 | 789 | 262 | 357 | 8.60E-33 | [ac:d70044] [pn:transcriptional regulator (gntr family) homolog yvoa] [gn:yvoa] [or:bacillus subtilis] [db:pir] |
| 283562_f3_29 | 2005 | 5659 | 507 | 168 | 250 | 1.90E-21 | [ac:b69616] [pn:cell-division initiation protein (septum placement) diviva] [gn:diviva] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 2866682_c3_147 | 2006 | 5660 | 237 | 78 | 74 | 0.11 | [ln:humcacnllg] [ac:129536] [pn:calcium channel 1-type alpha 1 subunit] [gn:cacnlla1] [fn:calcium channel] [or:*homo sapiens*] [sr:*homo sapiens* (tissue library: *lambda zapii*) adult heart cdna t] [db:genpept-pri1] [de:human calcium channel 1-type alpha 1 sub |
| 2867937_c1_198 | 2007 | 5661 | 222 | 73 | 63 | 0.25 | [ln:rnu56859] [ac:u56859] [pn:rpf-i] [gn:rpf-i] [or:*rattus norvegicus*] [sr:norway rat strain=sprague-dawley] [db:genpept-rod] [de:*rattus norvegicus* heparan sulfate proteoglycan, perlecan domain i(rpf-i) mrna, partial cds.] [nt:heparan sulfate proteoglycan |
| 289662_c2_16 | 2008 | 5662 | 234 | 77 | 104 | 3.20E-05 | [ln:padldh] [ac:x70925] [pn:d-lactate dehydrogenase] [gn:d-ldh] [or:*pediococcus acidilactici*] [db:genpept-bct] [ec:1.1.1.28] [de:*p.acidilactici* gene for d-lactate dehydrogenase.] [le:961] [re:1956] [di:direct] |
| 2906450_c2_54 | 2009 | 5663 | 228 | 75 | 61 | 0.44 | [ln:hhcd8bh7] [ac:y114174] [pn:cd8 beta chain] [or:*gallus gallus*] [sr:chicken] [db:genpept-vrt] [de:*g.gallus* mrna for cd8 beta chain, substrain h7.] [le:<1] [re: |
| 2912587_c3_32 | 2010 | 5664 | 1029 | 342 | 174 | 1.20E-09 | [ln:ceu49263] [ac:u49263] [pn:non-muscle myosin heavy chain ii] [gn:nmy-2] [or:*caenorhabditis elegans*] [sr:*caenorhabditis elegans* strain=n2 bristol] [db:genpept-inv] [de:*caenorhabditis elegans* non-muscle myosin heavy chain ii (nmy-2)mrna, complete cds.] [ |
| 2912675_f2_2 | 2011 | 5665 | 189 | 62 | 57 | 0.57 | [ac:s64940] [pn:probable membrane protein ylr104w:hypothetical protein 12730] [or:*saccharomyces cerevisiae*] [db:pir] [mp:12r] |
| 2913885_f2_11 | 2012 | 5666 | 369 | 122 | 1936 | 4.30E-206 | [ac:q04707] [gn:pona:exp2] [or:*streptococcus pneumoniae*] [de:penicillin-binding protein 1a (pbp-1a)] [sp:q04707] [db:swissprot] |
| 2928817_f3_9 | 2013 | 5667 | 2472 | 823 | | | |
| 292943_c1_29 | 2014 | 5668 | 1173 | 390 | 388 | 2.80E-38 | [ac:e69351] [pn:phosphoglycerate dehydrogenase (sera) homolog] [or:*archaeoglobus fulgidus*] [db:pir] |
| 2929503_c2_30 | 2015 | 5669 | 651 | 216 | 218 | 1.60E-16 | [ac:p13267] [gn:polc:dnae:dnaf:muti] [or:*bacillus subtilis*] [ec:2.7.7.7] [de:dna polymerase iii, alpha chain,] [sp:p13267] [dbsswissprot] |
| 29297127_f3_48 | 2016 | 5670 | 783 | 260 | 89 | 0.16 | [ac:s55316] [pn:mucin (clone pgm-2b)] [or:*sus scrofa* domestica] [sr:, domestic pig] [db:pir] |
| 29297250_c2_101 | 2017 | 5671 | 219 | 72 | 63 | 0.27 | [ac:s62349] [pn:171-3 protein] [gn:171-3] [or:*drosophila melanogaster*] [db:pir] |
| 29298437_c1_106 | 2018 | 5672 | 1449 | 482 | 162 | 6.90E-09 | [ac:p39854] [gn:cape] [or:*staphylococcus aureus*] [de:cape protein] [sp:p39854] [db:swissprot] |
| 29298442_c3_32 | 2019 | 5673 | 1221 | 406 | 1143 | 4.40E-116 | [ac:q60040] [gn:uxua] [or:*thermotoga neapolitana*] [ec:4.2.1.8] [de:mannonate dehydratase, (d-mannonate hydrolase)] [sp:q60040] [db:swissprot] |
| 29299087_f2_16 | 2020 | 5674 | 255 | 84 | 65 | 0.073 | [ln:af004602] [ac:af004602] [pn:nadh dehydrogenase subunit 1] [or:mitochondrion *nesticus barrowsi*] [sr:*nesticus barrowsi*] [db:genpept-inv] [de:*nesticus barrowsi* 16s ribosomal rna gene, partial sequence,trna-leu gene, complete sequence, and nadh dehydrogen |
| 29300152_f2_38 | 2021 | 5675 | 1164 | 387 | 981 | 6.50E-99 | [ac:p50853] [gn:ribd:ribg] [or:*actinobacillus pleuropneumoniae*] [sr:*haemophilus pleuropneumoniae*] [ec:3.5.4.—] [de:riboflavin-specific deaminase,] [sp:p50853] [db:swissprot] |
| 29300912_c2_51 | 2022 | 5676 | 1077 | 358 | 595 | 5.20E-58 | [ac:p49937] [gn:fhug] [or:*bacillus subtilis*] [de:ferrichrome transport permease protein fhug] [sp:p49937] [db:swissprot] |
| 29301505_c2_135 | 2023 | 5677 | 1317 | 438 | 426 | 4.20E-40 | [ac:p39301] [gn:sgat] [or:*escherichia coli*] [de:sgat protein] [sp:p39301] [db:swissprot] |
| 29301592_f3_21 | 2024 | 5678 | 1752 | 583 | 321 | 5.50E-27 | [ac:d69796] [pn:two-component sensor histidine kinase [yes homolog yesm] [gn:yesm] [or:*bacillus subtilis*] [db:pir] |

TABLE 2-continued

| Orf | NT Seq ID | AA Seq ID | NT Orf length | AA Orf length | Score | Probability | Description |
|---|---|---|---|---|---|---|---|
| 2930280_c1_63 | 2025 | 5679 | 1017 | 338 | 311 | 7.90E-28 | [ln:s66607] [ac:s66607] [pn:pectinmethylesterase] [gn:pectinmethylesterase, pme] [or:lycopersicon esculentum] [sr:tomato fruit] [db:genpept-pln] [de:pectinmethylesterase [lycopersicon esculentum=tomatoes, fruit, mrna, 1935 nt] [nt:this sequence comes fro |
| 2930837_c1_36 | 2026 | 5680 | 651 | 216 | 744 | 8.40E-74 | [ac:p38424] [gn:ysxc] [or:bacillus subtilis] [de:(orfx)] [sp:p38424] [db:swissprot] |
| 2930601_c2_58 | 2027 | 5681 | 390 | 129 | 246 | 5.00E-21 | [ac:g69902] [pn:conserved hypothetical protein yodb] [gn:yodb] [or:bacillus subtilis] [db:pir] |
| 2930783_c1_75 | 2028 | 5682 | 810 | 269 | 369 | 4.60E-34 | [ln:vfu65015] [ac:u65015] [pn:pts permease for mannose subunit iipman] [gn:many] [or:vibrio furnissii] [db:genpept-bct] [de:vibrio furnissii pts permease for mannose subunits iiiman cterminal domain (manx), iipman (many), iibman (manz), and iiiman-termin |
| 2931408_f1_2 | 2029 | 5683 | 804 | 267 | 681 | 4.00E-67 | [ac:f69866] [pn:tetrahydrodipicolinate succinylase homolog ykuq] [gn:ykuq] [or:bacillus subtilis] [db:pir] |
| 2931500_c1_25 | 2030 | 5684 | 939 | 312 | 400 | 2.40E-37 | [ac:p54567] [gn:yqkd] [or:bacillus subtilis] [de:hypothetical 34.6 kd protein in glnq-ansr intergenic region] [sp:p54567] [db:swissprot] |
| 2931791_f1_1 | 2031 | 5685 | 2097 | 698 | 1889 | 3.90E-195 | [ac:s68603:s45077:s45078] [pn:hypothetical protein gamma] [gn:gamma] [or:streptococcus pyogenes] [db:pir] |
| 2931910_c2_34 | 2032 | 5686 | 216 | 71 | 61 | 0.74 | [ac:p22120] [gn:s6] [or:maize rough dwarf virus] [sr:,mrdv] [de:probable nonstructural 36.3 kd protein] [sp:p22120] [db:swissprot] |
| 2932215_f1_1 | 2033 | 5687 | 2238 | 745 | 1947 | 4.70E-209 | [ac:a69601] [pn:atp-dependent clp proteinase-like protein clpe] [gn:clpe] [or:bacillus subtilis] [db:pir] |
| 2932856_c3_47 | 2034 | 5688 | 327 | 108 | 466 | 2.40E-44 | [ac:p55768] [or:enterococcus faecium] [sr:,streptococcus faecium] [de:probable ribosomal protein in infb 5'region] [sp:p55768] [db:swissprot] |
| 2932982_f3_22 | 2035 | 5689 | 333 | 110 | 163 | 3.10E-12 | [ac:b69434] [pn:benzodiazepine receptor/sensory transduction protein homolog] [or:archaeoglobus fulgidus] [db:pir] |
| 2933539_f3_35 | 2036 | 5690 | 531 | 176 | 245 | 6.40E-21 | [ln:lcaj3194] [ac:aj003194] [pn:transposase] [gn:tnp] [or:lactobacillus casei] [db:genpept-bct] [de:lactobacillus casei ccpa & tnp genes.] [le:1403] [re:2389] [di:complement] |
| 2933588_f2_14 | 2037 | 5691 | 633 | 210 | 210 | 3.30E-17 | [ln:staagrloc] [ac:113334] [or:staphylococcus lugdunensis] [sr:staphylococcus lugdunensis dna] [db:genpept-bct] [de:staphylococcus lugdunensis agr related dna sequence, two completecoding regions and two incomplete coding regions.] [le:1336] [re:1902] [di |
| 2933592_f1_13 | 2038 | 5692 | 417 | 138 | 58 | 0.53 | [ac:p29583] [or:methanobacterium thermoformicicum] [de:hypothetical 9.7 kd protein (orf7)] [sp:p29583] [db:swissprot] |
| 2933666_f1_1 | 2039 | 5693 | 1209 | 402 | 1321 | 6.10E-135 | [ac:p39141] [gn:nupc] [or:bacillus subtilis] [de:pyrimidine nucleoside transport protein] [sp:p39141] [db:swissprot] |
| 2933968_f1_3 | 2040 | 5694 | 756 | 251 | 211 | 2.50E-17 | [ln:bfu61539] [ac:u61539:m73530] [or:bacillus firmus] [db:genpept-bct] [de:bacillus firmus orfa gene, partial cds, and na+/h+ antiporter(nhac), nahs(nahs), orfb, orfc, and orfd genes, complete cds.] [nt:orfb] [le:3468] [re:4085] [di:direct] |
| 2937528_f1_2 | 2041 | 5695 | 192 | 63 | 65 | 0.073 | [ln:pbu42580] [ac:u42580:u17055:u32570] [gn:a669r] [or:paramecium bursaria chlorella virus 1] [db:genpept-vr1] [de:paramecium bursaria chlorella virus 1, complete genome.] [nt:similar to chlorella virus cvk2 unknown orf,] [le:319062] [re:319313] [di:direc |
| 2938030_c2_42 | 2042 | 5696 | 219 | 72 | 57 | 0.24 | [ln:cru57088] [ac:u57088] [pn:atp sulfurylase ats1] [gn:ats1] [or:chlamydomonas reinhardtii] [sr:chlamydomonas reinhardtii strain=cc125] [db:genpept-pln] [de:chlamydomonas reinhardtii atp sulfurylase ats1 (ats1) mrna,complete cds.] [le:93] [re:1406] [di:d |

TABLE 2-continued

| Orf | NT Seq ID | AA Seq ID | NT Orf length | AA Orf length | Score | Probability | Description |
|---|---|---|---|---|---|---|---|
| 29380302_c3_2 | 2043 | 5697 | 207 | 68 | 168 | 2.10E-12 | [ac:p56067] [gn:cysk:hp0107] [or:*helicobacter pylori*] [sr:*campylobacter pylori*] [ec:4.2.99.8] [de:(o-acetylserine (thiol)-lyase) (csase)] [sp:p56067] [db:swissprot] |
| 29382811_c1_9 | 2044 | 5698 | 213 | 70 | 61 | 0.45 | [ac:p25348] [gn:mrp132:ycr3w:ycr041] [or:*saccharomyces cerevisiae*] [sr; baker's yeast] [de:mitochondrial 60s ribosomal protein 132 precursor (ym132)] [sp:p25348] [db:swissprot] |
| 29383441_c3_77 | 2045 | 5699 | 1422 | 473 | 441 | 1.10E-41 | [ac:p39301] [gn:sgat] [or:*escherichia coli*] [de:sgat protein] [sp:p39301] [db:swissprot] |
| 29385936_f1_3 | 2046 | 5700 | 204 | 67 | 53 | 0.2 | [ln:saxcpmatke] [ac:134144] [pn:maturase] [gn:matk] [or:chloroplast *saxifraga punctata*] [sr:chloroplast *saxifraga punctata* leaf dna] [db:genpept-pln] [de:*saxifraga punctata* chloroplast maturase (matk) gene, 5' end,] [nt:includes over 2/3 of matk gene; put |
| 2939075_c2_41 | 2047 | 5701 | 549 | 182 | 282 | 7.60E-25 | [ac:p42313] [gn:yxjb:n15i] [or:*bacillus subtilis*] [de:hypothetical 31.5 kd protein in katb 3region] [sp:p42313] [db:swissprot] |
| 29406567_f1_19 | 2048 | 5702 | 1827 | 608 | 1055 | 9.30E-107 | [ac:p54719] [gn:yflc] [or:*bacillus subtilis*] [de:hypothetical abc transporter atp-binding protein 2 in glvbc 3'region] [sp:p54719] [db:swissprot] |
| 29410917_c3_16 | 2049 | 5703 | 348 | 115 | 174 | 6.60E-13 | [ac:s74048] [pn:probable daunorubicin resistance protein:protein c0112] [or:*sulfolobus solfataricus*] [db:pir] |
| 29425008_f2_17 | 2050 | 5704 | 315 | 104 | 89 | 0.00025 | [ac:s77324] [pn:hypothetical protein] [or:*synechocystis* sp.] [sr: pcc 6803, , pcc 6803] [sr:pcc 6803,] [db:pir] |
| 29431442_c3_73 | 2051 | 5705 | 1416 | 471 | 746 | 5.20E-74 | [ac:p28619] [gn:rph] [or:*bacillus subtilis*] [ec:2.7.7.56] [de:nucleotidyltransferase]] [sp:p28619] [db:swissprot] |
| 2944001_f1_2 | 2052 | 5706 | 192 | 63 | 47 | 0.26 | [ln:celc45h4] [ac:af039053] [gn:c45h4.7] [or:*caenorhabditis elegans*] [sr:*caenorhabditis elegans* strain=bristol n2] [db:genpept-inv] [de:*caenorhabditis elegans* cosmid c45h4.] [le:11550:11691:12212:12350] [re:11647:12162:12271:12439] [di:directjoin] |
| 29453328_c1_46 | 2053 | 5707 | 336 | 111 | 97 | 3.10E-05 | [ln:mtv004] [ac:al009198] [pn:hypothetical protein mtv004.14] [gn:mtv004.14] [or:*mycobacterium tuberculosis*] [db:genpept-bct] [de:*mycobacterium tuberculosis* sequence v004.] [nt:mtv004.14, unknown, len: 91 aa; similar to e. coli] [le:31376] [re:31651] [di: |
| 29453433_f1_2 | 2054 | 5708 | 969 | 322 | 1009 | 7.00E-102 | [ac:b70032] [pn:conserved hypothetical protein yvcl] [gn:yvcl] [or:*bacillus subtilis*] [db:pir] |
| 2945452_c2_31 | 2055 | 5709 | 2493 | 830 | 2561 | 2.40E-266 | [ln:lmu40604] [ac:u40604] [pn:clpc atpase] [gn:mec] [fn:general stress protein] [or:*listeria monocytogenes*] [db:genpept-bct] [de:*listeria monocytogenes* clpc atpase (mec) gene, complete cds.] [nt:similar to the mecb gene product from bacillus] [le:2244] [r |
| 29455407_c3_71 | 2056 | 5710 | 648 | 215 | 100 | 0.0091 | [ln:scmp48egg] [ac:m74170] [or:*schistosoma mansoni*] [sr:*schistosoma mansoni* (strain nmri) female adult worm dna] [db:genpept-inv] [de:*schistosoma mansoni* p48 eggshell protein gene, complete cds.] [nt:orf 3] [le:687] [re:1868] [di:complement] |
| 29457950_f1_3 | 2057 | 5711 | 261 | 86 | 252 | 1.20E-21 | [ln:isu40482] [ac:u40482] [or:insertion sequence is1353] [db:genpept-bct] [de:insertion sequence is1353 orfa and orfb genes, complete cds.] [nt:orfb; possible alternate start site at nt 686] [le:671] [re:1585] [di:direct] |
| 29461541_c1_36 | 2058 | 5712 | 201 | 66 | 61 | 0.18 | [ln:hivu67765] [ac:u67765] [pn:envelope glycoprotein] [gn:env] [or:human immunodeficiency virus type 1] [db:genpept-vrl] [de:hiv-1 isolate tw334-1 from taiwan, envelope glycoprotein (env)gene, v3 region, partial cds.] [ntv3 region] [le:<1] [re: |
| 29462555_c1_38 | 2059 | 5713 | 1941 | 646 | 260 | 6.70E-19 | [ac:g69801] [pn:hypothetical protein yfho] [gn:yfho] [or:*bacillus subtilis*] [db:pir] |

TABLE 2-continued

| Orf | NT Seq ID | AA Seq ID | NT Orf length | AA Orf length | Score | Probability | Description |
|---|---|---|---|---|---|---|---|
| 29464442_f2_6 | 2060 | 5714 | 651 | 216 | 520 | 4.60E-50 | [ac:p38034] [or:streptococcus pneumoniae] [de:hypothetical 23.1 kd protein in pona 5'region] [sp:p38034] [db:swissprot] |
| 29470056_c2_28 | 2061 | 5715 | 1488 | 495 | 2567 | 5.60E-267 | [ln:strpbgsl] [ac:m19454] [or:lactococcus lactis cremoris] [sr:s.lactis (strain z268) dna, clone x25] [db:genpept-bct] [de:s.lactis phospho-beta-d-galactosidase gene, complete cds.] [nt:phospho-beta-d-galactosidase (ec 3.2.1.85)] [le:601] [re:2034] [di:di |
| 2948262_c2_15 | 2062 | 5716 | 183 | 60 | 64 | 0.49 | [ac:p51946] [gn:ccnh] [or:homo sapiens] [sr:human] [de:cyclin h (mo15-associated protein) (p37) (p34)] [sp:p51946] [db:swissprot] |
| 29485952_c2_62 | 2063 | 5717 | 849 | 282 | 104 | 0.0021 | [ac:d64486] [pn:hypothetical protein mj1493] [or:methanococcus jannaschii] [db:pir] [mp:for1466545-1467240] |
| 29487804_c1_10 | 2064 | 5718 | 1028 | 342 | 990 | 7.20E-100 | [ac:f69878] [pn:conserved hypothetical protein ylon] [gn:ylon] [or:bacillus subtilis] [db:pir] |
| 29492212_f2_29 | 2065 | 5719 | 537 | 178 | 89 | 0.082 | [ln:cef55b12] [ac:z79757] [pn:f55b12.6] [or:caenorhabditis elegans] [db:genpept-inv] [de:caenorhabditis elegans cosmid f55b12, complete sequence.] [nt:similar to 7tm receptor] [le:21843:22080-22224:22524] [re:22034:22167:22248:22665] [le:92] [re:35 |
| 29495312_f2_13 | 2066 | 5720 | 573 | 190 | 511 | 5.60E-48 | [ln:d83706] [ac:d83706] [pn:pyruvate carboxylase] [or:bacillus stearothermophilus] [sr:bacillus stearothermophilus (strain:k1041) dna] [db:genpept-bct] [ec:6.4.1.1] [de:bacillus stearothermophilus dna for pyruvate carboxylase, completecds.] [le:92] [re:35 |
| 29500177_c2_28 | 2067 | 5721 | 186 | 61 | 65 | 0.8 | [ln:celc18f10] [ac:u00049] [gn:c18f10.2] [or:caenorhabditis elegans] [sr:caenorhabditis elegans strain=bristol n2] [db:genpept-inv] [de:caenorhabditis elegans cosmid c18f10.] [le:15112:15349:16140:17040] [re:15203:15473:16489:17130] [di:directjoin] |
| 29501575_c1_5 | 2068 | 5722 | 276 | 91 | 74 | 0.0084 | [ac:s15700] [pn:ig heavy chain] [or:homo sapiens] [sr:, man] [db:pir] |
| 29501575_c2_23 | 2069 | 5723 | 321 | 106 | 182 | 1.30E-13 | [ac:p35881] [or:lactococcus lactis] [sr:subsplactis:streptococcus lactis] [de:transposase for insertion sequence element is905] [sp:p35881] [db:swissprot] |
| 29502313_c3_48 | 2070 | 5724 | 2319 | 772 | 3451 | 0 | [ac:p18311] [gn:infb] [or:enterococcus faecium] [sr:streptococcus faecium] [de:translation initiation factor if-2] [sp:p18311] [db:swissprot] |
| 29503212_c1_37 | 2071 | 5725 | 606 | 201 | 296 | 2.50E-26 | [ac:p54491] [gn:yqgn] [or:bacillus subtilis] [de:hypothetical 21.4 kd protein in soda-comga intergenic region] [sp:p54491] [db:swissprot] |
| 29505312_f3_63 | 2072 | 5726 | 225 | 74 | 76 | 0.0051 | [ac:h70081] [pn:hypothetical protein yxle] [gn:yxle] [or:bacillus subtilis] [db:pir] |
| 29505317_c3_34 | 2073 | 5727 | 201 | 66 | 50 | 0.66 | [ln:spbc16e9] [ac:z99759] [pn:hypothetical protein] [gn:spbc16e9.07] [or:schizosaccharomyces pombe] [sr:fission yeast] [db:genpept-pln] [de:s.pombe chromosome ii cosmid c16e9.] [nt:spbc16e9.07, unknown, len:313aa] [le:10887] [re:11828] [di:direct] |
| 29531562_c3_20 | 2074 | 5728 | 198 | 65 | 49 | 0.45 | [ln:tsu45988] [ac:u45988] [pn:cytochrome c oxidase 1] [gn:co 1] [or:mitochondrion taenia saginata] [sr:taenia saginata] [db:genpept-inv] [de:taenia saginata repetitive dna sequence ptsag16 and cytochrome coxidase 1 (co 1) gene, mitochondrial gene encoding |
| 29535937_f2_5 | 2075 | 5729 | 465 | 155 | 90 | 0.0029 | [ac:jc1151] [pn:hypothetical 20.3k protein (insertion sequence is1131)] [or:agrobacterium tumefaciens] [db:pir] |
| 29535962_c3_25 | 2076 | 5730 | 369 | 122 | 224 | 1.10E-18 | [ac:jc1151] [pn:hypothetical 20.3k protein (insertion sequence is1131)] [or:agrobacterium tumefaciens] [db:pir] |
| 29542525_c1_31 | 2077 | 5731 | 1464 | 487 | 868 | 6.10E-87 | [ac:h69762] [pn:two-component sensor histidine kinase [ycl homolog yclk] [gn:yclk] [or:bacillus subtilis] [db:pir] |
| 29542813_c2_68 | 2078 | 5732 | 450 | 149 | 64 | 0.17 | [ac:45281] [pn:ribosomal protein l1] [or:thermus thermophilus] [db:pir] |
| 29548430_c2_114 | 2079 | 5733 | 1728 | 575 | 1448 | 2.10E-148 | [ac:h64879] [pn:hypothetical protein b1309] [or:escherichia coli] [db:pir] |

TABLE 2-continued

| Orf | NT Seq ID | AA Seq ID | NT Orf length | AA Orf length | Score | Probability | Description |
|---|---|---|---|---|---|---|---|
| 29567177_f2_54 | 2080 | 5734 | 1743 | 580 | 323 | 2.10E-26 | [ac:d69796] [pn:two-component sensor histidine kinase [yes homolog yesm] [gn:yesm] [or:bacillus subtilis] [db:pir] |
| 29570937_f3_25 | 2081 | 5735 | 324 | 107 | 195 | 1.30E-15 | [ac:p27174] [or:lactococcus lactis] [sr:subsplactis:streptococcus lactis] [de:hypothetical protein in rpmg 3'region (orf2) (fragment)] [sp:p27174] [db:swissprot] |
| 29574081_c1_29 | 2082 | 5736 | 204 | 67 | 53 | 0.019 | [ac:g70007] [pn:conserved hypothetical protein yuef] [gn:yuef] [or:bacillus subtilis] [db:pir] |
| 29578175_f1_1 | 2083 | 5737 | 645 | 214 | 366 | 9.60E-34 | [ac:d49898] [pn:cellobiose phosphotransferase system celc] [or:bacillus stearothermophilus] [db:pir] |
| 29584812_f2_7 | 2084 | 5738 | 957 | 318 | 792 | 6.90E-79 | [ac:p46545] [gn:pepq] [or:lactobacillus delbrueckii] [sr:,subsplactis] [ec:3.4.13.9] [de:dipeptidase) (prolidase) (imidodipeptidase] [sp:p46545] [db:swissprot] |
| 29586637_f2_11 | 2085 | 5739 | 696 | 231 | 822 | 4.60E-82 | [ln:spadca] [ac:z71552] [pn:abc protein] [gn:adcc] [or:streptococcus pneumoniae] [db:genpept-bct] [de:streptococcus pneumoniae adccba operon.] [1e:20] [re:721] [di:direct] |
| 29692312_c1_51 | 2086 | 5740 | 375 | 124 | 98 | 2.40E-05 | [ln:strinte] [ac:129324] [pn:excisionase] [or:streptococcus pneumoniae] [db:genpept-bct] [de:streptococcus pneumoniae putative integrase, putative orf2, putative excisionase, putative orf7, putative repressor protein,putative orf8, putative dna relaxase, p |
| 29720307_c2_9 | 2087 | 5741 | 396 | 131 | 124 | 4.20E-08 | [ac:s52344] [pn:hypothetical protein] [or:lactococcus lactis] [db:pir] |
| 29767157_c1_19 | 2088 | 5742 | 1221 | 406 | 1282 | 8.20E-131 | [ac:p05653] [gn:gyra:nala:cafb] [or:bacillus subtilis] [ec:5.99.1.3] [de:dna gyrase subunit a.] [sp:p05653] [db:swissprot] |
| 29774140_c2_50 | 2089 | 5743 | 1578 | 525 | 902 | 1.50E-90 | [ac:b69855] [pn:amino acid permease homolog ykba] [gn:ykba] [or:bacillus subtilis] [db:pir] |
| 29789165_f3_4 | 2090 | 5744 | 1122 | 373 | 1480 | 8.60E-152 | [ac:p80868:p70980] [gn:fusa:ftus] [or:bacillus subtilis] [de:elongation factor g (ef-g) (vegetative protein 19) (veg19)] [sp:p80868:p70980] [db:swissprot] |
| 29790637_f3_23 | 2091 | 5745 | 1875 | 624 | 2452 | 8.60E-255 | [ac:e69872] [pn:gtp-binding elongation factor homolog ylag] [gn:ylag] [or:bacillus subtilis] [db:pir] |
| 29802163_f1_1 | 2092 | 5746 | 606 | 202 | 67 | 0.14 | [ac:d34223] [pn:transcription factor atf-4] [or:homo sapiens] [sr:, man] [db:pir] |
| 2985905_c3_92 | 2093 | 5747 | 777 | 258 | 98 | 0.011 | [ac:s73467] [pn:hypothetical protein d12__orf257] [or:mycoplasma pneumoniae] [sr:atcc 29342, , atcc 29342,] [db:pir] |
| 29860912_f1_5 | 2094 | 5748 | 690 | 229 | 60 | 0.68 | [ac:p41598] [gn:psbk] [or:pinus thunbergii] [sr:green pine:japanese black pine] [de:photosystem ii 4 kd reaction centre protein precursor] [sp:p41598] [db:swissprot] |
| 29863586_c2_38 | 2095 | 5749 | 918 | 305 | 1051 | 2.50E-106 | [ln:ab008120] [ac:ab008120] [pn:phosphopentomutase] [gn:ppm] [fn:phosphotransfer between the c1 and c5 carbon] [or:bacillus stearothermophilus] [sr:bacillus stearothermophilus dna] [db:genpept-bct] [ec:2.7.5.6] [de:bacillus stearothermophilus gene for pho |
| 29876292_c3_90 | 2096 | 5750 | 318 | 105 | 68 | 0.28 | [ac:p28104] [gn:wnt-5b] [or:alopius vulpinus] [sp:p28104] [sr:,thresher shark] [de:wnt-5b protein (fragment)] [sp:p28104] [db:swissprot] |
| 29884425_f2_53 | 2097 | 5751 | 432 | 143 | 70 | 0.25 | [ln:ddu66370] [ac:u66370] [or:dictyostelium discoideum] [db:genpept-inv] [de:dictyostelium discoideum orfveg110 mrna, partial cds.] [nt:orfveg110] [le:<1] [re:888] [di:direct] |
| 29898587_c2_19 | 2098 | 5752 | 579 | 192 | 451 | 9.40E-43 | [ac:p42369] [gn:grpe] [or:lactococcus lactis] [sr:,subsplactis:streptococcus lactis] [de:grpe protein] [sp:p42369] [db:swissprot] |
| 29900200_c2_58 | 2099 | 5753 | 978 | 325 | 225 | 8.40E-19 | [ln:anu85709] [ac:u85709] [pn:putative fimbrial-associated protein] [or:actinomyces naeslundii] [db:genpept-bct] [de:actinomyces naeslundii putative fimbrial-associated protein genes,complete cds.] [nt:orf4] [le:98] [re:940] [di:direct] |

TABLE 2-continued

| Orf | NT Seq ID | AA Seq ID | NT Orf length | AA Orf length | Score | Probability | Description |
|---|---|---|---|---|---|---|---|
| 29921892_f3_13 | 2100 | 5754 | 1110 | 369 | 189 | 1.10E-12 | [ac:p44658] [gn:hi0357] [or:haemophilus influenzae] [de:putative thiamine biosynthesis protein hi0357] [sp:p44658] [db:swissprot] |
| 29922275_f1_7 | 2101 | 5755 | 606 | 201 | 79 | 0.007 | [ln:mmig11] [ac:vo0764] [pn:gamma 2a heavy chain of immunoglobulin g] [or:mus musculus] [sr:house mouse] [db:genpept-rod] [de:m.musculus mrna for immunoglobulin gamma 2a.] [ie:<1] [re: |
| 29922951_f2_9 | 2102 | 5756 | 654 | 217 | 207 | 6.80E-17 | [ac:p15454] [gn:guk1:ydr454c:d9461.39] [or:saccharomyces cerevisiae] [sr:baker's yeast] [ec:2.7.4.8] [de:guanylate kinase, (gmp kinase)] [sp:p15454] [db:swissprot] |
| 29923412_c2_47 | 2103 | 5757 | 747 | 248 | 747 | 4.00E-74 | [ac:p25813] [gn:gidb] [or:bacillus subtilis] [de:glucose inhibited division protein b] [sp:p25813] [db:swissprot] |
| 2992785_f3_9 | 2104 | 5758 | 771 | 256 | 703 | 1.90E-69 | [ac:p37543] [gn:yabb] [or:bacillus subtilis] [de:hypothetical 28.3 kd protein in xpac-abrb intergenic region] [sp:p37543] [db:swissprot] |
| 29946057_c1_18 | 2105 | 5759 | 258 | 85 | 68 | 0.34 | [ac:q12194] [gn:vps28:yp1066w:lpe4w] [or:saccharomyces cerevisiae] [sr:baker's yeast] [de:vacuolar protein sorting-associated protein vps28] [sp:q12194] [db:swissprot] |
| 29959837_c3_180 | 2106 | 5760 | 309 | 102 | 57 | 0.86 | [ln:bbbrgabcd] [ac:x87201] [gn:orfa] [or:borrelia burgdorferi] [sr:lyme disease spirochete] [db:b.burgdorferi plasmid, orfa, b, c, d, e, & f genes, clone pomb14and pomb17.] [le:594] [re:1691] [di:direct] |
| 29960041_c1_68 | 2107 | 5761 | 252 | 83 | 69 | 0.35 | [ln:ataf002109] [ac:af002109] [gn:t28m21.10] [or:arabidopsis thaliana] [sr:thale cress] [db:genpept-pln] [de:arabidopsis thaliana chromosome ii bac t28m21 genomic sequence,complete sequence.] [nt:hypothetical protein] [le:41509:42491-43657] [re:42315:4297 |
| 29964705_f2_17 | 2108 | 5762 | 672 | 223 | 72 | 0.14 | [ln:pfcompira] [ac:x95275] [gn:orf101] [or:plasmodium falciparum] [sr:malaria parasite] [db:genpept-inv] [de:p.falciparum complete gene map of plastid-like dna (ir-a).] [le:6725] [re:7030] [di:direct] |
| 29970192_c1_90 | 2109 | 5763 | 579 | 192 | 714 | 1.30E-70 | [ac:h70019] [pn:abc transporter (atp-binding protein) homolog yury] [gn:yury] [or:bacillus subtilis] [db:pir] |
| 29975025_c2_66 | 2110 | 5764 | 663 | 220 | 353 | 2.30E-32 | [ac:p42972] [gn:ycsn] [or:bacillus subtilis] [de:hypothetical 34.1 kd protein in pbpc 3'region] [sp:p42972] [db:swissprot] |
| 3003328_f1_7 | 2111 | 5765 | 1047 | 348 | 1189 | 5.90E-121 | [ac:q46127] [gn:trps1:rsa] [or:clostridium longisporum] [ec:6.1.1.2] [de:(trpts)] [sp:q46127] [db:swissprot] |
| 3007032_f2_48 | 2112 | 5766 | 264 | 87 | 68 | 0.086 | [ac:p56421] [gn:mog:hp0799] [or:helicobacter pylori] [sr:,campylobacter pylori] [de:molybdopterin biosynthesis mog protein] [sp:p56421] [db:swissprot] |
| 30078752_c3_54 | 2113 | 5767 | 708 | 235 | 127 | 3.60E-06 | [ln:af004325] [ac:af004325] [pn:unknown] [gn:cps19g] [or:streptococcus pneumoniae] [db:genpept-bct] [de:streptococcus pneumoniae capsular serotype 19b capsule biosynthesislocus, cps19bf gene, partial cds, cps19bg, cps19bh, cps19bp, cps19bi, cps19bq, cps19 |
| 30079707_c2_50 | 2114 | 5768 | 603 | 200 | 169 | 7.20E-13 | [ac:p02964:p11702] [gn:sigh:spo0h] [or:bacillus licheniformis] [de:rna polymerase sigma-h factor (sigma-30)] [sp:p02964:p11702] [db:swissprot] |
| 30080327_c3_115 | 2115 | 5769 | 615 | 204 | 65 | 0.23 | [ac:s20031] [pn:hypothetical protein a] [or:mycobacterium smegmatis] [db:pir] |
| 30089093_c1_51 | 2116 | 5770 | 711 | 236 | 427 | 3.30E-40 | [ac:p29284] [gn:tfp] [or:lactobacillus casei] [de:probable transcriptional regulator tfp] [sp:p29284] [db:swissprot] |
| 30111036_c1_42 | 2117 | 5771 | 1245 | 414 | 1004 | 2.40E-101 | [ac:g96647] [pn:2-amino-3-ketobutyrate coa ligase kbl] [gn:kbl] [or:bacillus subtilis] [db:pir] |
| 30115936_c3_75 | 2118 | 5772 | 678 | 225 | 737 | 4.60E-73 | [ac:p54689] [gn:ilve:hi1193] [or:haemophilus influenzae] [ec:2.6.1.42] [de:b (bcat)] [sp:p54689] [db:swissprot] |
| 30117882_c1_104 | 2119 | 5773 | 1152 | 383 | 1348 | 8.30E-138 | [ac:s33518] [pn:probable nucleotide-binding protein] [or:acholeplasma laidlawii] [db:pir] |

TABLE 2-continued

| Orf | NT Seq ID | AA Seq ID | NT Orf length | AA Orf length | Score | Probability | Description |
|---|---|---|---|---|---|---|---|
| 30120625_c2_48 | 2120 | 5774 | 978 | 325 | 751 | 1.50E-74 | [ac:p29824] [gn:lacg] [or:agrobacterium radiobacter] [de:lactose transport system permease protein lacg] [sp:p29824] [dbsswissprot] |
| 30126678_c1_19 | 2121 | 5775 | 228 | 75 | 59 | 0.027 | [ln:cef32d8] [ac:z74031] [pn:f32d8.10] [or:caenorhabditis elegans] [db:genpept-inv] [de:caenorhabditis elegans cosmid f32d8, complete sequence.] [nt:protein predicted using genefinder; weak similarity] [le:35836:36179:36361] [re:35975:36309:36725] [di:com |
| 30127178_f1_11 | 2122 | 5776 | 1341 | 446 | 1383 | 1.60E-141 | [ac:a69662] [pn:udp-n-acetylglucosamine 1-carboxyvinyltransferase mura] [gn:mura] [or:bacillus subtilis] [db:pir] |
| 30131580_c2_127 | 2123 | 5777 | 483 | 160 | 82 | 0.15 | [ln:ecu89650] [ac:u89650] [pn:rna polymerase ii second largest subunit] [gn:rpb2] [or:euplotes crassus] [db:genpept-inv] [de:euplotes crassus rna polymerase ii, second largest subunit gene,partial cds.] [le:61] [re: |
| 30133885_f3_35 | 2124 | 5778 | 681 | 226 | 80 | 0.034 | [ac:f69264] [pn:hypothetical protein af0118] [or:archaeoglobus fulgidus] [db:pir] |
| 30133562_c2_225 | 2125 | 5779 | 372 | 123 | 62 | 0.17 | [ac:q98961] [or:naja atra] [sr:chinese cobra] [de:cardiotoxin 3d precursor] [sp:q98961] [db:swissprot] |
| 30157841_c2_118 | 2126 | 5780 | 1413 | 470 | 745 | 6.60E-74 | [ac:p42100] [gn:yxaa:s14a] [or:bacillus subtilis] [de:hypothetical 39.4 kd protein in gntr-htpg intergenic region] [sp:p42100] [db:swissprot] |
| 30167186_f2_63 | 2127 | 5781 | 213 | 70 | 65 | 0.35 | [ac:p47488] [gn:mg246] [or:mycoplasma genitalium] [de:hypothetical protein mg246] [sp:p47488] [db:swissprot] |
| 30179712_c3_72 | 2128 | 5782 | 282 | 93 | 189 | 5.50E-15 | [ac:a69931] [pn:hypothetical protein yoze] [gn:yoze] [or:bacillus subtilis] [db:pir] |
| 30204550_c2_36 | 2129 | 5783 | 627 | 208 | 79 | 0.47 | [ac:s38250] [pn:hypothetical protein] [or:coxiella burnetii] [db:pir] |
| 30220000_c3_30 | 2130 | 5784 | 897 | 298 | 406 | 5.50E-38 | [ln:efu63997] [ac:u63997] [or:enterococcus faecium] [db:genpept-bct] [de:enterococcus faecium insertion sequence is1476 putative transposasegene, complete cds.] [le:140] [re:1414] [di:direct] |
| 3022781_c2_90 | 2131 | 5785 | 264 | 87 | 101 | 1.20E-05 | [ln:efu09422] [ac:u09422] [or:enterococcus faecalis] [db:genpept-bct] [de:enterococcus faecalis ds16 transposon tn916, (tet(m)). (xis-tn),(int-tn) genes, orfs 1–24, complete cds, complete sequence.] [le:16121] [re:16372] [di:complement] |
| 30260916_c2_98 | 2132 | 5786 | 1701 | 566 | 694 | 1.70E-68 | [ln:kpu95087] [ac:u95087] [pn:mdcd] [gn:mdcd] [or:klebsiella pneumoniae] [db:genpept-bct] [de:klebsiella pneumoniae malonate decarboxylase gene cluster (mdca, mdcb, mdcc, mdcd, mdce, mdcf, mdcg, mdch, mdcr) genes, completecds.] [nt:decarboxylase subunit; b |
| 30260938_c1_94 | 2133 | 5787 | 1476 | 491 | 1737 | 5.00E-179 | [ac:d70019] [pn:conserved hypothetical protein yuru] [gn:yuru] [or:bacillus subtilis] [db:pir] |
| 30263702_c2_131 | 2134 | 5788 | 687 | 228 | 114 | 4.90E-05 | [ac:d69163] [pn:hypothetical protein mth483] [gn:mth483] [or:methanobacterium thermoautotrophicum] [db:pir] |
| 30270437_c3_17 | 2135 | 5789 | 885 | 294 | 1069 | 3.10E-108 | [ac:a70034] [pn:maltodextrin transport system permease homolog yvdi] [gn:yvdi] [or:bacillus subtilis] [db:pir] |
| 30273557_f2_6 | 2136 | 5790 | 939 | 312 | 421 | 1.40E-39 | [ac:p54604] [gn:yhct] [or:bacillus subtilis] [de:hypothetical 33.7 kd protein in cspb-glpp intergenic region] [sp:p54604] [db:swissprot] |
| 30277138_f2_8 | 2137 | 5791 | 789 | 262 | 479 | 1.00E-45 | [ac:d69779] [pn:antibiotic resistance protein homolog yder] [gn:yder] [or:bacillus subtilis] [db:pir] |
| 30284375_c2_30 | 2138 | 5792 | 306 | 101 | 89 | 0.002 | [ac:q51548] [gn:pvda:pvd-1] [or:pseudomonas aeruginosa] [ec:1.—.—.—] [de:l-ornithine n5-oxygenase,] [sp:q51548] [db:swissprot] |
| 30336087_f1_17 | 2139 | 5793 | 1515 | 504 | 1590 | 1.90E-163 | [ac:d69853] [pn:altronate hydrolase homolog yjmj] [gn:yjmj] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 30336687_f3_5 | 2140 | 5794 | 588 | 195 | 630 | 1.00E-61 | [ln:lacals] [ac:116975] [pn:alpha-acetolactate synthase] [gn:als] [or:lactococcus lactis] [sr:lactococcus lactis (strain dsm 20384, sub_species lactis) dna ] [db:genpept-bct] [de:lactococcus lactis alpha-acetolactate synthase (als) gene, completecds.] [le: |
| 30339212_c2_40 | 2141 | 5795 | 768 | 255 | 489 | 8.90E-47 | [ac:p24670] [gn:arod] [or:salmonella typhi] [ec:4.2.1.10] [de:3-dehydroquinate dehydratase, (3-dehydroquinase)] [sp:p24670] [db:swissprot] |
| 30353430_f1_9 | 2142 | 5796 | 1296 | 431 | 63 | 0.72 | [ln:d49519] [ac:d49519] [or:periplaneta americana] [sr:periplaneta americana fat body cdna to mrna, clone:4] [db:genpept-inv] [de:american cockroach clone 4 mrna, partial cds.] [nt:similar to lps-binding protein; author-given] [le:<1] [re: |
| 30359425_f3_38 | 2143 | 5797 | 807 | 268 | 839 | 7.20E-84 | [ln:lllpk214] [ac:x92946;y10522] [pn:transposase] [gn:tnpa] [or:lactococcus lactis] [db:genpept-bct] [de:lactobacillus lactis plasmid pk214, complete sequence.] [le:13438] [re:14256] [di:complement] |
| 30469564_c1_35 | 2144 | 5798 | 1412 | 470 | 669 | 7.50E-66 | [ac:s3606;s46953] [pn:phosphotransferase system enzyme ii., glucose-specific, factor iib:glucose permease;phosphoenolpyruvate:glucose phosphotransferase system enzyme ii, glucose-specific;protein-npi-phosphohistidine–sugar phosphotransferase, glucose-sp |
| 30473457_c3_43 | 2145 | 5799 | 1494 | 497 | 529 | 5.10E-51 | [ac:p13398] [gn:nyla] [or:pseudomonas sp] [sr:nk87,] [ec:3.5.2.12] [de:degrading enzyme ei] [sp:p13398] [db:swissprot] |
| 30473461_c1_34 | 2146 | 5800 | 537 | 178 | 300 | 9.40E-27 | [ac:p43906] [gn:arok] [or:lactococcus lactis] [sr:subspllactis:streptococcus lactis] [ec:2.7.1.71] [de:shikimate kinase, (sk)] [sp:p43906] [db:swissprot] |
| 30480333_f2_114 | 2147 | 5801 | 1341 | 446 | 208 | 3.10E-14 | [ac:p19834] [or:streptomyces clavuligerus] [de:insertion element is116 hypothetical 44.8 kd protein] [sp:p19834] [db:swissprot] |
| 30480333_f3_32 | 2148 | 5802 | 297 | 99 | 81 | 0.011 | [ac:q48514] [gn:tnha] [or:leptospira borgpeterseni] [de:transposase for insertion sequence element is1533] [sp:q48514] [db:swissprot] |
| 30519450_c2_141 | 2149 | 5803 | 198 | 65 | 54 | 0.67 | [ac:s67565] [pn:probable membrane protein yol032w:hypothetical protein d2767] [or:saccharomyces cerevisiae] [db:pir] [mp:41] |
| 30553567_c2_44 | 2150 | 5804 | 522 | 173 | 407 | 4.30E-38 | [ac:s39974] [pn:hypothetical protein] [or:streptococcus equisimilis] [db:pir] |
| 30557807_f1_3 | 2151 | 5805 | 324 | 107 | 78 | 0.03 | [ln:asu10134] [ac:u10134] [pn:nadh dehydrogenase subunit 5] [gn:nd5] [or:mitochondrion anopheles sundaicus] [sr:anopheles sundaicus] [db:genpept-inv] [de:anopheles sundaicus nadh dehydrogenase subunit 4 (nd4) and subunit5 (nd5) genes, mitochondrial genes |
| 30558465_f1_5 | 2152 | 5806 | 2031 | 676 | 62 | 0.94 | [ln:bbu65818] [ac:u65818] [pn:outer surface protein a] [gn:ospa] [or:borrelia burgdorferi] [sr:lyme disease spirochete] [db:genpept-bct] [de:borrelia burgdorferi strain acal outer surface protein a (ospa)gene, partial cds.] [le:<1] [re: |
| 30567812_f3_77 | 2153 | 5807 | 546 | 181 | 117 | 2.30E-07 | [ac:pn04668] [pn:hypothetical protein 106] [or:lactobacillus gasseri] [db:pir] |
| 30581906_c3_6 | 2154 | 5808 | 291 | 96 | 54 | 0.67 | [ac:g64536] [pn:hypothetical protein hp0135] [or:helicobacter pylori] [db:pir] |
| 30596087_c2_20 | 2155 | 5809 | 591 | 196 | 157 | 3.20E-16 | [ac:s52247] [pn:hypothetical protein 1] [or:lactobacillus leichmannii] [db:pir] |
| 30648405_c1_27 | 2156 | 5810 | 354 | 117 | 67 | 0.85 | [ac:p29623] [or:gymnodraco acuticeps] [sr:antarctic dragonfish] [de:hemoglobin alpha chain] [sp:p29623] [db:swissprot] |
| 30648405_c3_35 | 2157 | 5811 | 354 | 117 | 65 | 0.48 | [ac:b38277] [pn:probable hydroxyproline-rich glycoprotein (clone mg1.6a)] [or:chlamydomonas reinhardtii] [db:pir] |
| 30649193_c3_63 | 2158 | 5812 | 2082 | 693 | 1289 | 1.50E-131 | [ac:h69878] [pn:protein kinase homolog ylop] [gn:ylop] [or:bacillus subtilis] [db:pir] |
| 30652125_f2_7 | 2159 | 5813 | 918 | 305 | 169 | 5.60E-11 | [ac:f64896] [pn:hypothetical protein b1443] [or:escherichia coli] [db:pir] |
| 30659377_f1_4 | 2160 | 5814 | 186 | 61 | 62 | 0.36 | [ac:s28716] [pn:hypothetical protein 7] [or:sugar beet yellows virus:sbyv] [db:pir] |
| 30664080_c2_42 | 2161 | 5815 | 468 | 155 | 111 | 0.00015 | [ac:64505] [pn:p115 homolog] [or:methanococcus jannaschii] [db:pir] [mp:forl623481–1626990] |

TABLE 2-continued

| Orf | NT Seq ID | AA Seq ID | NT Orf length | AA Orf length | Score | Probability | Description |
|---|---|---|---|---|---|---|---|
| 30683378_c1_27 | 2162 | 5816 | 594 | 197 | 333 | 3.00E-30 | [ac:d70033] [pn:conserved hypothetical protein yvdd] [gn:yvdd] [or:*bacillus subtilis*] [db:pir] |
| 30708542_f2_18 | 2163 | 5817 | 1038 | 345 | 1014 | 2.10E-102 | [ac:p27148] [gn:secy] [or:*lactococcus lactis*] [sr:subsp*lactis:streptococcus lactis*] [de:preprotein translocase secy subunit] [sp:p27148] [db:swissprot] |
| 30711077_f1_1 | 2164 | 5818 | 957 | 318 | 199 | 7.00E-16 | [ac:p16055] [gn:tpp15] [or:*treponema pallidum*] [de:15 kd lipoprotein precursor (major membrane immunogen)] [sp:p16055] [db:swissprot] |
| 30713162_f1_1 | 2165 | 5819 | 1017 | 338 | 279 | 1.60E-24 | [ac:c69805] [pn:iron(iii) dicitrate transport permease homolog yfiy] [gn:yfiy] [or:*bacillus subtilis*] [db:pir] |
| 30713265_f1_1 | 2166 | 5820 | 417 | 138 | 77 | 0.04 | [ac:c64578] [pn:conserved hypothetical integral membrane protein hp0467] [or:*helicobacter pylori*] [db:pir] |
| 30744010_c3_111 | 2167 | 5821 | 999 | 332 | 483 | 3.80E-46 | [ln:af034088] [ac:af034088] [pn:lipase] [gn:lipp] [or:pseudomonas sp. b11-1] [db:genpept] [de:pseudomonas sp. b11-1 lipase (lipp) gene, complete cds.] [le:1] [re:927] [di:direct] |
| 30745262_c3_131 | 2168 | 5822 | 1302 | 433 | 1239 | 3.00E-126 | [ac:64880] [pn:hypothetical protein b1310] [or:*escherichia coli*] [db:pir] |
| 30745632_c2_53 | 2169 | 5823 | 237 | 78 | 82 | 0.0031 | [ac:60215] [pn:epoxidase fom4] [gn:fom4] [or:*streptomyces wedmorensis*] [db:pir] |
| 31250463_c2_59 | 2170 | 5824 | 957 | 318 | 537 | 7.30E-52 | [ln:bsu34873] [ac:u34873] [pn:transcription antiterminator] [gn:surt] [or:*bacillus stearothermophilus*] [de:*bacillus stearothermophilus* (surt)gene, complete cds.] [le:1] [re:834] [di:direct] |
| 3125318_c3_51 | 2171 | 5825 | 186 | 61 | 66 | 0.12 | [ln:celf19c7] [ac:u42439] [gn:f19c7.5] [or:*caenorhabditis elegans*] [sr:*caenorhabditis elegans* strain=bristol n2] [db:genpept-inv] [de:*caenorhabditis elegans* cosmid f19c7.] [le:1388:1442:1597:1776] [re:1397:1537:1728:1848] [di:directjoin] |
| 31254428_f1_3 | 2172 | 5826 | 387 | 128 | 78 | 0.46 | [ln:llu23813] [ac:u23813] [pn:transposase] [or:*lactococcus lactis* [db:genpept-bct] [de:*lactococcus lactis* insertion sequence is-116 transposase gene,complete cds.] [le:123] [re:1280] [di:direct] |
| 31256262_c2_47 | 2173 | 5827 | 198 | 65 | 170 | 5.60E-13 | [ac:jc1262] [pn:hypothetical 4.5k protein] [or:*lactococcus lactis* susp. *lactis*] [db:pir] |
| 31256_c2_70 | 2174 | 5828 | 198 | 65 | 64 | 0.69 | [ac:p04177] [gn:th] [or:*rattus norvegicus*] [sr:,rat] [ec:1.14.16.2] [de:tyrosine 3-monooxygenase, (tyrosine 3-hydroxylase) (th)] [sp:p04177] [db:swissprot] |
| 3126062_c1_94 | 2175 | 5829 | 324 | 107 | 74 | 0.85 | [ac:p38929] [gn:pmc1:yg1006w] [or:*saccharomyces cerevisiae*] [sr:baker's yeast] [ec:3.6.1.38] [de:calcium-transporting atpase 2, (vacuolar ca2+atpase)] [sp:38929] [dbswissprot] |
| 3126277_f3_42 | 2176 | 5830 | 1011 | 336 | 203 | 3.30E-16 | [ac:g69986] [pn:hypothetical protein ysnf] [gn:ysnf] [or:*bacillus subtilis*] [db:pir] |
| 3126542_f3_18 | 2177 | 5831 | 345 | 114 | 107 | 1.50E-05 | [ln:scu77778] [ac:u77778:u29130] [pn:putative membrane protein] [gn:epih] [fn:involved in epidermin secretion] [or:*staphylococcus epidermidis*] [de:*staphylococcus epidermidis* plasmid ptue32 putative abc transportersubunits (epig), (epie). |
| 3126562_f2_13 | 2178 | 5832 | 1950 | 649 | 2116 | 3.40E-219 | [ac:h69643] [pn:isoleucyl-trna synthetase iles] [gn:iles] [or:*bacillus subtilis*] [db:pir] |
| 3126885_c1_34 | 2179 | 5833 | 813 | 270 | 432 | 9.70E-41 | [ac:s75051] [pn:lactose transport system permease protein lacg:protein slr1723:protein slr1723] [gn:lacg] [or:synechocystis sp.] [sr:pcc 6803, , pcc 6803] [sr:pcc 6803,] [db:pir] |
| 31275186_f2_20 | 2180 | 5834 | 342 | 113 | 71 | 0.89 | [ac:q58172] [gn:mj0762] [or:*methanococcus jannaschii*] [de:hypothetical protein mj0762] [sp:q58172] [db:swissprot] |
| 31282885_c1_70 | 2181 | 5835 | 684 | 227 | 143 | 2.10E-09 | [ac:a65001] [pn:hypothetical protein b2291] [or:*escherichia coli*] [db:pir] |

TABLE 2-continued

| Orf | NT Seq ID | AA Seq ID | NT Orf length | AA Orf length | Score | Probability | Description |
|---|---|---|---|---|---|---|---|
| 31284665_f2_15 | 2182 | 5836 | 258 | 85 | 132 | 6.00E-09 | [ln:bacist1] [ac:d10543:d90504] [pn:orf2] [gn:is-t1] [or:bacillus stearothermophilus] [sr:bacillus stearothermophilus (strain:nca 1503) dna] [db:genpept-bct] [de:b.stearothermophilus is-t1 gene.] [le:687] [re:974] [di:direct] |
| 31288956_c2_45 | 2183 | 5837 | 282 | 93 | 170 | 5.60E-13 | [ac:p25814] [gn:rnpa] [or:bacillus subtilis] [ec:3.1.26.5] [de:ribonuclease p protein component, (protein c5) (rnase p)] [sp:p25814] [db:swissprot] |
| 31289818_f1_1 | 2184 | 5838 | 1050 | 349 | 284 | 4.70E-25 | [ln:fvaj1445] [ac:aj001445] [pn:ripening-induced protein] [or:fragaria vesca] [db:genpept-pln] [de:fragaria vesca partial mrna for ripening-induced protein, clone2.3.r1.] [le:<1] [re:1016] [di:direct] |
| 31306562_f2_8 | 2185 | 5839 | 324 | 107 | 55 | 0.58 | [ln:ce1cg13] [ac:j01566:m33100] [or:plasmid cole1] [sr:plasmid cole1 (clone: pew2762 and pmm1.) dna] [db:genpept-bct] [de:plasmid cole1, complete genome.] [nt:mob8 orf; xxx] [le:3657] [re:3818] [di:direct] |
| 31313773_c3_65 | 2186 | 5840 | 228 | 75 | 233 | 1.20E-19 | [ac:p37807] [gn:rpmb] [or:bacillus subtilis] [de:50s ribosomal protein 128] [sp:p37807] [db:swissprot] |
| 31315003_c3_52 | 2187 | 5841 | 810 | 269 | 588 | 2.90E-57 | [ac:b69627] [pn:transcriptional repressor of the fructose operon frur] [gn:frur] [or:bacillus subtilis] [db:pir] |
| 31329067_c2_56 | 2188 | 5842 | 276 | 91 | 66 | 0.062 | [ln:pbu42580] [ac:u42580:u17055:u32570] [gn:a479r] [or:paramecium bursaria chlorella virus 1] [db:genpept-vr1] [de:paramecium bursaria chlorella virus 1, complete genome.] [nt:phe-rich] [le:231265] [re:231591] [di:direct] |
| 31329702_c2_48 | 2189 | 5843 | 984 | 327 | 950 | 1.20E-95 | [ac:f69794] [pn:dna ligase homolog yerg] [gn:yerg] [or:bacillus subtilis] [db:pir] |
| 31406566_c2_36 | 2190 | 5844 | 627 | 208 | 590 | 1.80E-57 | [ac:c70008] [pn:pyrazinamidase/nicotinamidase homolog yueg] [gn:yuej] [or:bacillus subtilis] [db:pir] |
| 31410067_c1_82 | 2191 | 5845 | 1254 | 417 | 748 | 3.20E-74 | [ac:p39377] [gn:iada] [or:escherichia coli] [ec:3.4.19.—] [de:isoaspartyl dipeptidase,] [sp:p39377] [db:swissprot] |
| 31413281_c1_60 | 2192 | 5846 | 225 | 74 | 80 | 0.026 | [ac:p19023] [gn:atp2] [or:zea mays] [sr:,maize] [ec:3.6.1.34] [de:atp synthase beta chain, mitochondrial precursor,] [sp:p19023] [db:swissprot] |
| 31426437_c1_88 | 2193 | 5847 | 516 | 172 | 421 | 1.40E-39 | [ac:f69999] [pn:conserved hypothetical protein ytqi] [gn:ytqi] [or:bacillus subtilis] [db:pir] |
| 31433438_c1_15 | 2194 | 5848 | 606 | 201 | 518 | 7.50E-50 | [ac:f70045] [pn:two-component sensor histidine kinase [yvq homolog yvqe] [gn:yvqe] [or:bacillus subtilis] [db:pir] |
| 31437817_f2_17 | 2195 | 5849 | 210 | 69 | 186 | 1.10E-14 | [ac:s12681:s10490:jp0049:f69697] [pn:ribosomal protein 130:b127] [gn:rpmd] [cl:escherichia coli ribosomal protein 130] [or:bacillus subtilis] [db:pir] |
| 31443828_f3_104 | 2196 | 5850 | 681 | 226 | 403 | 1.10E-37 | [ac:p54443] [gn:yrkp] [or:bacillus subtilis] [de:intergenic region] [sp:p54443] [db:swissprot] |
| 31442937_c2_68 | 2197 | 5851 | 369 | 122 | 55 | 0.71 | [ln:hivlu48123] [ac:u48123] [pn:envelope glycoprotein, c2-v5 region] [gn:env] [or:human immunodeficiency virus type 1] [db:genpept-vr1] [de:human immunodeficiency virus type 1 clone 62s sample i envelopeglycoprotein (env) gene, c2-v5 region, partial cds.] |
| 31445255_f2_4 | 2198 | 5852 | 339 | 112 | 119 | 1.40E-07 | [ln:bsargr] [ac:y09546] [pn:arginine repressor] [gn:argr] [fn:regulation of arginine biosynthesis genes] [or:bacillus stearothermophilus] [db:genpept-bct] [de:b.stearothermophilus argr gene.] [le:32] [re:481] [di:direct] |
| 31447200_c2_75 | 2199 | 5853 | 549 | 182 | 79 | 0.77 | [ac:s33441] [pn:ef protein] [or:streptococcus suis] [db:pir] |
| 31454025_c3_99 | 2200 | 5854 | 591 | 196 | 599 | 2.00E-58 | [ac:p27547] [gn:mtlf] [or:enterococcus faecalis] [sr:,streptococcus faecalis] [ec:2.7.1.69] [de:(ec 2.7.1.69) (eiii-mtl)] [sp:p27547] [db:swissprot] |
| 31458575_c2_48 | 2201 | 5855 | 777 | 258 | 357 | 8.60E-33 | [ac:p37440:p77442:p76963] [gn:ucpa] [or:escherichia coli] [ec:1.—.—.—] [de:oxidoreductase ucpa,] [sp:p37440:p77442:p76963] [db:swissprot] |
| 31460750_c2_28 | 2202 | 5856 | 312 | 103 | 351 | 3.70E-32 | [ac:p03000] [gn:infc] [or:bacillus stearothermophilus] [de:translation initiation factor if-3] [sp:p03000] [db:swissprot] |

TABLE 2-continued

| Orf | NT Seq ID | AA Seq ID | NT Orf length | AA Orf length | Score | Probability | Description |
|---|---|---|---|---|---|---|---|
| 31464687_c1_30 | 2203 | 5857 | 528 | 175 | 364 | 1.60E-33 | [acc:e69840] [pn:hypothetical protein yitl] [gn:yitl] [or:*bacillus subtilis*] [db:pir] |
| 31468_c2_44 | 2204 | 5858 | 594 | 197 | 184 | 1.90E-14 | [acc:e69862] [pn:conserved hypothetical protein ykra] [gn:ykra] [or:*bacillus subtilis*] [db:pir] |
| 31523290_c3_63 | 2205 | 5859 | 1389 | 462 | 1207 | 7.30E-123 | [acc:p54475] [gn:yqfr] [or:*bacillus subtilis*] [de:probable rna helicase in ccca-soda intergenic region] [sp:p54475] [db:swissprot] |
| 31535081_c2_22 | 2206 | 5860 | 183 | 60 | 55 | 0.64 | [ln:hiv1u08822] [acu08822] [pn:envelope glycoprotein, c2v3 region] [gn:env] [or:human immunodeficiency virus type 1] [sr:human immunodeficiency virus type 1, sample 024 from uganda] [db:genpept-vr1] [de:human immunodeficiency virus type 1, sample 024 fro |
| 31539176_f1_1 | 2207 | 5861 | 1044 | 347 | 861 | 3.40E-86 | [ln:silct] [acy07622] [pn:lactate oxidase] [gn:lcto] [fn:lactate utilisation] [or:*streptococcus iniae*] [db:genpept-bct] [de:s.*iniae* lctp & lcto genes and orf1.] [le:2763] [re:3974] [di:direct] |
| 3156257_f1_5 | 2208 | 5862 | 309 | 102 | 103 | 7.10E-06 | [ln:strinte] [ac:129324] [pn:orf11] [or:*streptococcus pneumoniae*] [db:genpept-bct] [de:*streptococcus pneumoniae* putative integrase, putative orf2, putative excisionase, putative orf7, putative repressor protein,putative orf8, putative dna relaxase, putativ |
| 3156257_f3_28 | 2209 | 5863 | 309 | 102 | 110 | 1.30E-06 | [ln:strinte] [ac:129324] [pn:orf11] [or:*streptococcus pneumoniae*] [db:genpept-bct] [de:*streptococcus pneumoniae* putative integrase, putative orf2, putative excisionase, putative orf7, putative repressor protein, putative orf8, putative dna relaxase, putativ |
| 31641002_c2_120 | 2210 | 5864 | 273 | 90 | 69 | 0.17 | [acp:46343] [gn:phoh] [or:*bacillus subtilis*] [de:phoh protein homolog] [sp:p46343] [db:swissprot] |
| 31641965_f1_8 | 2211 | 5865 | 678 | 225 | 271 | 1.10E-23 | [acc:64944] [pn:hypothetical protein b1827] [or:*escherichia coli*] [db:pir] |
| 3164680_f3_16 | 2212 | 5866 | 183 | 60 | 44 | 0.57 | [ln:af015306] [acc:af015306] [pn:small gtp-binding protein sec4p] [gn:sec4] [or:*candida albicans*] [db:genpept-pln] [de:*candida albicans* small gtp-binding protein sec4p (sec4) gene,complete cds.] [nt:similar to *s. cerevisiae* small gtp-binding protein] [le:4 |
| 31646937_c2_14 | 2213 | 5867 | 363 | 120 | 85 | 0.0013 | [acs:57883] [pn:t-cell receptor beta chain (ps7 10.1)] [cl:immunoglobulin v region:immunoglobulin homology] [or:*homo sapiens*] [sr:, man] [db:pir] |
| 31648428_c2_14 | 2214 | 5868 | 2253 | 750 | 2407 | 5.00E-250 | [acp:50849] [gn:pnpa:comr] [or:*bacillus subtilis*] [ec:2.7.7.8] [de:phosphorylase) (pnpase)] [sp:p50849] [db:swissprot] |
| 31656467_c3_126 | 2215 | 5869 | 261 | 86 | 63 | 0.42 | [ac:q0606] [pn:arylesterase, precursor] [or:*pseudomonas fluorescens*] [ec:3.1.1.2] [db:pir] |
| 31675877_c2_19 | 2216 | 5870 | 228 | 75 | 63 | 0.27 | [ln:a12061] [aca12061] [pn:stromelysin] [or:*oryctolagus cuniculus*] [sr:european rabbit] [db:genpept-pat] [de:partial nucleotide sequence of the stromelysin gene.] [le:24] [re: |
| 3167677_f1_5 | 2217 | 5871 | 1158 | 385 | 484 | 3.00E-46 | [acs:76858] [pn:hypothetical protein] [or:*synechocystis sp.*] [sr:pcc 6803, , pcc 6803.] [db:pir] |
| 31678183_c2_15 | 2218 | 5872 | 771 | 256 | 920 | 1.90E-92 | [acp:16971] [gn:recarece] [or:*bacillus subtilis*] [de:reca protein] [sp:p16971] [db:swissprot] |
| 3173417_c1_5 | 2219 | 5873 | 474 | 158 | 438 | 3.20E-41 | [acc:o5519] [gn:ydif] [or:*bacillus subtilis*] [de:hypothetical abc transporter atp-binding protein ydif] [sp:o05519] [db:swissprot] |
| 3173808_c2_124 | 2220 | 5874 | 213 | 70 | 55 | 0.02 | [acp:12388] [gn:pai2-planh2] [or:*mus musculus*] [sr:,mouse] [de:plasminogen activator inhibitor-2, macrophage (pai-2)] [sp:p12388] [db:swissprot] |
| 31807687_c1_22 | 2221 | 5875 | 618 | 206 | 453 | 5.80E-43 | [acp:38494] [gn:ypfd:jofd] [or:*bacillus subtilis*] [de:30s ribosomal protein s1 homolog] [sp:p38494] [db:swissprot] |
| 31817677_f1_10 | 2222 | 5876 | 726 | 241 | 541 | 2.70E-52 | [acc:e69876] [pn:conserved hypothetical protein ylme] [gn:ylme] [or:*bacillus subtilis*] [db:pir] |

TABLE 2-continued

| Orf | NT Seq ID | AA Seq ID | NT Orf length | AA Orf length | Score | Probability | Description |
|---|---|---|---|---|---|---|---|
| 31830216_c1_48 | 2223 | 5877 | 666 | 221 | 127 | 7.00E-06 | [acc:q01042] [gn:73:ceclf1] [or:herpesvirus saimiri] [sr:11,] [de:immediate-early protein] [sp:q01042] [dbs:swissprot] |
| 31844026_c3_59 | 2224 | 5878 | 405 | 134 | 266 | 4.90E-23 | [ln:atkasiiig] [acc:y116689] [pn:3-ketoacyl-acyl carrier protein synthase iii] [gn:kas iii] [or:arabidopsis thaliana] [sr:thale cress] [db:genpept-pln] [de:a.thaliana kas iii gene.] [le:272:714;947:1173:1360] [re:462:862:1083:1278:1478] [di:direct|join] |
| 31879442_c1_73 | 2225 | 5879 | 276 | 91 | 76 | 0.008 | [acc:q69233] [pn:n-terminal acetyltransferase complex, subunit ard1] [gn:mth999] [or:methanobacterium thermoautotrophicum] [db:pir] |
| 31880001_f1_13 | 2226 | 5880 | 282 | 93 | 86 | 0.0019 | [acc:s49295] [pn:hypothetical protein] [or:escherichia coli] [db:pir] |
| 31898502_f1_1 | 2227 | 5881 | 237 | 78 | 70 | 0.0039 | [acc:jc4525] [pn:nucleic acid-binding proteins e5.1:e5.1 protein] [cl:unassigned ribonucleoprotein repeat-containing proteins:ribonucleoprotein repeat homology] [or:homo sapiens] [sr:, man] [db:pir] |
| 31908561_f1_4 | 2228 | 5882 | 195 | 64 | 53 | 0.56 | [acc:s69347] [pn:steroid 11 beta-monooxygenase, cytochrome p450] [cl:cytochrome p450] [or:rana catesbeiana] [sr:, bullfrog] [ec:1.14.15.4] [db:pir] |
| 31914178_c1_13 | 2229 | 5883 | 1737 | 578 | 1859 | 5.90E-192 | [acc:f69884] [pn:conserved hypothetical protein ymda] [gn:ymda] [or:bacillus subtilis] [db:pir] |
| 31914626_c2_56 | 2230 | 5884 | 378 | 125 | 156 | 1.70E-11 | [ln:atupinf] [acc:m19352] [pn:unknown protein] [or:agrobacterium tumefaciens] [sr:a.tumefaciens (strain a6) dna, pvck219] [db:genpept-bct] [de:agrobacterium tumefaciens pinf1 and pinf2 genes, complete cds.] [nt:orf1; putative] [le:1344] [re:1964] [di:direc |
| 32031412_f2_21 | 2231 | 5885 | 408 | 135 | 475 | 2.70E-45 | [acc:f32307] [pn:ribosomal protein 117] [cl:escherichia coli ribosomal protein 117] [or:bacillus subtilis] [db:pir] |
| 32035707_c2_25 | 2232 | 5886 | 735 | 244 | 373 | 5.30E-34 | [acc:q05506] [gn:ydr341c:d9651.10] [or:saccharomyces cerevisiae] [sr:baker's yeast] [ec:6.1.1.19] [de:-trna ligase) (argrs)] [sp:q05506] [dbs:swissprot] |
| 32035938_c2_123 | 2233 | 5887 | 816 | 271 | 631 | 7.90E-62 | [acc:q02115] [gn:lytr] [or:bacillus subtilis] [de:membrane-bound protein lytr] [sp:q02115] [dbs:swissprot] |
| 3204549_c1_28 | 2234 | 5888 | 303 | 100 | 120 | 1.20E-07 | [acc:69826] [pn:1-acylglycerol-3-phosphate o-acyltransfera homolog yhdo] [gn:yhdo] [or:bacillus subtilis] [db:pir] |
| 32047676_c2_13 | 2235 | 5889 | 582 | 193 | 396 | 6.30E-37 | [ln:vflu65015] [acc:u65015] [pn:glcnac 6-p deacetylase] [gn:mand] [or:vibrio furnissii] [db:genpept-bct] [de:vibrio furnissii pts permease for mannose subunits iiiman cterminal domain (manx), iipman (many), iibman (manz), and iiiman-nterminal domain (manw). |
| 32064752_f3_148 | 2236 | 5890 | 315 | 104 | 94 | 0.0004 | [acc:s22623] [pn:undecaprenyl-phosphate galactosephosphotransferase,] [gn:rfbp] [or:salmonella choleraesuis] [ec:2.7.8.6] [db:pir] |
| 32070200_f2_37 | 2237 | 5891 | 225 | 74 | 74 | 0.028 | [acc:q0329] [gn:mj0014] [or:methanococcus jannaschii] [de:hypothetical protein mj0014] [sp:q00329] [dbs:swissprot] |
| 32070768_c2_24 | 2238 | 5892 | 240 | 79 | 343 | 2.60E-31 | [acc:23532] [gn:lacf] [or:lactococcus lactis] [sr:,subsplactis:streptococcus lactis] [ec:2.7.1.69] [de:(ec 2.7.1.69) (eiii-lac)] [sp:p23532] [dbs:swissprot] |
| 32073375_f1_1 | 2239 | 5893 | 192 | 63 | 131 | 2.50E-08 | [acc:d69759] [pn:hypothetical protein ycgq] [gn:ycgq] [or:bacillus subtilis] [db:pir] |
| 32073562_c3_63 | 2240 | 5894 | 234 | 77 | 64 | 0.092 | [acc:g70021] [pn:hypothetical protein yusn] [gn:yusn] [or:bacillus subtilis] [db:pir] |
| 32078186_f3_127 | 2241 | 5895 | 240 | 79 | 59 | 0.0011 | [ln:lllpk214] [acc:x92946;y10522] [pn:hypothetical protein] [gn:orf4] [or:lactococcus lactis] [db:genpept-bct] [de:lactobacillus lactis plasmid pk214, complete sequence.] [le:1824] [re:2189] [di:direct] |
| 32082162_c2_47 | 2242 | 5896 | 1452 | 483 | 1610 | 1.40E-165 | [acc:p22250] [gn:glix] [or:bacillus subtilis] [ec:6.1.1.17] [de:(glurs)] [sp:p22250] [dbs:swissprot] |
| 32082962_c1_11 | 2243 | 5897 | 393 | 130 | 218 | 2.10E-17 | [acc:g53610] [pn:ntpj protein] [or:enterococcus hirae] [db:pir] |

TABLE 2-continued

| Orf | NT Seq ID | AA Seq ID | NT Orf length | AA Orf length | Score | Probability | Description |
|---|---|---|---|---|---|---|---|
| 32085953_f3_26 | 2244 | 5898 | 819 | 272 | 821 | 5.80E-82 | [ac:p37551] [gn:purr] [or:bacillus subtilis] [de:pur operon repressor] [sp:p37551] [db:swissprot] |
| 3209766_c2_103 | 2245 | 5899 | 810 | 269 | 149 | 6.60E-08 | [ln:celzc178] [ac:af024496] [gn:zc178.1] [or:caenorhabditis elegans] [sr:caenorhabditis elegans strain=bristol n2] [db:genpept-inv] [de:caenorhabditis elegans cosmid zc178.] [le:20] [re:1648] [di:direct] |
| 32125305_f1_47 | 2246 | 5900 | 441 | 146 | 117 | 1.30E-06 | [ac:s16613] [pn:opacity protein opab precursor] [gn:opab] [cl:opacity protein] [or:neisseria gonorrhoeae] [sr:strain ms11, , strain ms11] [db:pir] |
| 32132301_f3_9 | 2247 | 5901 | 543 | 180 | 81 | 0.57 | [ac:a64481] [pn:hypothetical protein mj1450] [or:methanococcus jannaschii] [db:pir] [mp:for1419701-1420816] |
| 32134430_c3_171 | 2248 | 5902 | 615 | 204 | 86 | 0.33 | [ac:s45598:s43556] [pn:plasminogen-binding protein mlc36] [cl:m5 protein] [or:streptococcus sp.] [db:pir] |
| 32145817_c1_46 | 2249 | 5903 | 570 | 189 | 237 | 4.50E-20 | [ac:e69786] [pn:ribosomal-protein-alanine n-acetyltransfer homolog ydid] [gn:ydid] [or:bacillus subtilis] [db:pir] |
| 32157953_f2_6 | 2250 | 5904 | 222 | 73 | 61 | 0.13 | [ln:af001101] [ac:af001101] [pn:cysteine protease] [gn:ndicp1298] [or:dirofilaria immitis] [db:genpept-inv] [de:dirofilaria immitis cysteine protease (ndicp1298) mrna, partialcds.] [le:<1] [re:1203] [di:direct] |
| 32204785_f3_34 | 2251 | 5905 | 1644 | 547 | 847 | 1.00E-84 | [ac:h69299] [pn:nadh oxidase (noxa-3) homolog] [or:archaeoglobus fulgidus] [db:pir] |
| 32210927_c2_108 | 2252 | 5906 | 1071 | 356 | 892 | 1.70E-89 | [ac:a47092] [pn:replication protein repa] [gn:repa] [or:enterococcus faecalis] [db:pir] |
| 32212575_c1_82 | 2253 | 5907 | 267 | 88 | 188 | 2.50E-14 | [ln:shu75349] [ac:u75349] [pn:putative abc transporter shic] [or:serpulina hyodysenteriae] [db:genpept-bct] [de:serpulina hyodysenteriae shi operon, periplasmic-iron-bindingproteins shia and shib, putative abc transporter shic, and putativepermeases shid |
| 32213278_f2_11 | 2254 | 5908 | 186 | 61 | 102 | 9.00E-06 | [ln:synorflac] [ac:m15619] [or:artificial sequence] [db:genpept-syn] [de:synthetic e.coli orf16/lacz fusion protein, partial cds.] [nt:orf16-lacz fusion protein] [le:29] [re: fusion protein, partial cds.] [nt:orf16-lacz fusion protein] [le:29] [re: |
| 32213278_f2_5 | 2255 | 5909 | 186 | 61 | 102 | 9.00E-06 | [ln:synorflac] [ac:m15619] [or:artificial sequence] [sr:e.coli (strain se5000) synthetic dna, clone pkb1] [db:genpept-syn] [de:synthetic e.coli orf16/lacz fusion protein, partial cds.] [nt:orf16-lacz fusion protein] [le:29] [re: |
| 32218761_c1_2 | 2256 | 5910 | 183 | 60 | 61 | 0.18 | [ac:s73440] [pn:hypothetical protein b01_orf103b] [or:mycoplasma pneumoniae] [sr:atcc 29342, , atcc 29342] [db:pir] |
| 32218761_c2_66 | 2257 | 5911 | 183 | 60 | 61 | 0.18 | [ac:s73440] [pn:hypothetical protein b01_orf103b] [or:mycoplasma pneumoniae] [sr:atcc 29342, , atcc 29342] [db:pir] |
| 32223401_c2_39 | 2258 | 5912 | 207 | 68 | 49 | 0.19 | [ac:p75083] [or:mycoplasma pneumoniae] [de:hypothetical protein mg028 homolog] [sp:p75083] [db:swissprot] |
| 32224026_f3_16 | 2259 | 5913 | 270 | 89 | 61 | 0.97 | [ac:p35983] [or:canine adenovirus type 2] [de:e1b protein, small t-antigen (early e1b 20 kd protein)] [sp:p35983] [db:swissprot] |
| 32225665_c3_18 | 2260 | 5914 | 240 | 79 | 58 | 0.34 | [ln:hsfrgam2] [ac:z32633] [pn:frgamma'] [or:homo sapiens] [sr:human] [db:genpept-pri1] [de:h.sapiens frgamma' mrna for folate receptor (817bp).] [sp:p41439] [le:18] [re:332] [di:direct] |
| 32226526_f2_4 | 2261 | 5915 | 183 | 60 | 47 | 0.72 | [ac:a53028:s08071] [pn:isopentenyl-diphosphate delta-isomerase, homolog:hypothetical protein c54] [gn:idi1] [or:homo sapiens] [db:pir] [mp:15q25.1-15q25.2] [ec:5.3.3.2] |
| 32226526_f2_48 | 2262 | 5916 | 192 | 63 | 60 | 0.26 | [ln:hivu67374] [ac:u67374] [pn:gp105] [gn:env] [or:human immunodeficiency virus type 2] [db:genpept-vrl] [de:hiv-2 isolate abi20 from cote d'ivoire, gp105 (env) gene, partialcds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 32226577_f3_76 | 2263 | 5917 | 948 | 315 | 701 | 3.00E-69 | [ln:atceld] [ac:z77855] [pn:sugar-binding transport protein] [or:anaerocellum thermophilum] [db:genpept-bct] [de:a.thermophilum celd gene.] [nt:putative] [le:2944] [re:3882] [di:direct] |
| 32228442_f1_7 | 2264 | 5918 | 921 | 306 | 864 | 1.60E-86 | [ac:e69670] [pn:glycine betaine/carnitine/choline abc transporter (osmoprotec) opucc] [gn:opucc] [or:bacillus subtilis] [db:pir] |
| 32229561_f3_33 | 2265 | 5919 | 657 | 218 | 574 | 8.70E-56 | [ac:p96707] [gn:ydgi] [or:bacillus subtilis] [ec:1.—.—.—] [de:putative nad(p)h nitroreductase,] [sp:p96707] [db:swissprot] |
| 32235277_f3_15 | 2266 | 5920 | 1113 | 370 | 1752 | 1.30E-180 | [ac:q47827] [gn:ddl1] [or:enterococcus hirae] [ec:6.3.2.4] [de:d-alanine–d-alanine ligase, (d-alanylalanine synthetase)] [sp:q47827] [db:swissprot] |
| 32239437_f2_26 | 2267 | 5921 | 327 | 108 | 77 | 0.047 | [ac:hsu77612] [acu:77612] [pn:proglucagon] [gn:lpii] [or:heloderma suspectum] [sr:gila monster] [db:genpept-vrt] [de:heloderma suspectum proglucagon (lpii) mrna, complete cds.] [nt:pancreatic proglucagon] [le:96] [re:710] [di:direct] |
| 32241590_f1_3 | 2268 | 5922 | 207 | 68 | 50 | 0.057 | [ln:cet27e7] [ac:z82284] [pn:t27e7.1] [or:caenorhabditis elegans] [db:genpept-inv] [de:caenorhabditis elegans cosmid t27e7, complete sequence.] [nt:protein predicted using genefinder] [le:2361:2518:2635:3036] [re:2418:2586:2810:3239] [di:directjoin] |
| 32245388_f3_8 | 2269 | 5923 | 750 | 249 | 606 | 3.50E-59 | [ac:p42360] [or:streptococcus gordonii challis] [de:(orf1)] [sp:p42360] [db:swissprot] |
| 32245937_c2_109 | 2270 | 5924 | 189 | 62 | 58 | 0.34 | [ln:ysp972ha] [ac:d83992] [or:schizosaccharomyces pombe] [sr:schizosaccharomyces pombe (strain:972h-) dna, clone_lib:mizukam] [db:genpept-pln] [de:fission yeast dna for isp4, peptidyl prolyl cis-trans isomerase,atf1, chromosome ii cosmid 1228 sequence.] |
| 3230002_c2_34 | 2271 | 5925 | 603 | 200 | 67 | 0.072 | [ac:p37745] [gn:rfbc] [or:escherichia coli] [ec:5.1.3.13] [de:deoxyglucose 3,5-epimerase] (dtdp-1-rhamnose synthetase)] [sp:p37745] [db:swissprot] |
| 32304562_c2_1 | 2272 | 5926 | 468 | 155 | 64 | 0.13 | [ac:s81755] [gn:calcium receptor[car] [or:homo sapiens] [sr:human keratinocytes neonatal foreskin] [db:genpept-pri2] [de:calcium receptor[car [human, neonatal foreskin, keratinocytes, mrnapartial, 798 nt].] [le:1] [re:798] [di:direct] |
| 32313_f1_6 | 2273 | 5927 | 225 | 74 | 68 | 0.072 | [ln:eavrmn0] [ac:x78501] [pn:small envelope protein] [gn:m] [or:equine arteritis virus] [db:genpept-vrl] [de:equine arteritis virus (isolate norw2) mrna for m and n proteins.] [le:8] [re:496] [di:direct] |
| 32319831_c3_71 | 2274 | 5928 | 252 | 83 | 67 | 0.026 | [ac:o05543] [or:gluconobacter suboxydans] [de:hypothetical protein in adhs 5'region (orf3) (fragment)] [sp:o05543] [db:swissprot] |
| 32423186_f1_1 | 2275 | 5929 | 192 | 63 | 49 | 0.35 | [ac:p47585] [gn:mg343] [or:mycoplasma genitalium] [de:hypothetical protein mg-343] [sp:p47585] [db:swissprot] |
| 32428030_c2_124 | 2276 | 5930 | 939 | 312 | 800 | 9.80E-80 | [ac:q07211] [gn:scrk] [or:streptococcus mutans] [ec:2.7.1.4] [de:fructokinase,] [sp:q07211] [db:swissprot] |
| 32461562_f3_28 | 2277 | 5931 | 600 | 199 | 503 | 2.90E-48 | [ac:g69761] [pn:phenylacrylic acid decarboxylase homolog yclb] [gn:yclb] [or:bacillus subtilis] [db:pir] |
| 32464717_f1_3 | 2278 | 5932 | 1164 | 387 | 683 | 2.50E-67 | [ac:b69875] [pn:conserved hypothetical protein ylbm] [gn:ylbm] [or:bacillus subtilis] [db:pir] |
| 32468786_f3_16 | 2279 | 5933 | 381 | 126 | 53 | 0.9 | [ln:yscpho] [ac:m17306] [gn:pho5] [or:saccharomyces cerevisiae] [sr:yeast (s.cerevisiae) dna, clone pgem2/pho5] [db:genpept-pln] [de:yeast (s.cerevisiae) acid phosphatase (pho5) gene, 5' end.] [nt:acid phsophatase precursor] [le:1] [re: |
| 32478130_f3_7 | 2280 | 5934 | 438 | 145 | 248 | 1.20E-20 | [ac:p39145] [gn:comfa:comf1] [or:bacillus subtilis] [de:comf operon protein 1] [sp:p39145] [db:swissprot] |
| 32505042_f3_29 | 2281 | 5935 | 552 | 183 | 689 | 5.70E-68 | [ac:p21467] [gn:rpse:spca] [or:bacillus subtilis] [de:30s ribosomal protein s5 (bs5)] [sp:p21467] [db:swissprot] |

TABLE 2-continued

| Orf | NT Seq ID | AA Seq ID | NT Orf length | AA Orf length | Score | Probability | Description |
|---|---|---|---|---|---|---|---|
| 32539191_c3_63 | 2282 | 5936 | 1410 | 469 | 1134 | 4.00E-115 | [ac:p96995] [gn:gale] [or:streptococcus mutans] [ec:5.1.3.2] [de:galactose 4-epimerase] [sp:p96995] [db:swissprot] |
| 32547553_c1_27 | 2283 | 5937 | 294 | 97 | 79 | 0.015 | [ac:a28444] [pn:filaggrin precursor] [or:mus musculus] [sr:, house mouse] [db:pir] |
| 3256702_f2_20 | 2284 | 5938 | 384 | 127 | 49 | 1 | [ac:p34632] [gn:zk370.9] [or:caenorhabditis elegans] [de:hypothetical 6.2 kd protein zk370.9 in chromosome iii] [sp:p34632] [db:swissprot] |
| 32611587_c2_53 | 2285 | 5939 | 1311 | 436 | 426 | 4.20E-40 | [ac:f69885] [pn:processing proteinase homolog ymfg] [gn:ymfg] [or:bacillus subtilis] [db:pir] |
| 32614818_c2_115 | 2286 | 5940 | 192 | 63 | 51 | 0.17 | [ac:s76437] [pn:hypothetical protein] [or:synechocystis sp.] [sr:pcc 6803, ., pcc 6803] [sr:pcc 6803,] [db:pir] |
| 32620938_c3_27 | 2287 | 5941 | 1422 | 473 | 892 | 1.70E-89 | [ac:p50729] [gn:recq] [or:bacillus subtilis] [ec:3.6.1.—] [de:atp-dependent dna helicase recq,] [sp:p50729] [db:swissprot] |
| 32666_f3_36 | 2288 | 5942 | 261 | 86 | 69 | 0.19 | [ln:cee08b6] [ac:z72502] [pn:c08b6.9] [or:caenorhabditis elegans] [db:genpept-inv] [de:caenorhabditis elegans cosmid c08b6, complete sequence.] [nt:similar to ubiquitin activating enzyme] [le:26356:27940:28335] [re:26518:28287:28603] [di:complementjoin] |
| 32680212_c3_148 | 2289 | 5943 | 948 | 315 | 453 | 5.80E-43 | [ln:sau73374] [ac:u73374] [pn:cap8n] [gn:cap8n] [or:staphylococcus aureus] [db:genpept-bct] [de:staphylococcus aureus type 8 capsule genes, cap8a, cap8b, cap8c, cap8d, cap8e, cap8f, cap8g, cap8h, cap8i, cap8j, cap8k, cap8l, cap8m, cap8n, cap8o, cap8p, compl] |
| 32695385_c2_11 | 2290 | 5944 | 273 | 90 | 56 | 0.49 | [ln:cell2004] [ac:u80029] [gn:t2o4.16] [or:caenorhabditis elegans] [sr:caenorhabditis elegans strain=bristol n2] [db:genpept-inv] [de:caenorhabditis elegans cosmid t20d4.] [le:4076:4256] [re:4126:4375] [di:complementjoin] |
| 32695937_c2_41 | 2291 | 5945 | 1584 | 527 | 119 | 0.0005 | [ac:i40055] [pn:positive trans-activator of capsule synthesis] [gn:acpa] [or:bacillus anthracis] [db:pir] |
| 32788_c3_33 | 2292 | 5946 | 1263 | 420 | 666 | 1.60E-65 | [ac:q02115] [gn:lytr] [or:bacillus subtilis] [de:membrane-bound protein lytr] [sp:q02115] [db:swissprot] |
| 3298262_c1_120 | 2293 | 5947 | 387 | 128 | 344 | 2.10E-31 | [ac:f69791] [pn:conserved hypothetical protein yebb] [gn:yebb] [or:bacillus subtilis] [db:pir] |
| 3313510_c2_43 | 2294 | 5948 | 264 | 87 | 69 | 0.0006 | [ln:af001845] [ac:af001845] [pn:atrophin-1 related protein] [or:homo sapiens] [sr:human] [db:genpept-pri2] [de:homo sapiens atrophin-1 related protein mrna, partial cds.] [nt:hatrp] [le:565] [re: |
| 3317090_f2_19 | 2295 | 5949 | 240 | 79 | 60 | 0.23 | [ac:s61055:s67706:s67710] [pn:probable membrane protein yd1158c:hypothetical protein d1530] [or:saccharomyces cerevisiae] [db:pir] [mp:41] |
| 33203387_c2_14 | 2296 | 5950 | 228 | 75 | 66 | 0.063 | [ac:p48934] [gn:sdh3:sdhc] [or:chondrus crispus] [sr:,carragheen] [de:dehydrogenase, subunit iii)] [sp:p48934] [db:swissprot] |
| 33203387_f2_18 | 2297 | 5951 | 237 | 78 | 57 | 0.41 | [ac:p33512] [gn:nd41] [or:anopheles quadrimaculatus] [sr:,mosquito] [ec:1.6.5.3] [de:nadh-ubiquinone oxidoreductase chain 41,] [sp:p33512] [db:swissprot] |
| 33203387_f2_45 | 2298 | 5952 | 198 | 65 | 57 | 0.54 | [ac:p48934] [gn:sdh3:sdhc] [or:chondrus crispus] [sr:,carragheen] [de:dehydrogenase, subunit iii)] [sp:p48934] [db:swissprot] |
| 33203387_f3_36 | 2299 | 5953 | 228 | 75 | 61 | 0.23 | [ac:p48934] [gn:sdh3:sdhc] [or:chondrus crispus] [sr:,carragheen] [de:dehydrogenase, subunit iii)] [sp:p48934] [db:swissprot] |
| 33203387_f3_68 | 2300 | 5954 | 192 | 63 | 46 | 0.54 | [ln:hsu73006] [ac:u73006] [pn:vacuolar-type h(+) atpase 115 kda subunit] [or:homo sapiens] [sr:human] [db:genpept-pri2] [de:human vacuolar-type h(+) atpase 115 kda subunit mma, complete cds.] [nt:homolog of yeast vph1 gene; similar to bovine] [le:170] [r |

TABLE 2-continued

| Orf | NT Seq ID | AA Seq ID | NT Orf length | AA Orf length | Score | Probability | Description |
|---|---|---|---|---|---|---|---|
| 33207930_f3_6 | 2301 | 5955 | 261 | 86 | 229 | 3.20E-19 | [ln:tmcsp131p] [acy11219] [pn:cold shock protein] [or:*thermotoga maritima*] [db:genpept] [de:*thermotoga maritima* genes encoding cold shock protein and largesubunit ribosomal protein 13l.] [le:351] [re:551] [di:direct] |
| 33209525_f2_59 | 2302 | 5956 | 186 | 61 | 60 | 0.23 | [ln:bsu66480] [ac:u66480] [pn:ynah] [gn:ynah] [or:*bacillus subtilis*] [db:genpept-bct] [de:*bacillus subtilis* spovk (spovk), ynba (ynba), ynbb (ynbb), glnr (glnr), glutamine synthetase (glna), ynaa (ynaa), ynab (ynab), ynac (ynac), ynad (ynad), ynae (ynae). y |
| 3321093_c1_117 | 2303 | 5957 | 1488 | 495 | 476 | 2.10E-45 | [ln:u93688] [ac:u93688] [or:*staphylococcus aureus*] [db:genpept-bct] [de:*staphylococcus aureus* toxic shock syndrome toxin-1 (tst),enterotoxin (ent), and integrase (int) genes, complete cds.] [nt:orf11] [le:7956] [re:8729] [di:complement] |
| 33218816_f3_25 | 2304 | 5958 | 315 | 104 | 74 | 0.097 | [ac:s21346] [pn:probable pol polyprotein-related protein 2] [di:pol polyprotein] [or:*rattus norvegicus*] [sr:, norway rat] [db:pir] |
| 3321962_c1_22 | 2305 | 5959 | 705 | 234 | 275 | 4.20E-24 | [ac:d70043] [pn:hypothetical protein yvlb] [gn:yvlb] [or:*bacillus subtilis*] [db:pir] |
| 3322302_f3_3 | 2306 | 5960 | 552 | 183 | 496 | 1.60E-47 | [ac:p71040] [gn:ywne] [or:*bacillus subtilis*] [de:hypothetical 55.8 kd protein in spoiiq-mta intergenic region] [sp:p71040] [db:swissprot] |
| 33226558_c2_29 | 2307 | 5961 | 546 | 181 | 68 | 0.039 | [ac:s23349] [pn:hypothetical protein 17.4] [or:*salmonella choleraesuis*] [db:pir] |
| 33235317_f3_8 | 2308 | 5962 | 1191 | 396 | 621 | 6.80E-69 | [ac:q11047] [gn:mtcy50.10] [or:*mycobacterium tuberculosis*] [de:hypothetical abc transporter atp-binding protein cy50.10] [sp:q11047] [db:swissprot] |
| 33237517_c1_38 | 2309 | 5963 | 222 | 73 | 59 | 0.91 | [ac:a70029] [pn:hypothetical protein yvax] [gn:yvax] [or:*bacillus subtilis*] [db:pir] |
| 33239012_c2_11 | 2310 | 5964 | 1383 | 461 | 578 | 2.10E-59 | [ln:af008219] [ac:af008219] [pn:unknown] [or:*borrelia afzelii*] [db:genpept-bct] [de:*borrelia afzelii* r-ip3 chromosome right end, area and arcb genes, complete cds.] [nt:orf473] [le:3925] [re:5346] [di:direct] |
| 33242186_c3_59 | 2311 | 5965 | 774 | 257 | 100 | 0.016 | [ac:p44643] [gn:hi0333] [or:*haemophilus influenzae*] [ec:2.1.1.—] [de:hypothetical rna methyltransferase hi0333,] [sp:p44643] [db:swissprot] |
| 33242202_c1_53 | 2312 | 5966 | 3150 | 1049 | 1506 | 2.80E-224 | [ln:af034786] [ac:af034786] [pn:restriction subunit] [gn:hsdr] [fn:lldi type i restriction modification] [or:*lactococcus lactis* bv. *diacetylactis*] [db:genpept-bct] [de:*lactococcus lactis* bv. diacetylactis, plasmid pnd861, lldi type i restriction subunit (h |
| 33242325_c3_26 | 2313 | 5967 | 621 | 206 | 296 | 2.50E-26 | [ac:p12464] [gn:rpoe] [or:*bacillus subtilis*] [ec:2.7.7.6] [de:dna-directed rna polymerase delta subunit,] [sp:p12464] [db:swissprot] |
| 33244812_f2_28 | 2314 | 5968 | 603 | 200 | 77 | 0.012 | [ln:fplrepfib] [ac:m26308] [or:plasmid inef] [sr:plasmid inef dna] [db:genpept-bct] [de:inef plasmid repfib replicon.] [nt:or17] [le:859] [re:1110] [di:direct] |
| 33251436_c1_21 | 2315 | 5969 | 972 | 323 | 888 | 4.60E-89 | [ac:o06987] [gn:yvde] [or:*bacillus subtilis*] [de:hypothetical transcriptional regulator in clpp-crh intergenic region] [sp:o06987] [db:swissprot] |
| 33259677_f2_51 | 2316 | 5970 | 2907 | 968 | 142 | 1.80E-08 | [ln:sau58333] [ac:u58333] [pn:surface protein rib] [gn:rib] [or:*streptococcus agalactiae*] [sr:*streptococcus agalactiae* strain=bm110] [db:genpept-bct] [de:*streptococcus agalactiae* group b surface protein rib (rib) gene,complete cds.] [le:70] [re:3765] [di: |
| 33281257_c1_13 | 2317 | 5971 | 417 | 138 | 79 | 0.25 | [ac:s69757] [pn:hypothetical protein ydr149c] [or:*saccharomyces cerevisiae*] [db:pir] [mp:4r] |
| 33291375_f1_16 | 2318 | 5972 | 183 | 60 | 121 | 8.80E-08 | [ln:serry1] [ac:107627] [or:*saccharopolyspora erythraea*] [sr:*saccharopolyspora erythraea* (strain nrrl 2338) dna; and insertio] [db:genpept-bct] [de:*saccharopolyspora erythraea* insertion sequence is1136, copy b, 5'end.] [nt:putative] [le:445] [re:718] [di: |

TABLE 2-continued

| Orf | NT Seq ID | AA Seq ID | NT Orf length | AA Orf length | Score | Probability | Description |
|---|---|---|---|---|---|---|---|
| 33292342_f1_1 | 2319 | 5973 | 207 | 68 | 63 | 0.73 | [ac:p75423] [gn:cyss] [or:mycoplasma pneumoniae] [ec:6.1.1.16] [de:(cysrs) [sp:p75423] [db:swissprot] |
| 33306637_c1_17 | 2320 | 5974 | 528 | 175 | 455 | 3.50E-43 | [ac:c69981] [pn:nifs protein homolog homolog yrvo] [gn:yrvo] [or:bacillus subtilis] [db:pir] |
| 33314637_c3_69 | 2321 | 5975 | 774 | 257 | 753 | 9.40E-75 | [ac:b69972] [pn:spore coat protein homolog yrbc] [gn:yrbc] [or:bacillus subtilis] [db:pir] |
| 33323962_c2_24 | 2322 | 5976 | 774 | 257 | 107 | 0.0019 | [ln:ab006796] [ac:ab006796] [pn:integrase] [gn:int] [or:staphylococcus aureus] [sr:staphylococcus aureus (strain:atcc49775) dna] [db:genpept-bct] [de:staphylococcus aureus genes for luks-pv, lukf-pv and integrase,complete cds.] [le:3308] [di:com] |
| 33336053_c2_45 | 2323 | 5977 | 1011 | 336 | 1249 | 2.60E-127 | [ln:listms] [ac:m92842] [gn:prs] [or:listeria monocytogenes] [sr:listeria monocytogenes (strain 1028) dna] [db:genpept-bct] [de:listeria monocytogenes tms and prs genes, partial cds.] [le:808] [re: |
| 33335827_c3_6 | 2324 | 5978 | 612 | 204 | 490 | 6.90E-47 | [ac:p37710] [or:enterococcus faecalis] [sr:streptococcus faecalis] [ec:3.5.1.28] [de:autolysin, (n-acetylmuramoyl-1-alanine amidase] [sp:p37710] [db:swissprot] |
| 33360687_f1_6 | 2325 | 5979 | 525 | 174 | 81 | 0.6 | [ac:p53676] [or:rattus norvegicus] [sr:,rat] [de:assembly protein complex 1 medium chain homolog 1) (p47a)] [sp:p53676] [db:swissprot] |
| 33361050_c3_21 | 2326 | 5980 | 684 | 227 | 94 | 0.033 | [ac:p54567] [gn:yqkd] [or:bacillus subtilis] [de:hypothetical 34.6 kd protein in glnq-ansr intergenic region] [sp:p54567] [db:swissprot] |
| 33362800_c3_49 | 2327 | 5981 | 900 | 299 | 870 | 3.70E-87 | [ac:q07211] [gn:scrk] [or:streptococcus mutans] [ec:2.7.1.4] [de:fructokinase,] [sp:q07211] [db:swissprot] |
| 33366436_f2_9 | 2328 | 5982 | 1533 | 510 | 1497 | 1.40E-153 | [ac:d69772] [pn:atp-dependent rna helicase homolog ydbr] [gn:ydbr] [or:bacillus subtilis] [db:pir] |
| 33370688_f3_31 | 2329 | 5983 | 261 | 86 | 72 | 0.014 | [ac:s74519] [pn:suppressor protein htar:hypothetical protein slr0724:hypothetical protein slr0724] [or:synechocystis sp.] [sr:pcc 6803, , pcc 6803] [sr:pcc 6803,] [db:pir] |
| 33375050_f1_20 | 2330 | 5984 | 666 | 221 | 580 | 2.00E-56 | [ac:p50854] [gn:ribe:ribb] [or:actinobacillus pleuropneumoniae] [sr:haemophilus pleuropneumoniae] [ec:2.5.1.9] [de:riboflavin synthase alpha chain,] [sp:p50854] [db:swissprot] |
| 33381392_f2_1 | 2331 | 5985 | 2586 | 861 | 2798 | 1.90E-291 | [ac:p47847] [gn:seca] [or:listeria monocytogenes] [de:preprotein translocase seca subunit] [sp:p47847] [db:swissprot] |
| 33385135_c3_8 | 2332 | 5986 | 600 | 199 | 127 | 7.90E-14 | [ac:c69534] [pn:dna polymerase, bacteriophage-type homolog] [or:archaeoglobus fulgidus] [db:pir] |
| 33396911_c2_17 | 2333 | 5987 | 246 | 81 | 191 | 3.40E-15 | [ac:p45903] [gn:yqaf] [or:bacillus subtilis] [de:region (orf8)] [sp:p45903] [db:swissprot] |
| 33398432_c2_253 | 2334 | 5988 | 579 | 192 | 58 | 0.76 | [ln:scu96108] [ac:u96108] [pn:scee precursor] [gn:scee] [or:staphylococcus carnosus] [db:genpept-bct] [de:staphylococcus carnosus (3r)-hydroxymyristoyl acyl carrier proteindehydrase homolog (fabz) gene, partial cds, ywpf homolog, single-strand binding prot |
| 33398450_f1_6 | 2335 | 5989 | 1989 | 662 | 1813 | 4.40E-187 | [ac:o05519] [gn:ydif] [or:bacillus subtilis] [de:hypothetical abc transporter atp-binding protein ydif] [sp:o05519] [db:swissprot] |
| 33400926_c3_78 | 2336 | 5990 | 282 | 93 | 209 | 4.20E-17 | [ac:p55153] [gn:dltc] [or:lactobacillus casei] [de:d-alanyl carrier protein (dcp)] [sp:p55153] [db:swissprot] |
| 33401582_c2_17 | 2337 | 5991 | 402 | 133 | 397 | 5.00E-37 | [ac:p45871] [gn:ywkd] [or:bacillus subtilis] [de:hypothetical 14.8 kd protein in tdk-prfa intergenic region] [sp:p45871] [db:swissprot] |
| 33402217_c1_51 | 2338 | 5992 | 2160 | 719 | 809 | 2.40E-155 | [ac:h69877] [pn:calcium-transporting atpase homolog ylob] [gn:ylob] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 33407566_f2_26 | 2339 | 5993 | 237 | 78 | 64 | 0.11 | [ln:a51541] [acc:a51541] [pn:orf3] [fn:unknown] [or:unidentified] [db:genpept-pat] [de:sequence 1 from patent ep0719864.] [le:3573] [re:5838] [di:complement] |
| 33407912_c2_60 | 2340 | 5994 | 1521 | 506 | 811 | 6.70E-81 | [acc:a69756] [pn:adhesion protein homolog ycdh] [gn:ycdh] [or:bacillus subtilis] [db:pir] |
| 33413503_c1_16 | 2341 | 5995 | 921 | 306 | 1079 | 2.70E-109 | [acc:c69637] [pn:dna gyrase-like protein (subunit b) grlb] [gn:grlb] [or:bacillus subtilis] [db:pir] |
| 33445967_c1_42 | 2342 | 5996 | 321 | 106 | 136 | 2.30E-09 | [acc:c69878] [pn:hypothetical protein yloh] [gn:yloh] [or:bacillus subtilis] [db:pir] |
| 33447337_f3_2 | 2343 | 5997 | 555 | 184 | 88 | 0.083 | [ln:ae000788] [acc:ae000788] [pn:protein p23] [gn:bbk52] [or:borrelia burgdorferi] [sr:lyme disease spirochete] [db:genpept-bct] [de:borrelia burgdorferi plasmid lp36, complete plasmid sequence.] [nt:similar to gb:131616 pid:520778 gb:ae000785] [le:34595] |
| 33463_c3_28 | 2344 | 5998 | 1014 | 337 | 597 | 3.20E-58 | [acc:q05506] [gn:ydr341c:d9651.10] [or:saccharomyces cerevisiae] [sr:baker's yeast] [ec:6.1.1.19] [de:-trna ligase) (argrs)] [sp:q05506] [db:swissprot] |
| 33469050_c1_111 | 2345 | 5999 | 747 | 248 | 341 | 4.30E-31 | [ac:h70004] [pn:conserved hypothetical protein ytzf] [gn:ytzf] [or:bacillus subtilis] [db:pir] |
| 33470062_c3_41 | 2346 | 6000 | 465 | 154 | 355 | 1.40E-32 | [acc:g69345] [pn:nucleoside diphosphate kinase (ndk) homolog] [or:archaeoglobus fulgidus] [db:pir] |
| 33480337_f1_4 | 2347 | 6001 | 417 | 138 | 383 | 1.50E-35 | [ln:ehy13922] [acc:y13922:y15222] [gn:mrar] [or:enterococcus hirae] [db:genpept-bct] [de:enterococcus hirae mrar, pbp3s, mray, murd, murg, ftsq and ftsagenes, mraw, yllc and ftsz partial genes.] [le:14488] [re:1799] [di:direct] |
| 33489812_c1_48 | 2348 | 6002 | 1164 | 387 | 1188 | 7.50E-121 | [acc:g69848] [pn:fructose phosphotransferase system enzyme homolog yjdd] [gn:yjdd] [or:bacillus subtilis] [db:pir] |
| 33492936_f2_10 | 2349 | 6003 | 306 | 101 | 64 | 0.7 | [acc:p54940] [gn:yxea:hs74a] [or:bacillus subtilis] [de:hypothetical 13.0 kd protein in idh-deor intergenic region precursor] [sp:pp54940] [db:swissprot] |
| 33495262_c1_19 | 2350 | 6004 | 1773 | 590 | 1061 | 2.20E-107 | [ln:cloabg] [acc:149336] [pn:pts-dependent enzyme ii] [gn:abgf] [fn:transmembrane transport of] [or:clostridium longisporum] [sr:clostridium longisporum (strain b6405) (clone: pbgl1) dna] [db:genpept-bct] [de:clostridium longisporum methyl-accepting chemot |
| 33595288_c3_39 | 2351 | 6005 | 249 | 82 | 63 | 0.36 | [acc:c69093] [pn:conserved hypothetical protein mth1692] [gn:mth1692] [or:methanobacterium thermoautotrophicum] [db:pir] |
| 33600253_c2_24 | 2352 | 6006 | 1602 | 533 | 725 | 2.00E-79 | [aca:a70022] [pn:multidrug-efflux transporter homolog yusp] [gn:yusp] [or:bacillus subtilis] [db:pir] |
| 33605083_c1_124 | 2353 | 6007 | 2211 | 736 | 1785 | 4.10E-184 | [ln:eftu09422] [acc:u09422] [or:enterococcus faecalis] [db:genpept-bct] [de:enterococcus faecalis ds16 transposon tn916, (tet(m)), (xis-tn), (int-tn) genes, orfs 1–24, complete cds, complete sequence.] [nt:orf15] [le:7643] [re:9907] [di:direct] |
| 33608337_c3_142 | 2354 | 6008 | 294 | 97 | 74 | 0.053 | [ln:apu96137] [acu96137] [or:anabaena pcc7120] [db:genpept-bct] [de:anabaena pcc7120 apceabc gene cluster, phycobilisome core-membranelinker protein (apce), allophycocyanin alpha subunit (apca),allophyceocyanin beta subunit (apcb) and phycobilisome core 1 |
| 33617192_c2_18 | 2355 | 6009 | 867 | 288 | 692 | 2.70E-68 | [acc:c69651] [pn:prolipoprotein diacylglyceryl transferase lgt] [gn:lgt] [or:bacillus subtilis] [db:pir] |
| 33632882_c2_4 | 2356 | 6010 | 1179 | 393 | 1172 | 3.70E-119 | [acc:666080:i40018] [pn:cell division protein tms26] [gn:tms26] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 3367005_c3_53 | 2357 | 6011 | 270 | 89 | 179 | 1.10E-13 | [acc:a69627] [pn:fructose 1-phosphate kinase frub] [gn:frub] [or:bacillus subtilis] [db:pir] |
| 33673317_c1_6 | 2358 | 6012 | 786 | 261 | 525 | 3.80E-66 | [acp:081188] [gn:manz;ptsm;gptb] [or:escherichia coli] [de:(eii-m-man)] [sp:p081188] [db:swissprot] |
| 33678557_f1_7 | 2359 | 6013 | 546 | 181 | 105 | 0.0019 | [acp:37198] [gn:nup62] [or:homo sapiens] [sr:,human] [de:nuclear pore glycoprotein p62 (nucleoporin p62)] [sp:p37198] [db:swissprot] |
| 33681660_f3_79 | 2360 | 6014 | 375 | 124 | 61 | 0.22 | [ln:ab001684] [ac:ab001684] [gn:tmv] [or:chloroplast chlorella vulgaris] [sr:chlorella vulgaris chloroplast dna] [db:genpept-pln] [de:chlorella vulgaris c-27 chloroplast dna, complete sequence.] [nt:orf67] [re:53481] [re:53684] [di:direct] |
| 33683327_c1_52 | 2361 | 6015 | 987 | 328 | 607 | 2.80E-59 | [acp:37517] [gn:vyag] [or:bacillus subtilis] [de:hypothetical transcriptional regulator in tetb-exoa intergenic region] [sp:p37517] [db:swissprot] |
| 3368837_c1_48 | 2362 | 6016 | 966 | 321 | 850 | 4.90E-85 | [acp:46469] [gn:ftsh:trna] [or:lactococcus lactis] [sr:subsplactis:streptococcus lactis] [ec:3.4.24.—] [de:cell division protein ftsh homolog.] [sp:p46469] [db:swissprot] |
| 3370462_c1_28 | 2363 | 6017 | 1440 | 479 | 1422 | 1.20E-145 | [ln:bsaraabd] [acc:x89408] [pn:1-arabinose isomerase] [gn:araa] [or:bacillus subtilis] [db:genpept-bct] [de:b.subtilis dna for araa, arab and arad genes.] [le:228] [re:1718] [di:direct] |
| 33710307_c3_16 | 2364 | 6018 | 1464 | 487 | 1813 | 4.40E-187 | [ln:af008553] [acc:af008553] [pn:glu-trnagln amidotransferase subunit b] [gn:gatb] [or:bacillus subtilis] [db:genpept-bct] [de:bacillus subtilis glu-trnagln amidotransferase subunits c (gatc), a (gata) and b (gatb) genes, complete cds.] [le:2185] [re:3615] |
| 33710333_c3_31 | 2365 | 6019 | 1044 | 347 | 81 | 0.011 | [acp:34859] [gn:nd41] [or:apis mellifera] [sr:,honeybee] [ec:1.6.5.3] [de:nadh-ubiquinone oxidoreductase chain 41,] [sp:p34859] [db:swissprot] |
| 33750955_c2_70 | 2366 | 6020 | 3660 | 1219 | 107 | 4.40E-05 | [acp:54509] [gn:yqhh] [or:bacillus subtilis] [de:hypothetical helicase in sini-gcvt intergenic region] [sp:p54509] [db:swissprot] |
| 33756517_f3_22 | 2367 | 6021 | 417 | 138 | 60 | 0.35 | [acp:21536] [gn:atp8] [or:schizosaccharomyces pombe] [sr:,fission yeast] [ec:3.6.1.34] [de:atp synthase protein 8. (a61)] [sp:p21536] [db:swissprot] |
| 33767l7_c3_49 | 2368 | 6022 | 297 | 98 | 87 | 0.002 | [acs:36779:s36780] [pn:ribosome-binding protein p34] [cl:leucine-rich alpha-2-glycoprotein repeat homology] [or:rattus norvegicus] [sr:,norway rat] [db:pir] |
| 33773427_f3_80 | 2369 | 6023 | 927 | 308 | 190 | 5.50E-13 | [acp:77672] [gn:ydey] [or:escherichia coli] [de:hypothetical abc transporter permease protein ydey] [sp:p77672] [db:swissprot] |
| 33776465_f1_2 | 2370 | 6024 | 231 | 77 | 192 | 1.50E-14 | [acq:47745] [gn:vansb] [or:enterococcus faecalis] [sr:,streptococcus faecalis] [ec:2.7.3.—] [de:protein vansb] (vancomycin histidine protein kinase)] [sp:q47745] [db:swissprot] |
| 33788280_c1_118 | 2371 | 6025 | 768 | 255 | 102 | 0.021 | [acp:75563] [gn:phet] [or:mycoplasma pneumoniae] [ec:6.1.1.20] [de:trna ligase beta chain) (phers)] [sp:p75563] [db:swissprot] |
| 33789187_c3_72 | 2372 | 6026 | 513 | 170 | 61 | 0.41 | [acq44148] [or:anabaena sp] [sr:pcc 7120,] [de:hypothetical 8.2 kd protein in nifx-nifw intergenic region (orf1)] [sp:q44148] [db:swissprot] |
| 33790813_c3_19 | 2373 | 6027 | 1125 | 374 | 1351 | 4.00E-138 | [acp:37572] [gn:rada:sms] [or:bacillus subtilis] [de:dna repair protein rada homolog (dna repair protein sms homolog)] [sp:p37572] [db:swissprot] |
| 33791088_c1_48 | 2374 | 6028 | 2031 | 676 | 244 | 8.40E-20 | [acp:32058] [gn:cmtb] [or:escherichia coli] [ec:2.7.1.69] [de:enzyme ii, a component),] [sp:p32058] [db:swissprot] |
| 33792553_c2_152 | 2375 | 6029 | 531 | 176 | 92 | 0.0082 | [aci:41076] [pn:methyltransferase m.ecohk31i beta chain] [or:escherichia coli] [db:pir] |
| 33798177_f2_22 | 2376 | 6030 | 855 | 284 | 767 | 3.10E-76 | [acc:69742] [pn:abc transporter (atp-binding protein) homolog ybae] [gn:ybae] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 33804712_c3_46 | 2377 | 6031 | 207 | 68 | 105 | 9.40E-06 | [ac:p36942] [gn:gpmb] [or:escherichia coli] [ec:5.4.2.1] [de:2) (pgam 2) (bpg-dependent pgam 2)] [sp:p36942] [db:swissprot] |
| 33828175_c2_24 | 2378 | 6032 | 222 | 73 | 62 | 0.068 | [ln:cet21b4] [acz81124] [pn:t21b4.8] [or:caenorhabditis elegans] [db:genpept-inv] [de:caenorhabditis elegans cosmid t21b4, complete sequence.] [nt:similar to 7tm receptor] [le:24866:25711:25952] [re:25339:25901:26294] [di:complementjoin] |
| 33828175_f1_12 | 2379 | 6033 | 1077 | 358 | 94 | 0.11 | [ac:p36044] [gn:ykl200c] [or:saccharomyces cerevisiae] [sr:baker's yeast] [de:hypothetical 46.9 kd protein in tor2-pas1 intergenic region] [sp:p36044] [db:swissprot] |
| 33828175_f3_21 | 2380 | 6034 | 216 | 71 | 54 | 0.67 | [ln:pbu42580] [acu42580:u17055:u32570] [gn:a3091] [or:paramecium bursaria chlorella virus 1] [db:genpept-vrl] [de:paramecium bursaria chlorella virus 1, complete genome.] [le:155062] [re:155298] [di:complement] |
| 33828175_f3_7 | 2381 | 6035 | 324 | 107 | 57 | 0.41 | [ac:i77320] [pn:nadh dehydrogenase subunit 5] [or:mitochondrion lemur catta] [sr:, ring-tailed lemur] [db:pir] |
| 33828450_c1_47 | 2382 | 6036 | 465 | 154 | 193 | 2.10E-15 | [ac:c69786] [pn:ribosomal-protein-alanine n-acetyltransfer homolog ydid] [gn:ydid] [or:bacillus subtilis] [db:pir] |
| 33829037_f1_18 | 2383 | 6037 | 1797 | 598 | 700 | 3.90E-69 | [ac:g98815] [pn:abc transporter (atp-binding protein) homolog ygad] [gn:ygad] [or:bacillus subtilis] [db:pir] |
| 33833442_c2_20 | 2384 | 6038 | 204 | 67 | 71 | 0.069 | [ln:u88974] [pn:orf9] [or:streptococcus thermophilus] [db:genpept-bct] [de:streptococcus thermophilus bacteriophage 01205 dna sequence.] [nt:contains a putative atp/gtp binding site between] [le:4086] [re:4787] [di:direct] |
| 33834555_c1_20 | 2385 | 6039 | 345 | 115 | 53 | 0.84 | [ln:hiv192610] [acz92610] [pn:gp120, c2/v3 region] [gn:env] [or:human immunodeficiency virus type 1] [db:genpept-vrl] [de:human immunodeficiency virus type 1 env gene (strain kr45-1).] [le:<1] [re: |
| 33835937_c3_58 | 2386 | 6040 | 1131 | 376 | 1441 | 1.20E-147 | [ac:p37518] [gn:yyaf] [or:bacillus subtilis] [de:region] [sp:p37518] [db:swissprot] |
| 33835961_f2_2 | 2387 | 6041 | 321 | 107 | 177 | 1.30E-13 | [ac:p96314] [gn:prfb] [or:bacillus firmus] [de:peptide chain release factor 2 (rf-2) (fragment)] [sp:p96314] [db:swissprot] |
| 33838290_c2_64 | 2388 | 6042 | 342 | 113 | 109 | 4.40E-06 | [ln:af016485] [ac:af016485] [or:halobacterium sp. nrc-1] [db:genpept-bct] [de:halobacterium sp. nrc-1 plasmid pnrc100, complete plasmid sequence.] [nt:orfh08O1] [le:72330] [re:73046] [di:complement] |
| 33844635_f2_4 | 2389 | 6043 | 213 | 71 | 75 | 0.24 | [ac:75142] [pn:sensory transduction histidine kinase;protein slr1759;protein slr1759] [or:synechocystis sp.] [sr:pcc 6803., pcc 6803] [sr:pcc 6803.] [db:pir] |
| 33859377_f3_5 | 2390 | 6044 | 195 | 64 | 55 | 0.19 | [ln:af003003] [ac:af003003] [pn:mal63-13p] [gn:mal63] [or:saccharomyces cerevisiae] [sr:baker's yeast] [db:genpept-pln] [de:saccharomyces cerevisiae mal63-13p (mal63) gene, allele mal63-13,complete cds.] [nt:transcription activator, nonfunctional mutant] |
| 33859818_c1_36 | 2391 | 6045 | 234 | 77 | 68 | 0.13 | [ac:q16763] [or:homo sapiens] [sr:,human] [ec:6.3.2.19] [de:protein ligase) (ubiquitin carrier protein) (e2-epf5)] [sp:q16763] [db:swissprot] |
| 33860142_c1_58 | 2392 | 6046 | 234 | 77 | 70 | 0.12 | [ln:hsp70g] [acx51758] [pn:heat shock protein 70b' (aa 355–643)] [or:homo sapiens] [sr:human] [db:genpept-pri1] [de:human mrna for heat shock protein hsp70b'.] [sp:p17066] [le:<1] [re:870] [di:direct] |
| 33860452_c3_154 | 2393 | 6047 | 2127 | 708 | 91 | 0.029 | [ln:cezk945] [acz48544] [pn:zk945.10] [or:caenorhabditis elegans] [db:genpept-inv] [de:caenorhabditis elegans cosmid zk945, complete sequence.] [nt:similar to mucin] [sp:q09625] [le:25174:25897:26027] [re:25742:25975:26658] [di:complementjoin] |

TABLE 2-continued

| Orf | NT Seq ID | AA Seq ID | NT Orf length | AA Orf length | Score | Probability | Description |
|---|---|---|---|---|---|---|---|
| 33861260_c2_48 | 2394 | 6048 | 225 | 74 | 50 | 0.33 | [ac:i40591] [pn:arginine--trna ligase,] [gn:args] [or:buchnera aphidicola] [ec:6.1.1.19] [db:pir] |
| 33867817_c1_92 | 2395 | 6049 | 1035 | 344 | 1068 | 3.90E-108 | [ac:f70019] [pn:nifs protein homolog homolog yurw] [gn:yurw] [or:bacillus subtilis] [db:pir] |
| 33870692_c3_39 | 2396 | 6050 | 999 | 332 | 916 | 5.00E-92 | [ac:h69979] [pn:proteinase homolog yrro] [gn:yrro] [or:bacillus subtilis] [db:pir] |
| 33870712_c2_17 | 2397 | 6051 | 222 | 73 | 68 | 0.23 | [ln:wsaj662] [ac:aj000662] [pn:purl protein] [gn:purl] [or:wolinella succinogenes] [db:genpept-bct] [de:wolinella succinogenes nifs, moea, frdc, frda, frdb, frdc2 and purlgenes; orf138 and orf125.] [nt:similar to various purl proteins (fgam synthase)] [le: |
| 33870936_c1_30 | 2398 | 6052 | 1170 | 390 | 480 | 8.00E-46 | [ac:p55340] [gn:ecsb:prst] [or:bacillus subtilis] [de:protein ecsb] [sp:p55340] [db:swissprot] |
| 33875010_f3_2 | 2399 | 6053 | 450 | 149 | 67 | 0.077 | [ac:q6995] [gn:rfap] [or:salmonella typhimurium] [de:lipopolysaccharide core biosynthesis protein rfap (fragment)] [sp:q06995] [db:swissprot] |
| 3392837_f1_1 | 2400 | 6054 | 1044 | 347 | 700 | 3.90E-69 | [ac:e69831] [pn:conserved hypothetical protein yhfp] [gn:yhfp] [or:bacillus subtilis] [db:pir] |
| 33984387_f1_6 | 2401 | 6055 | 306 | 101 | 83 | 0.029 | [ac:q60301] [gn:mjecs02] [or:methanococcus jannaschii] [de:hypothetical protein mjecs02] [sp:q60301] [db:swissprot] |
| 33984752_f1_3 | 2402 | 6056 | 189 | 62 | 46 | 0.26 | [ln:af004112] [ac:af004112] [pn:phospholipid methyltransferase] [gn:cho1+] [fn:catalyzes the last two methylation steps from] [or:schizosaccharomyces pombe] [sr:fission yeast] [db:genpept-pln] [de:schizosaccharomyces pombe phospholipid methyltransferase ( |
| 33992837_f2_23 | 2403 | 6057 | 807 | 268 | 67 | 0.22 | [ac:p32224] [gn:ce81] [or:swinepox virus] [sr:kasza,spv] [de:hypothetical protein c8] [sp:p32224] [db:swissprot] |
| 3401937_c2_64 | 2404 | 6058 | 1554 | 517 | 1635 | 3.20E-168 | [ac:p12048] [gn:purh:purh j] [or:bacillus subtilis] [sp:p12048] [db:swissprot] [de:(inosinicase) (imp synthetase) (atic)] |
| 34022188_f1_4 | 2405 | 6059 | 255 | 84 | 53 | 0.0038 | [ln:ysccox5b] [ac:m11140] [or:saccharomyces cerevisiae] [sr:yeast (s.cerevisiae)] [de:yeast (s.cerevisiae) cox5b gene encoding mitochondrial cytochrome coxidase subunit vb, partial cds.] [nt:cytochrome c oxidase subun |
| 34037937_c2_63 | 2406 | 6060 | 882 | 293 | 158 | 5.20E-09 | [ln:spu52008] [ac:u52008] [pn:mrp50] [gn:mrp50] [or:streptococcus pyogenes] [sr:streptococcus pyogenes strain=b514] [db:genpept-bct] [de:streptococcus pyogenes emm gene cluster, mrp50, emm50 and emn50genes, complete cds.] [nt:igg binding protein; allele: |
| 34062502_c2_38 | 2407 | 6061 | 516 | 171 | 74 | 0.74 | [ac:p95786] [gn:atph] [or:streptococcus mutans] [ec:3.6.1.34] [de:atp synthase delta chain, ] [sp:p95786] [db:swissprot] |
| 34062925_c2_43 | 2408 | 6062 | 204 | 67 | 98 | 0.00036 | [ac:h69626] [pn:pts fructose-specific enzyme iibc component frua] [gn:frua] [or:bacillus subtilis] [db:pir] |
| 34064067_c1_33 | 2409 | 6063 | 1332 | 443 | 1682 | 3.40E-173 | [ac:p39772] [gn:asns] [or:bacillus subtilis] [ec:6.1.1.22] [de:(asns)] [sp:p39772] [db:swissprot] |
| 34064087_c3_18 | 2410 | 6064 | 690 | 229 | 696 | 1.00E-68 | [ac:h65154:s47779] [pn:insertion element is150 hypothetical 33.3 kd protein (orfb)hypothetical protein o283] [gn:yi5b] [or:escherichia coli] [db:pir] |
| 34064653_c2_59 | 2411 | 6065 | 2376 | 791 | 1924 | 7.60E-199 | [ac:a69676] [pn:phenylalanyl-trna synthetase (beta subunit) phet] [gn:phet] [or:bacillus subtilis] [db:pir] |
| 34065626_c2_127 | 2412 | 6066 | 1233 | 410 | 387 | 5.70E-36 | [ac:a69774] [pn:integrase homolog ydcl] [gn:ydcl] [or:bacillus subtilis] [db:pir] |
| 34066078_f1_1 | 2413 | 6067 | 1605 | 534 | 830 | 6.50E-83 | [ac:o05519] [gn:ydif] [or:bacillus subtilis] [de:hypothetical abc transporter atp-binding protein ydif] [sp:o05519] [db:swissprot] |

TABLE 2-continued

| Orf | NT Seq ID | AA Seq ID | NT Orf length | AA Orf length | Score | Probability | Description |
|---|---|---|---|---|---|---|---|
| 34066302_f1_18 | 2414 | 6068 | 291 | 96 | 58 | 0.34 | [acq28072] [gn:cd3d] [or:bos taurus] [sr:bovine] [de:t3 delta chain) (fragment)] [sp:q28072] [db:swissprot] |
| 34067512_c2_50 | 2415 | 6069 | 291 | 96 | 69 | 0.028 | [acq56128] [gn:rcsc] [or:salmonella typhi] [ec:2.7.3.—] [de:component c) (fragment)] [sp:q56128] [db:swissprot] |
| 34070332_f3_28 | 2416 | 6070 | 618 | 205 | 748 | 3.20E-74 | [ac:b69601] [pn:atp-dependent clp proteinase proteolytic chain p (clpp)] [gn:clpp] [or:bacillus subtilis] [db:pir] |
| 34071008_f3_6 | 2417 | 6071 | 1149 | 382 | 1120 | 1.20E-113 | [ln:lsaj1330] [ac:aj001330] [pn:orf1] [gn:arc1] [fn:unknown] [or:lactobacillus sake] [db:genpept-bct] [de:lactobacillus sake dna encoding the arginine-deiminase pathway genes.] [nt:putative transaminase type i] [le:3571] [re:4686] [di:direct] |
| 34072807_f1_6 | 2418 | 6072 | 399 | 132 | 482 | 4.90E-46 | [ln:bacrplp] [ac:147971] [pn:ribosomal protein s13] [gn:rpsm] [or:bacillus subtilis] [db:genpept-bct] [de:bacillus subtilis ribosomal protein (rplpnxefroq, rpmcdj,rpsqnhemk) genes, integral membrane protein (secy) gene, adenylatekinase (adk) gene, methion |
| 34074027_c3_57 | 2419 | 6073 | 1257 | 418 | 834 | 2.40E-83 | [ln:spdnagpo] [ac:y11463] [or:streptococcus pneumoniae] [db:genpept-bct] [de:streptococcus pneumoniae dnag, rpod, cpoa genes and orf3 and orf5.] [nt:orf5] [le:3192] [re: |
| 3407812_f3_13 | 2420 | 6074 | 543 | 180 | 142 | 5.20E-10 | [ac:p46854] [gn:yhhy] [or:escherichia coli] [de:hypothetical 18.8 kd protein in gntr-ggt intergenic region (o162)] [sp:p46854] [db:swissprot] |
| 34094062_c3_29 | 2421 | 6075 | 1362 | 453 | 1014 | 2.10E-102 | [ln:lmrpongen] [ac:x93169] [pn:sigma-54 protein] [gn:rpon] [or:listeria monocytogenes] [db:genpept-bct] [de:l.monocytogenes rpon and orfd genes.] [le:1034] [re:2377] [di:direct] |
| 34101713_c2_52 | 2422 | 6076 | 663 | 220 | 641 | 6.90E-63 | [ac:b69879] [pn:ribulose-5-phosphate 3-epimerase homolog ylor] [gn:ylor] [or:bacillus subtilis] [db:pir] |
| 34110032_c3_160 | 2423 | 6077 | 1818 | 605 | 132 | 5.10E-11 | [ln:bsu18943] [ac:u18943;x99465] [gn:mtlr] [or:bacillus stearothermophilus] [db:genpept-bct] [de:bacillus stearothermophilus mannitol transport protein (mtla),putative transcriptional regulator (mtlr), mannitol enzyme iia(mtlf) and mannitol-1-phosphate de |
| 34111082_c2_37 | 2424 | 6078 | 651 | 216 | 875 | 1.10E-87 | [ac:q47748] [gn:vanhb] [or:enterococcus faecalis] [sr:,streptococcus faecalis] [ec:1.1.1.—] [de:b-type resistance protein vanhb)] [sp:q47748] [db:swissprot] |
| 34117967_f1_3 | 2425 | 6079 | 705 | 235 | 159 | 3.10E-10 | [ac:p54721] [gn:yyfic] [or:bacillus subtilis] [de:hypothetical 31.5 kd protein in glvbc 3'region] [sp:p54721] [db:swissprot] |
| 34117968_c1_91 | 2426 | 6080 | 1140 | 379 | 692 | 2.70E-68 | [ac:g70019] [pn:conserved hypothetical protein yurx] [gn:yurx] [or:bacillus subtilis] [db:pir] |
| 34118826_c1_88 | 2427 | 6081 | 327 | 108 | 59 | 0.28 | [ac:d60396] [pn:antigen 7h8/7] [cl:pol polyprotein] [or:plasmodium falciparum] [db:pir] |
| 34120463_c2_40 | 2428 | 6082 | 414 | 137 | 85 | 0.17 | [ac:pc6003] [pn:surface membrane protein lmp4;hypothetical 624 protein:lmp4 protein] [gn:lmp4] [or:mycoplasma hominis] [db:pir] |
| 34157517_c3_8 | 2429 | 6083 | 966 | 321 | 774 | 5.60E-77 | [ac:d69744] [pn:conserved hypothetical protein ybbi] [gn:ybbi] [or:bacillus subtilis] [db:pir] |
| 34160877_c1_81 | 2430 | 6084 | 1122 | 373 | 91 | 0.24 | [ac:q58128] [gn:mj0718] [or:methanococcus jannaschii] [de:hypothetical protein mj0718] [sp:q58128] [db:swissprot] |
| 34161330_c3_95 | 2431 | 6085 | 363 | 120 | 317 | 1.50E-28 | [ln:af029727] [ac:af029727] [pn:transposase] [or:enterococcus faecium] [db:genpept-bct] [de:enterococcus faecium insertion sequence is1485, complete sequence.] [nt:putative transposase] [le:76;330] [re:330;1238] [di:directjoin] |
| 34163577_c1_39 | 2432 | 6086 | 1770 | 589 | 1944 | 5.80E-201 | [ac:d69591] [pn:aspartyl-trna synthetase asps] [gn:asps] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 34164067_c3_72 | 2433 | 6087 | 183 | 60 | 67 | 0.088 | [ac:p42547] [or:bacteriophage 12] [de:hypothetical 17.2 kd protein (orf12)] [sp:p42547] [dbsswissprot] |
| 34164188_f3_34 | 2434 | 6088 | 843 | 280 | 374 | 1.40E-34 | [ln:laclacr] [acm35375] [or:lactococcus lactis] [sr:l.lactis (strain mg1820) dna dbgenpept-bct] [de:l.lactis lactose phosphotransferase system repressor (lacr) gene,complete cds.] [nt:lactose repressor (lacr; alt.)] [le:370] [re:1155] [di:direct] |
| 34165881_c1_5 | 2435 | 6089 | 198 | 65 | 59 | 0.28 | [ac:p08357] [gn:p10] [or:orgyia pseudotsugata multicapsid polyhedrosis virus] [sr:opmmpv] [dep10 protein (fibrous body protein)] [sp:p08357] [dbsswissprot] |
| 34166511_f3_36 | 2436 | 6090 | 1437 | 478 | 632 | 6.20E-62 | [ac:a69763] [pn:homoserine dehydrogenase homolog yclm] [gn:yclm] [or:bacillus subtilis] [db:pir] |
| 34167188_c1_31 | 2437 | 6091 | 699 | 232 | 562 | 1.60E-54 | [ac:q47746] [gn:vanyb] [or:enterococcus faecalis] [sr:streptococcus faecalis] [ec:3.4.16.4] [de:(dd-carboxypeptidase)] [sp:q47746] [dbsswissprot] |
| 34167876_c3_20 | 2438 | 6092 | 477 | 158 | 110 | 5.90E-06 | [ac:p76238] [gn:yeak] [or:escherichia coli] [de:hypothetical 17.9 kd protein in gapa-rnd intergenic region] [sp:p76238] [dbsswissprot] |
| 34172832_c1_136 | 2439 | 6093 | 216 | 71 | 100 | 5.20E-05 | [acs12722] [pn:probable transposase (insertion sequence is904)] [or:lactococcus lactis subsp. lactis] [db:pir] |
| 34173438_c2_46 | 2440 | 6094 | 1926 | 641 | 2312 | 5.90E-240 | [ac:p25812] [gn:gida] [or:bacillus subtilis] [de:glucose inhibited division protein a] [sp:p25812] [dbsswissprot] |
| 34173567_c1_21 | 2441 | 6095 | 270 | 89 | 70 | 0.12 | [ac:p47488] [gn:mg246] [or:mycoplasma genitalium] [de:hypothetical protein mg246] [sp:p47488] [dbsswissprot] |
| 34174075_f2_4 | 2442 | 6096 | 402 | 133 | 248 | 3.10E-21 | [ln:nmy14298] [acyl4298] [pn:lactoylglutathione lyase] [gn:gloa] [or:neisseria meningitidis] [db:genpept-bct] [ec:4.4.1.5] [de:neisseria meningitidis gloa gene.] [nt:subunit glyoxalase 1] [le:1] [re:417] [di:direct] |
| 34175252_c2_67 | 2443 | 6097 | 876 | 291 | 351 | 3.70E-32 | [acs68604:s45079] [pn:hypothetical protein delta] [or:streptococcus pyogenes] [db:pir] |
| 34175307_c2_67 | 2444 | 6098 | 303 | 100 | 69 | 0.012 | [ac:c69914] [pn:hypothetical protein yoni] [gn:yoni] [or:bacillus subtilis] [db:pir] |
| 34175307_c3_143 | 2445 | 6099 | 303 | 100 | 67 | 0.021 | [ac:c69914] [pn:hypothetical protein yoni] [gn:yoni] [or:bacillus subtilis] [db:pir] |
| 34175678_c2_71 | 2446 | 6100 | 201 | 66 | 67 | 0.15 | [ac:s08389] [pn:hypothetical protein a] [or:methanococcus vannielii] [db:pir] |
| 34177133_c1_60 | 2447 | 6101 | 2706 | 901 | 159 | 4.60E-08 | [ac:a45988] [pn:dentin matrix acidic phosphoprotein ag1] [or:rattus norvegicus] [sr:; norway rat] [db:pir] |
| 34177812_c2_37 | 2448 | 6102 | 1152 | 383 | 762 | 1.00E-75 | [ac:e70009] [pn:conserved hypothetical protein yufp] [gn:yufp] [or:bacillus subtilis] [db:pir] |
| 34177812_c3_155 | 2449 | 6103 | 393 | 130 | 53 | 0.92 | [ac:pq0817] [pn:expressed sequence tag t50] [cl:methionine adenosyltransferase] [or:brassica napus] [sr:, rape] [db:pir] |
| 34178175_f3_69 | 2450 | 6104 | 342 | 113 | 170 | 5.60E-13 | [ac:a69364] [pn:hypothetical protein af0913] [or:archaeoglobus fulgidus] [db:pir] |
| 34178266_f2_75 | 2451 | 6105 | 1437 | 478 | 1160 | 7.00E-118 | [ln:llmalac] [acx75982] [gn:mlep] [or:lactococcus lactis] [db:genpept-bct] [de:l.lactis (11441) mles & mlep genes.] [le:2104] [re:3381] [di:direct] |
| 34178377_c2_41 | 2452 | 6106 | 1359 | 452 | 93 | 0.21 | [ac:p39826] [gn:cdc3] [or:candida albicans] [sr:,yeast] [de:cell division control protein 3] [sp:p39826] [dbsswissprot] |
| 34178438_c2_126 | 2453 | 6107 | 792 | 263 | 512 | 3.20E-49 | [ac:h70066] [pn:capsular polysaccharide biosynthesis homolog ywqe] [gn:ywqe] [or:bacillus subtilis] [db:pir] |
| 34178441_c3_44 | 2454 | 6108 | 231 | 76 | 160 | 3.40E-11 | [ln:ab008120] [ac:ab008120] [pn:phosphopentomutase] [gn:ppm] [fn:phosphotransfer between the c1 and c5 carbon] [or:bacillus stearothermophilus] [sr:bacillus stearothermophilus dna dbgenpept-bct] [de:bacillus stearothermophilus gene for pho |

TABLE 2-continued

| Orf | NT Seq ID | AA Seq ID | NT Orf length | AA Orf length | Score | Probability | Description |
|---|---|---|---|---|---|---|---|
| 34178780_c1_45 | 2455 | 6109 | 192 | 63 | 75 | 0.048 | [ln:celk09f6] [ac:af016683] [gn:k09f6.1] [or:caenorhabditis elegans] [sr:caenorhabditis elegans strain=bristol n2] [db:genpept-inv] [de:caenorhabditis elegans cosmid k09f6.] [le:27413] [re:28468] [di:direct] |
| 34178787_f2_28 | 2456 | 6110 | 1797 | 598 | 1068 | 3.90E-108 | [ac:p54719] [gn:yfhc] [or:bacillus subtilis] [de:hypothetical abc transporter atp-binding protein 2 in glvbc 3'region] [sp:p54719] [db:swissprot] |
| 34178812_c2_70 | 2457 | 6111 | 456 | 151 | 61 | 0.34 | [ln:d78257] [ac:d78257] [pn:baca] [gn:baca] [or:enterococcus faecalis] [sr:enterococcus faecalis plasmid:pyi17 dna] [db:genpept-bct] [de:enterococcus faecalis plasmid pyi17 genes for baca, bacb, orf3, orf4, orf5, orf6, orf7, orf8, orf9, orf10, orf11, partia |
| 34179702_c1_41 | 2458 | 6112 | 1536 | 511 | 569 | 2.90E-55 | [ac:47677-s27678] [pn:hypothetical protein 11.45] [or:salmonella choleraesuis] [db:pir] |
| 34179702_c2_72 | 2459 | 6113 | 912 | 303 | 465 | 3.10E-44 | [ac:p14308] [gn:prtm] [or:lactococcus lactis] [sr:,subspcremoris: streptococcus cremoris] [de:protease maturation protein precursor] [sp:p14308] [db:swissprot] |
| 34179712_c2_31 | 2460 | 6114 | 1245 | 414 | 428 | 2.60E-40 | [ac:a69819] [pn:conserved hypothetical protein yhao] [gn:yhao] [or:bacillus subtilis] [db:pir] |
| 34179817_f1_13 | 2461 | 6115 | 1476 | 491 | 484 | 3.00E-46 | [ac:p37710] [or:enterococcus faecalis] [sr:streptococcus faecalis] [ec:3.5.1.28] [de:autolysin, (n-acetylmuramoyl-1-alanine amidase)] [sp:p37710] [db:swissprot] |
| 34180251_f3_19 | 2462 | 6116 | 231 | 76 | 116 | 5.30E-07 | [ln:sau83488] [ac:u83488] [or:streptococcus agalactiae] [db:genpept-bct] [de:streptococcus agalactiae plasmid pgb354, complete plasmid sequence.] [nt:orfb] [le:2643] [re:3296] [di:direct] |
| 34180312_f2_5 | 2463 | 6117 | 1419 | 472 | 1775 | 4.70E-183 | [ac:d69785] [pn:beta-glucosidase homolog ydhp] [gn:ydhp] [or:bacillus subtilis] [db:pir] |
| 34180380_c1_87 | 2464 | 6118 | 438 | 145 | 63 | 0.2 | [ln:dnu26684] [acu26684] [pn:unknown] [gn:orfe] [or:dichelobacter nodosus] [db:genpept-bct] [de:dichelobacter nodosus rna operon 23s ribosomal rna (rrl) gene,partial sequence, 5s ribosomal rna (rrf) gene, complete sequence, and (orfe) gene, partial cds.] |
| 34180443_c3_87 | 2465 | 6119 | 222 | 73 | 67 | 0.045 | [ac:p42543] [or:bacteriophage 12] [de:hypothetical 7.3 kd protein (orf8)] [sp:p42543] [db:swissprot] |
| 34181262_f2_6 | 2466 | 6120 | 213 | 70 | 68 | 0.21 | [ac:p54463] [gn:yqew] [or:bacillus subtilis] [de:hypothetical 33.4 kd protein in dnaj-rpsu interegenic region] [sp:p54463] [db:swissprot] |
| 34181528_c3_31 | 2467 | 6121 | 444 | 147 | 200 | 1.80E-15 | [ln:instranspo] [ac:1346675] [pn:transposase] [or:insertion sequence is1251] [sr:insertion sequence is1251 dna] [db:genpept-bct] [de:insertion sequence is1251 from enterococcus faecium transposasegene, complete cds.] [nt:putative] [le:128] [re:1417] [di:di |
| 34181661_c2_91 | 2468 | 6122 | 291 | 96 | 54 | 0.0049 | [ac:g64380] [pn:hypothetical protein m[0647] [or:methanococcus jannaschii] [db:pir] [mp:rev575510-575295] |
| 34182187_f3_94 | 2469 | 6123 | 975 | 324 | 709 | 4.30E-70 | [ac:h69984] [pn:conserved hypothetical protein ysgb] [gn:ysgb] [or:bacillus subtilis] [db:pir] |
| 34182687_f1_3 | 2470 | 6124 | 627 | 208 | 328 | 1.00E-29 | [ac:a69903] [pn:hypothetical protein yodd] [gn:yodd] [or:bacillus subtilis] [db:pir] |
| 34183130_c2_115 | 2471 | 6125 | 924 | 307 | 1056 | 7.30E-107 | [ac:p77716] [gn:ycjp] [or:escherichia coli] [de:hypothetical abc transporter permease protein ycjp] [sp:p77716] [db:swissprot] |
| 34183467_c1_50 | 2472 | 6126 | 3540 | 1179 | 1379 | 4.30E-141 | [ac:p23477] [gn:addb] [or:bacillus subtilis] [de:atp-dependent nuclease subunit b] [sp:p23477] [db:swissprot] |
| 34183467_f2_2 | 2473 | 6127 | 825 | 275 | 188 | 1.40E-12 | [ln:cdiiorf] [ac:x98606] [or:clostridium difficile] [db:genpept-bct] [de:difficile transposon group ii intron with potential codingregion.] [nt:potential coding region] [le:742] [re:2571] [di:direct] |

TABLE 2-continued

| Orf | NT Seq ID | AA Seq ID | NT Orf length | AA Orf length | Score | Probability | Description |
|---|---|---|---|---|---|---|---|
| 34187875_c3_57 | 2474 | 6128 | 462 | 153 | 352 | 2.90E-32 | [ac:c69742] [pn:conserved hypothetical protein yazc] [gn:yazc] [or:bacillus subtilis] [db:pir] |
| 34187880_c2_23 | 2475 | 6129 | 219 | 72 | 73 | 0.016 | [ln:cec16c2] [ac:z81036] [pn:c16c2.1] [or:caenorhabditis elegans] [db:genpept-inv] [de:caenorhabditis elegans cosmid c16c2, complete sequence.] [nt:similar to homeobox protein] [le:14319:14685:16003] [re:14462:14827:16162] [di:directjoin] |
| 34192183_c3_44 | 2476 | 6130 | 327 | 108 | 117 | 2.30E-07 | [ln:sorfs] [ac:z79691] [gn:yorfe] [fn:putative transcription regulator] [or:streptococcus pneumoniae] [db:genpept-bct] [de:s.pneumoniae yorf[a,b,c,d,e], ftsl, pbpx and regr genes.] [le:2388] [re:2582] [di:complement] |
| 34192187_c2_114 | 2477 | 6131 | 486 | 161 | 46 | 0.14 | [ac:c69915] [pn:hypothetical protein yonl] [gn:yonl] [or:bacillus subtilis] [db:pir] |
| 34192513_c3_148 | 2478 | 6132 | 366 | 121 | 93 | 8.10E-05 | [ln:b4porfsx] [ac:135061] [or:bacteriophage phi-41] [db:genpept-phg] [de:bacteriophage phi-41 orfs 11–12, complete cds's, orf 13, 5' end.] [nt:structural protein; orf13; putative] [le:3572] [re:3856] [di:direct] |
| 34194812_c3_25 | 2479 | 6133 | 2091 | 696 | 1060 | 2.80E-107 | [ac:h69724] [pn:dna topoisomerase iii topb] [gn:topb] [or:bacillus subtilis] [db:pir] |
| 34195285_f1_11 | 2480 | 6134 | 672 | 223 | 117 | 1.60E-07 | [ac:p44611] [gn:hi0282] [or:haemophilus influenzae] [de:hypothetical protein hi0282] [sp:p44611] [db:swissprot] |
| 34195750_c2_239 | 2481 | 6135 | 969 | 322 | 259 | 2.10E-22 | [ln:llpflmg13] [ac:aj000325] [pn:putative membrane protein] [gn:orfa] [or:lactococcus lactis] [db:genpept-bct] [de:lactococcus lactis pfl gene (strain mg1363).] [le:270] [re:1187] [di:direct] |
| 34195932_c1_125 | 2482 | 6136 | 858 | 285 | 179 | 1.90E-12 | [ac:q57883] [gn:mj0441] [or:methanococcus jannaschii] [de:hypothetical protein mj0441] [sp:q57883] [db:swissprot] |
| 34198275_c2_28 | 2483 | 6137 | 228 | 75 | 53 | 0.58 | [ln:hsu61981] [ac:u61981] [gn:hmsh3] [fn:putative mismatch repair/binding protein] [or:homo sapiens] [sr:human] [db:genpept-pri2] [de:human putative mismatch repair/binding protein hmsh3 (hmsh3) mrna, complete cds.] [nt:humdug; human divergent u |
| 34198887_c3_74 | 2484 | 6138 | 636 | 211 | 518 | 7.50E-50 | [ac:p12040] [gn:purn] [or:bacillus subtilis] [ec:2.1.2.2] [de:transformylase] (5'-phosphoribosylglycinamide transformylase)] [sp:p12040] [db:swissprot] |
| 34235931_f3_25 | 2485 | 6139 | 216 | 71 | 156 | 1.10E-10 | [ac:s63615:s55408] [pn:malf protein homolog cymf] [gn:cymf] [or:klebsiella oxytoca] [db:pir] |
| 34239632_f3_23 | 2486 | 6140 | 288 | 95 | 139 | 3.50E-09 | [ac:s53879] [pn:hypothetical protein 1] [or:lactococcus lactis subsp. lactis biovar diacetylactis] [db:pir] |
| 34240836_c1_83 | 2487 | 6141 | 834 | 277 | 415 | 6.10E-39 | [ln:ae001165] [ac:ae001165:ae000783] [pn:spermidine/putrescine abc transporter, permease] [gn:bb0641] [or:borrelia burgdorferi] [sr:lyme disease spirochete] [db:genpept-bct] [de:borrelia burgdorferi (section 51 of 70) of the complete genome.] [nt:similar |
| 34250012_f1_2 | 2488 | 6142 | 210 | 69 | 68 | 0.27 | [ac:q99500] [gn:edg3] [or:homo sapiens] [sr:,human] [de:probable g protein-coupled receptor edg-3] [sp:q99500] [db:swissprot] |
| 34250675_f3_55 | 2489 | 6143 | 723 | 240 | 516 | 1.20E-49 | [ln:lmu17284] [ac:u17284] [or:listeria monocytogenes] [db:genpept-bct] [de:listeria monocytogenes major sigma factor (rpod) gene, partial cds, and downstream orfa1 and orfa2 genes, complete cds.] [nt:orfa1; transposon insertion into orfa1 impairs] [le:130] |
| 34251712_c3_71 | 2490 | 6144 | 777 | 258 | 271 | 1.10E-23 | [ac:p34209:p77578] [or:escherichia coli] [de:hypothetical 29.7 kd protein in hrpa-alda intergenic region] [sp:p34209:p77578] [db:swissprot] |
| 34252327_c2_59 | 2491 | 6145 | 975 | 324 | 1226 | 7.10E-125 | [ln:lbathya] [ac:m19653] [or:lactobacillus casei] [sr:l.casei (strain mtx-resistant) dna, clone pkpts-1] [db:genpept-bct] [de:l.casei thymidylate synthase (thya) gene, complete cds, andbeta-galactosidase gene, 3' end.] [nt:thymidylate synthase (ec 2.1.1.4 |

TABLE 2-continued

| Orf | NT Seq ID | AA Seq ID | NT Orf length | AA Orf length | Score | Probability | Description |
|---|---|---|---|---|---|---|---|
| 34254037_c2_26 | 2492 | 6146 | 300 | 99 | 58 | 0.94 | [ln:hivu44075] [acu44075] [gn:rev] [or:human immunodeficiency virus type 1] [db:genpept-vrl] [de:human immunodeficiency virus type 1, patient 9002, clones 6 and 7,(rev) gene, partial cds.] [le:<1] [re:273] [di:direct] |
| 34257776_c1_16 | 2493 | 6147 | 339 | 112 | 279 | 1.60E-24 | [acp35881] [or:lactococcus lactis] [sr:subsplactis:streptococcus lactis] [de:transposase for insertion sequence element is905] [sp:p35881] [dbsswissprot] |
| 34257805_c1_19 | 2494 | 6148 | 1254 | 417 | 1537 | 7.80E-158 | [ln:lsa]1330] [acp:aj001330] [pn:arginine deiminase] [gn:arca] [or:lactobacillus sake] [db:genpept-bct] [de:lactobacillus sake dna encoding the arginine-deiminase pathwaygenes.] [le:240] [re:1469] [di:direct] |
| 34257813_c2_29 | 2495 | 6149 | 825 | 274 | 840 | 5.70E-84 | [acp37079] [gn:sord] [or:klebsiella pneumoniae] [ec:1.1.1.140] [de:phosphate dehydrogenase) (ketosephosphate reductase)] [sp:p37079] [dbsswissprot] |
| 34258337_c3_156 | 2496 | 6150 | 1047 | 348 | 328 | 1.00E-29 | [acq38135] [or:bacteriophage rl1] [ec:3.5.1.28] [de:n-acetylmuramoyl-l-alanine amidase,] [sp:q38135] [dbsswissprot] |
| 34258437_c3_147 | 2497 | 6151 | 1857 | 618 | 1446 | 3.40E-148 | [ln:sau73374] [acu73374] [pn:cap8d] [or:staphylococcus aureus] [db:genpept-bct] [de:staphylococcus aureus type 8 capsule genes, cap8a, cap8b, cap8c, cap8d, cap8e, cap8f, cap8g, cap8h, cap8i, cap8j, cap8k, cap8l, cap8m, cap8n, cap8o, cap8p, compl] |
| 34258468_c2_24 | 2498 | 6152 | 822 | 273 | 814 | 3.20E-81 | [acq58418] [gn:pstb,mj1012] [or:methanococcus jannaschii] [de:probable phosphate transport atp-binding protein pstb] [sp:q58418] [dbsswissprot] |
| 34259811_f1_1 | 2499 | 6153 | 378 | 125 | 148 | 1.20E-10 | [acd70004] [pn:hypothetical protein ytzb] [gn:ytzb] [or:bacillus subtilis] [db:pir] |
| 34260792_c1_17 | 2500 | 6154 | 870 | 289 | 1048 | 5.10E-106 | [acc69637] [pn:dna gyrase-like protein (subunit b) grlb] [gn:grlb] [or:bacillus subtilis] [db:pir] |
| 34261333_c2_78 | 2501 | 6155 | 267 | 88 | 194 | 1.60E-15 | [acb69779] [pn:conserved hypothetical protein ydep] [gn:ydep] [or:bacillus subtilis] [db:pir] |
| 34267013_c2_150 | 2502 | 6156 | 483 | 160 | 428 | 2.60E-40 | [acd69979] [pn:conserved hypothetical protein yrrk] [gn:yrrk] [or:bacillus subtilis] [db:pir] |
| 34272700_c3_35 | 2503 | 6157 | 294 | 97 | 54 | 0.67 | [ln:af007261] [ac:af007261] [pn:ribosomal protein 131] [gn:rpl31] [or:mitochondrion reclinomonas americana] [sr:reclinomonas americana] [db:genpept-inv] [de:reclinomonas americana mitochondrial dna, complete genome.] [le:66975] [re:67190] [di:direct] |
| 34273437_c1_18 | 2504 | 6158 | 1257 | 418 | 1046 | 8.40E-106 | [acp35881] [or:lactococcus lactis] [sr:subsplactis:streptococcus lactis] [de:transposase for insertion sequence element is905] [sp:p35881] [dbsswissprot] |
| 34273437_f3_17 | 2505 | 6159 | 1251 | 416 | 1031 | 3.30E-104 | [acp35881] [or:lactococcus lactis] [sr:subsplactis:streptococcus lactis] [de:transposase for insertion sequence element is905] [sp:p35881] [dbsswissprot] |
| 34274062_c1_194 | 2506 | 6160 | 1443 | 480 | 1403 | 1.20E-143 | [ln:af005098] [ac:af005098] [pn:gadc] [gn:gadc] [or:lactococcus lactis] [db:genpept-bct] [de:lactococcus lactis maseh ii (rmb) gene, partial cds, positiveregulator gadr (gadr), gadc (gadc) and glutamate decarboxylase(gadb) genes, complete cds.] [nt:puta |
| 34277077_f1_1 | 2507 | 6161 | 675 | 224 | 389 | 3.50E-36 | [ac:o06974] [gn:yvck] [or:bacillus subtilis] [de:hypothetical 34.7 kd protein in crh-trxb intergenic region] [sp:o06974] [dbsswissprot] |
| 34375280_f3_33 | 2508 | 6162 | 306 | 101 | 329 | 8.00E-30 | [ac:f69644] [pn:initiation factor if-1 infa] [gn:infa] [or:bacillus subtilis] [db:pir] |
| 34381382_c2_176 | 2509 | 6163 | 339 | 112 | 137 | 1.80E-09 | [ln:lacspan] [ac:d00696;d00695] [or:lactococcus lactis] [sr:l.lactis (strain nedo497) genomic dna] [db:genpept-bct] [de:l.lactis span gene encoding nisin and insertion sequence is904.] [nt:orf1] [le:128] [re:418] [di:direct] |
| 34385031_c1_59 | 2510 | 6164 | 201 | 66 | 55 | 0.31 | [acp44132] [gn:hi1236] [or:haemophilus influenzae] [de:hypothetical protein hi1236] [sp:p44132] [dbsswissprot] |

TABLE 2-continued

| Orf | NT Seq ID | AA Seq ID | NT Orf length | AA Orf length | Score | Probability | Description |
|---|---|---|---|---|---|---|---|
| 34385031_c2_13 | 2511 | 6165 | 201 | 66 | 55 | 0.31 | [ac:p44132] [gn:hi1236] [or:*haemophilus influenzae*] [de:hypothetical protein hi1236] [sp:p44132] [db:swissprot] |
| 34385031_f1_2 | 2512 | 6166 | 201 | 66 | 55 | 0.31 | [ac:p44132] [gn:hi1236] [or:*haemophilus influenzae*] [de:hypothetical protein hi1236] [sp:p44132] [db:swissprot] |
| 34385031_f3_39 | 2513 | 6167 | 201 | 66 | 55 | 0.31 | [ac:p44132] [gn:hi1236] [or:*haemophilus influenzae*] [de:hypothetical protein hi1236] [sp:p44132] [db:swissprot] |
| 34386287_c1_41 | 2514 | 6168 | 213 | 70 | 68 | 0.14 | [ln:ac001119] [ac:ae001119;ae000783] [pn:*b. burgdorferi* predicted coding region bb0066] [gn:bb0066] [or:*borrelia burgdorferi*] [sr:lyme disease spirochete] [db:genpept-bct] [de:*borrelia burgdorferi* (section 5 of 70) of the complete genome.] [nt:hypothetica |
| 34390905_f2_7 | 2515 | 6169 | 462 | 153 | 452 | 7.40E-43 | [ln:llu80412] [ac:u80412] [pn:gamma glutamyl phosphate reductase homolog] [gn:proa] [fn:putative involvement in proline metabolism] [or:*lactococcus lactis cremoris*] [db:genpept-bct] [de:*lactococcus lactis cremoris* gamma glutamyl phosphate reductasehomolog |
| 34394687_f3_27 | 2516 | 6170 | 198 | 65 | 49 | 0.32 | [ac:p13422] [or:*bacillus anthracis*] [de:hypothetical 21.6 kd protein in protective antigen 5'region] [sp:p13422] [db:swissprot] |
| 34410962_c2_146 | 2517 | 6171 | 1536 | 511 | 123 | 0.00018 | [ac:i40055] [pn:positive trans-activator of capsule synthesis] [gn:acpa] [or:*bacillus anthracis*] [db:pir] |
| 34413912_c2_237 | 2518 | 6172 | 924 | 307 | 611 | 1.00E-59 | [ac:p25148] [gn:gspa:ipa-12d] [or:*bacillus subtilis*] [de:general stress protein a] [sp:p25148] [db:swissprot] |
| 34414057_c3_151 | 2519 | 6173 | 1158 | 385 | 118 | 0.00028 | [ln:ae001150] [ac:ae001150;ae000783] [pn:lipopolysaccharide biosynthesis-related protein] [gn:bb0454] [or:*borrelia burgdorferi*] [sr:lyme disease spirochete] [db:genpept-bct] [de:*borrelia burgdorferi* (section 36 of 70) of the complete genome.] [nt:similar |
| 34414090_c1_60 | 2520 | 6174 | 462 | 153 | 164 | 8.40E-16 | [ln:llbphigle] [ac:x98106] [gn:rorf172] [or:bacteriophage phigle] [db:genpept-phg] [de:lactobacillus bacteriophage phigle complete genomic dna.] [le:29618] [re:30136] [di:complement] |
| 34414628_c1_22 | 2521 | 6175 | 1404 | 467 | 104 | 0.013 | [ln:scy14206] [acy14206] [gn:sfr] [or:*streptomyces coelicolor*] [db:genpept-bct] [de:*streptomyces coelicolor* a3(2) mreb, mrec, mred, pbp, sfr genes andorf.] [le:5524] [re:6642] [di:direct] |
| 34416665_f2_14 | 2522 | 6176 | 492 | 163 | 127 | 2.00E-08 | [ac:p76238] [gn:yeak] [or:*escherichia coli*] [de:hypothetical 17.9 kd protein in gapa-rnd intergenic region] [sp:p76238] [db:swissprot] |
| 34421880_c1_12 | 2523 | 6177 | 996 | 331 | 402 | 1.50E-37 | [ln:af039391] [ac:af039391] [pn:mu-crystallin] [gn:crym] [or:*mus musculus*] [sr:house mouse] [db:genpept-rod] [de:*mus musculus* mu-crystallin (crym) mrna, complete cds.] [nt:similar to ornithine cyclodeaminase] [le:65] [re:1006] [di:direct] |
| 34424163_f2_25 | 2524 | 6178 | 219 | 72 | 60 | 0.36 | [ac:q06055] [gn:atp5g2] [or:*homo sapiens*] [sr:human] [ec:3.6.1.34] [de:9) (subunit c)] [sp:q06055] [db:swissprot] |
| 34425463_f1_14 | 2525 | 6179 | 270 | 89 | 47 | 1 | [ac:s68093] [pn:2-dehydro-3-deoxyphosphoheptonate aldolase, aro4:3-deoxy-d-arabinoheptulosonate-7-phosphate synthase] [gn:aro4] [cl:phospho-2-dehydro-3-deoxyheptonate aldolase] [or:*candida albicans*] [ec:4.1.2.15] [db:pir] |
| 34429655_f1_2 | 2526 | 6180 | 228 | 75 | 297 | 2.00E-26 | [ac:p27452] [gn:xis] [or:*streptococcus pneumoniae*] [de:excisionase] [sp:p27452] [db:swissprot] |
| 34432800_c1_40 | 2527 | 6181 | 984 | 327 | 472 | 5.60E-45 | [ln:spcps14e] [ac:x85787] [pn:ss-1,4-galactosyltransferase] [gn:cps14] [fn:capsular polysaccharide synthesis] [or:*streptococcus pneumoniae*] [db:genpept-bct] [de:*s.pneumoniae* cps14 locus.] [le:9524] [re:10480] [di:direct] |

TABLE 2-continued

| Orf | NT Seq ID | AA Seq ID | NT Orf length | AA Orf length | Score | Probability | Description |
|---|---|---|---|---|---|---|---|
| 34459816_c2_64 | 2528 | 6182 | 351 | 116 | 81 | 0.12 | [acq03332] [gn:n] [or:rinderpest virus] [sr:rbok,rdv] [de:nucleocapsid protein] [sp:q03332] [dbsswissprot] |
| 34492081_c1_188 | 2529 | 6183 | 186 | 61 | 81 | 0.018 | [ln:mmu25739] [acu25739] [pn:yspl-1 form 2] [gn:yspl-1] [or:mus musculus] [sr:house mouse] [db:genpept-rod] [de:mus musculus yolk sac permease-like molecule 1 (yspl-1) mrna,complete cds.] [nt:description: yolk sac permease-like molecule 1 form] [le:366] |
| 34500427_c2_130 | 2530 | 6184 | 1599 | 532 | 463 | 5.00E-44 | [acj:h0206] [pn:hypothetical 57.4k protein] [or:enterococcus faecalis] [db:pir] |
| 34507711_f1_3 | 2531 | 6185 | 1170 | 389 | 1065 | 8.10E-108 | [acc:e69820] [pn:conserved hypothetical protein yhba] [gn:yhba] [or:bacillus subtilis] [db:pir] |
| 34511067_f2_12 | 2532 | 6186 | 1404 | 467 | 798 | 1.60E-79 | [acg70015] [pn:conserved hypothetical protein yund] [gn:yund] [or:bacillus subtilis] [db:pir] |
| 34548162_f1_22 | 2533 | 6187 | 264 | 87 | 48 | 0.99 | [acs:74359] [pn:hypothetical protein ssr01091] [or:synechocystis sp.] [sr:pcc 6803, , pcc 6803] [sr:pcc 6803,] [db:pir] |
| 34562627_c1_32 | 2534 | 6188 | 1380 | 459 | 1473 | 4.70E-151 | [acq56115] [gn:pepc] [or:streptococcus thermophilus] [ec:3.4.22.—] [de:aminopeptidase c.] [sp:q56115] [dbsswissprot] |
| 34562827_c1_61 | 2535 | 6189 | 651 | 216 | 103 | 0.0011 | [ln:humhnm] [acc:d11393] [pn:human non-muscle myosin heavy chain] [or:homo sapiens] [sr:homo sapiens fetus cdna to mrna, clone:hmyhnm] [db:genpept-pri2] [de:human mrna for non-muscle myosin heavy chain.] [le:92] [re: |
| 34563937_f2_16 | 2536 | 6190 | 198 | 65 | 65 | 0.073 | [acp:19287] [or:thermoproteus tenax virus 1] [sr:kra1,ttv1] [de:hypothetical 9.4 kd protein] [sp:p19287] [dbsswissprot] |
| 34564202_c3_73 | 2537 | 6191 | 348 | 115 | 173 | 2.70E-13 | [acp37542] [gn:yaba] [or:bacillus subtilis] [de:hypothetical 14.1 kd protein in xpac-abrb intergenic region] [sp:p37542] [dbsswissprot] |
| 34564687_f1_4 | 2538 | 6192 | 2199 | 732 | 2982 | 0 | [acp05425] [acc:copb] [or:enterococcus faecalis] [sr:,streptococcus faecalis] [ec:3.6.1.36] [de:potassium/copper-transporting atpase b.] [sp:p05425] [dbsswissprot] |
| 34567887_f1_4 | 2539 | 6193 | 213 | 70 | 68 | 0.22 | [acf64592] [pn:hypothetical protein hp0582] [or:helicobacter pylori] [db:pir] |
| 34570888_c2_78 | 2540 | 6194 | 714 | 237 | 276 | 3.30E-24 | [acc69991] [pn:conserved hypothetical protein yteu] [gn:yteu] [or:bacillus subtilis] [db:pir] |
| 34571062_c1_41 | 2541 | 6195 | 624 | 207 | 224 | 1.10E-18 | [acp31465] [gn:yief] [or:escherichia coli] [de:hypothetical 20.4 kd protein in tnab-bglb intergenic region] [sp:p31465] [dbsswissprot] |
| 34571062_f3_82 | 2542 | 6196 | 1227 | 408 | 153 | 6.70E-09 | [acp77601] [gn:ykga] [or:escherichia coli] [de:hypothetical transcriptional regulator in each-beta intergenic region] [sp:p77601] [dbsswissprot] |
| 34572215_c1_25 | 2543 | 6197 | 504 | 167 | 192 | 2.60E-15 | [ln:af038816] [acc:af038816;u82331] [pn:putative rhamnosyl transferase] [gn:wbbl] [or:serratia marcescens] [db:genpept-bct] [de:serratia marcescens putative dtdp-4-dehydrorhamnose 3,5 epimerase(mlc), putative dtdp-1-rhamnose synthase (rmld), putativerhamm |
| 34573441_c1_29 | 2544 | 6198 | 1227 | 408 | 1047 | 6.60E-106 | [ln:atu91632] [acu91632] [pn:membrane-spanning permease] [gn:ggub] [or:agrobacterium tumefaciens] [db:genpept-bct] [de:agrobacterium tumefaciens sugar transporter (ggua),membrane-spanning permease (ggub), and (gguc) genes, complete cds.] [le:1628] [re:28 |
| 34573461_f1_2 | 2545 | 6199 | 681 | 226 | 102 | 0.0037 | [ln:liinlc] [acy076639] [gn:orf z] [fn:putative transcriptional repressor] [or:listeria ivanovii] [db:genpept] [de:l.ivanovii 23s rrna, 5s rrna, trna-asn, trna-thr, orf z, inld, andinlc genes.] [nt:shows signature of helix-turn-helix from tetr] [le:4383] |
| 34574062_c1_28 | 2546 | 6200 | 828 | 275 | 1069 | 3.10E-108 | [acq59812] [gn:glna] [or:staphylococcus aureus] [ec:6.3.1.2] [de:glutamine synthetase, (glutamate–ammonia ligase) (gs)] [sp:q59812] [dbsswissprot] |

TABLE 2-continued

| Orf | NT Seq ID | AA Seq ID | NT Orf length | AA Orf length | Score | Probability | Description |
|---|---|---|---|---|---|---|---|
| 34574092_f1_5 | 2547 | 6201 | 2025 | 674 | 2288 | 2.00E-237 | [ac:p37465] [gn:metrs] [or:bacillus subtilis] [ec:6.1.1.10] [de:(metrs)] [sp:p37465] [db:swissprot] |
| 34579057_c1_30 | 2548 | 6202 | 1320 | 439 | 601 | 1.20E-58 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_c2_136 | 2549 | 6203 | 249 | 82 | 72 | 0.13 | [ln:lah222725] [ac:aj222725] [pn:hypothetical protein] [gn:orf-425] [fn:unknown] [or:lactobacillus helveticus] [db:genpept-bct] [de:lactobacillus helveticus plasmid plh1 complete sequence, strainatcc15009.] [le:6628] [re:7905] [di:complement] |
| 34579057_c2_58 | 2550 | 6204 | 1320 | 439 | 603 | 7.40E-59 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_c3_79 | 2551 | 6205 | 1320 | 439 | 603 | 7.40E-59 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_f1_1 | 2552 | 6206 | 1320 | 439 | 603 | 7.40E-59 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_f2_17 | 2553 | 6207 | 1320 | 439 | 598 | 2.50E-58 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_f2_4 | 2554 | 6208 | 246 | 81 | 62 | 0.31 | [ac:p21973] [gn:fp18] [or:fowlpox virus] [sr:fp-1,] [de:hypothetical 18.0 kd protein] [sp:p21973] [db:swissprot] |
| 34579057_f3_30 | 2555 | 6209 | 1320 | 439 | 598 | 2.50E-58 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34579057_f3_79 | 2556 | 6210 | 1320 | 439 | 603 | 7.40E-59 | [ln:efu63997] [ac:u63997] [or:enterococcus faecium] [db:genpept-bct] [de:enterococcus faecium insertion sequence is1476 putative transposasegene, complete cds.] [nt:putative transposase] [1e:140] [re:1414] [di:direct] |
| 34581326_c2_32 | 2557 | 6211 | 822 | 273 | 416 | 4.80E-39 | [ac:c69862] [pn:conserved hypothetical protein ykra] [gn:ykra] [or:bacillus subtilis] [db:pir] |
| 34585438_c3_14 | 2558 | 6212 | 1026 | 341 | 857 | 8.90E-86 | [ac:p50980] [gn:oppd] [or:lactococcus lactis] [sr:,subspcremoris: streptococcus cremoris] [de:oligopeptide transport atp-binding protein oppd] [sp:p50980] [db:swissprot] |
| 34585925_f3_40 | 2559 | 6213 | 342 | 113 | 363 | 2.00E-33 | [ac:p33382] [or:listeria monocytogenes] [de:hypothetical 12.0 kd protein in plcb-ldh intergenic region (orfb)] [sp:p33382] [db:swissprot] |
| 34586528_c3_35 | 2560 | 6214 | 1548 | 515 | 1527 | 9.00E-157 | [ln:atu91632] [ac:u91632] [pn:sugar transporter] [gn:ggua] [or:agrobacterium tumefaciens] [db:genpept-bct] [de:agrobacterium tumefaciens sugar transporter (ggua), membrane-spanning permease (ggub), and (gguc) genes, complete cds.] [nt:atp-binding protein] |
| 34589052_f3_3 | 2561 | 6215 | 960 | 319 | 311 | 6.40E-28 | [ln:ab005215] [ac:ab005215] [pn:301aa long hypothetical abba] [gn:phaa019] [or:pyrococcus horikoshii] [sr:pyrococcus horikoshii (strain:ot3) dna, clone:aa] [db:genpept-bct] [de:pyrococcus horikoshii ot3 phaa001–phaa055 genes, complete cds.] [nt:similar to |
| 34589063_c1_46 | 2562 | 6216 | 1254 | 417 | 1112 | 8.50E-113 | [ac:g69842] [pn:3-oxoacyl-acyl-carrier protein synthase homolog yjay] [gn:yjay] [or:bacillus subtilis] [db:pir] |
| 34589063_f2_33 | 2563 | 6217 | 1569 | 522 | 92 | 0.24 | [ac:s75177] [pn:hypothetical protein slr2034] [or:synechocystis sp.] [sr:pcc 6803, , pcc 6803] [db:pir] |

TABLE 2-continued

| Orf | NT Seq ID | AA Seq ID | NT Orf length | AA Orf length | Score | Probability | Description |
|---|---|---|---|---|---|---|---|
| 34589212_c2_75 | 2564 | 6218 | 2217 | 738 | 744 | 4.40E-90 | [acc:69990] [pn:transcriptional regulator (arac/xyls famil) homolog ytdp] [gn:ytdp] [or:bacillus subtilis] [db:pir] |
| 34589553_c3_39 | 2565 | 6219 | 939 | 312 | 421 | 1.40E-39 | [acc:69808] [pn:transporter homolog ytkh] [gn:ytkh] [or:bacillus subtilis] [db:pir] |
| 34617202_c1_92 | 2566 | 6220 | 3675 | 1224 | 4770 | 0 | [acc:p37871:p70978] [gn:rpoc:lpm:std] [or:bacillus subtilis] [ec:2.7.7.6] [de:beta' chain] (rna polymerase beta' subunit)] [sp:p37871:p70978] [db:swissprot] |
| 34617207_c1_39 | 2567 | 6221 | 723 | 240 | 405 | 7.10E-38 | [acc:d69983] [pn:conserved hypothetical protein ysbb] [gn:ysbb] [or:bacillus subtilis] [db:pir] |
| 34617842_f1_3 | 2568 | 6222 | 1017 | 338 | 761 | 1.30E-75 | [acc:q04797] [gn:asd] [or:bacillus subtilis] [ec:1.2.1.11] [de:dehydrogenase)] [sp:q04797] [db:swissprot] |
| 34620317_c3_156 | 2569 | 6223 | 2382 | 793 | 879 | 2.10E-92 | [acc:s68603:s45077:s45078] [pn:hypothetical protein gamma] [gn:gamma] [or:streptococcus pyogenes] [db:pir] |
| 34626877_c1_68 | 2570 | 6224 | 813 | 270 | 761 | 1.30E-75 | [acc:d69763] [pn:ferrichrome abc transporter (atp-binding p) homolog yclp] [gn:yclp] [or:bacillus subtilis] [db:pir] |
| 34628932_c2_8 | 2571 | 6225 | 210 | 69 | 61 | 0.28 | [acc:a05215] [pn:hypothetical protein 138] [or:chloroplast nicotiana tabacum] [sr:common tobacco] [db:pir] |
| 34633413_c1_35 | 2572 | 6226 | 273 | 90 | 73 | 0.097 | [acp:42726] [gn:tfxd] [or:rhizobium leguminosarum] [sr:biovar trifolii] [de:trifolitoxin processing protein tfxd] [sp:p42726] [db:swissprot] |
| 34640906_f3_15 | 2573 | 6227 | 2616 | 871 | 2501 | 5.50E-260 | [acq:24803:q27649] [gn:adh2] [or:entamoeba histolytica] [ec:1.1.1.1:1.2.1.10] [de:dehydrogenase, (acdh)] [sp:q24803:q27649] [db:swissprot] |
| 34641436_c2_9 | 2574 | 6228 | 534 | 177 | 661 | 5.30E-65 | [acb:69587] [pn:adenine phosphoribosyltransferase apt] [gn:apt] [or:bacillus subtilis] [db:pir] |
| 34641878_c3_279 | 2575 | 6229 | 585 | 194 | 65 | 0.21 | [acc:69748] [pn:hypothetical protein ybef] [gn:ybef] [or:bacillus subtilis] [db:pir] |
| 34642188_f1_6 | 2576 | 6230 | 867 | 288 | 703 | 1.90E-69 | [acp:32169] [gn:rhad] [or:escherichia coli] [ec:4.1.2.19] [de:rhamnulose-1-phosphate aldolase,] [sp:p32169] [db:swissprot] |
| 34645253_f3_31 | 2577 | 6231 | 996 | 331 | 690 | 4.40E-68 | [acc:69855] [pn:abc transporter (binding protein) homolog ykca] [gn:ykca] [or:bacillus subtilis] [db:pir] |
| 34645412_c2_21 | 2578 | 6232 | 717 | 238 | 225 | 8.40E-19 | [acp:40780] [gn:ytxh] [or:bacillus subtilis] [de:hypothetical 16.7 kd protein in murc-aroa intergenic region (orf2)] [sp:p40780] [db:swissprot] |
| 34646938_c2_35 | 2579 | 6233 | 1050 | 349 | 1583 | 1.00E-162 | [acp:95780] [gn:rmlb] [or:streptococcus mutans] [ec:4.2.1.46] [de:ddp-glucose 4,6-dehydratase,] [sp:p95780] [db:swissprot] |
| 34647125_f3_31 | 2580 | 6234 | 552 | 183 | 763 | 8.20E-76 | [hn:lpu63827] [acc:u63827] [pnp-coumaric acid decarboxylase] [gn:pdc] [fn:catalyzes biotransformation of p-coumaric acid] [or:lactobacillus plantarum] [db:genpept-bct] [de:lactobacillus plantarum p-coumaric acid decarboxylase (pdc) gene, complete cds.] [nt |
| 34647787_c2_35 | 2581 | 6235 | 222 | 73 | 301 | 7.40E-27 | [acc:q48770] [gn:csplacspl] [or:listeria monocytogenes] [de:cold shock-like protein cspla (cspl)] [sp:q48770] [db:swissprot] |
| 34647787_c3_19 | 2582 | 6236 | 1692 | 564 | 1712 | 2.20E-176 | [ac:f70033] [pn:glucan 1,4-alpha-maltohydrolase homolog yvdf] [gn:yvdf] [or:bacillus subtilis] [db:pir] |
| 34647787_c3_36 | 2583 | 6237 | 1692 | 564 | 1712 | 2.20E-176 | [ac:f70033] [pn:glucan 1,4-alpha-maltohydrolase homolog yvdf] [gn:yvdf] [or:bacillus subtilis] [db:pir] |
| 34648262_f3_22 | 2584 | 6238 | 1275 | 424 | 1356 | 1.20E-138 | [acb:48649:s36640] [pn:1-rhamnose isomerase,] [or:escherichia coli] [ec:5.3.1.14] [db:pir] |
| 34648313_c2_13 | 2585 | 6239 | 873 | 290 | 568 | 3.80E-55 | [acq:58484] [gn:aroe:mj1084] [or:methanococcus jannaschii] [ec:1.1.1.25] [de:shikimate 5-dehydrogenase,] [sp:q58484] [db:swissprot] |
| 34648387_c2_23 | 2586 | 6240 | 243 | 81 | 206 | 8.60E-17 | [acg:69766] [pn:conserved hypothetical protein yexe] [gn:yexe] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 34648425_c2_32 | 2587 | 6241 | 918 | 305 | 1135 | 3.10E-115 | [ln:ab003804] [ac:ab003804] [pn:gtp-binding protein] [gn:sgg] [or:streptococcus gordonii] [sr:streptococcus gordonii (strain:challis) dna] [db:genpept-bct] [de:streptococcus gordonii gene for gtp-binding protein, complete cds.] [le:61] [re:960] [di:direct] |
| 34648425_c3_33 | 2588 | 6242 | 429 | 142 | 384 | 1.20E-35 | [ac:d69843] [pn:conserved hypothetical protein yjbd] [gn:yjbd] [or:bacillus subtilis] [db:pir] |
| 34648442_f1_1 | 2589 | 6243 | 1440 | 479 | 1058 | 4.50E-107 | [ac:h69626] [pn:pts fructose-specific enzyme iibc component frua] [gn:frua] [or:bacillus subtilis] [db:pir] |
| 34648457_f3_16 | 2590 | 6244 | 729 | 242 | 399 | 3.00E-37 | [ac:f70011] [pn:hypothetical protein yugp] [gn:yugp] [or:bacillus subtilis] [db:pir] |
| 34649061_c3_58 | 2591 | 6245 | 240 | 79 | 72 | 0.054 | [ln:ae001133] [ac:ae001133:ae000783] [pn:b. burgdorferi predicted coding region bb0227] [gn:bb0227] [or:borrelia burgdorferi] [sr:lyme disease spirochete] [db:genpept-bct] [de:borrelia burgdorferi (section 19 of 70) of the complete genome.] [nt:hypothetic |
| 34651428_c2_71 | 2592 | 6246 | 933 | 310 | 611 | 1.00E-59 | [ac:g69796] [pn:lactose permease homolog yesp] [gn:yesp] [or:bacillus subtilis] [db:pir] |
| 34651551_c3_54 | 2593 | 6247 | 312 | 103 | 55 | 0.58 | [ac:pq0533] [pn:beta-ketoacyl-acp synthase] [or:rhodococcus sp.] [db:pir] |
| 34651562_c1_48 | 2594 | 6248 | 2154 | 717 | 511 | 2.10E-66 | [ac:h70040] [pn:hypothetical protein yvgs] [gn:yvgs] [or:bacillus subtilis] [db:pir] |
| 34651653_c1_8 | 2595 | 6249 | 1047 | 348 | 594 | 6.60E-58 | [ln:ssk3meca1] [acy13052] [gn:orf454] [or:staphylococcus sciuri] [db:genpept-bct] [de:s.sciuri mecal gene, strain k3(mm2).] [le:4208] [re:5572] [di:direct] |
| 34652137_c1_46 | 2596 | 6250 | 654 | 217 | 92 | 0.034 | [ac:a69428] [pn:glycerol uptake facilitator, mip channel (glpf) homolog] [or:archaeoglobus fulgidus] [db:pir] |
| 34652187_c3_188 | 2597 | 6251 | 867 | 288 | 208 | 5.30E-17 | [ac:s42060] [pn:hypothetical protein 1] [or:streptococcus thermophilus] [db:pir] |
| 34656686_c3_63 | 2598 | 6252 | 888 | 295 | 202 | 6.00E-16 | [ac:q00753] [gn:msm] [or:streptococcus mutans] [de:msm operon regulatory protein] [sp:q00753] [db:swissprot] |
| 34662541_c3_61 | 2599 | 6253 | 1227 | 408 | 1238 | 3.80E-126 | [ac:p46469] [gn:ftsh] [or:lactococcus lactis] [sr:subsplactis: streptococcus lactis] [ec:3.4.24.—] [de:cell division protein ftsh homolog.] [sp:p46469] [db:swissprot] |
| 34662837_c1_68 | 2600 | 6254 | 1329 | 442 | 242 | 4.50E-20 | [ln:atorf06] [ac:x97828] [pn:polygalacturonase precursor homologue] [or:arabidopsis thaliana] [sr:thale cress] [db:genpept-pln] [de:a.thaliana mrna (orf06) from chromosome iii.] [nt:swiss-prot:p35336] [le:<1] [re: |
| 34664012_c2_105 | 2601 | 6255 | 498 | 165 | 193 | 2.10E-15 | [ac:p36922] [or:enterococcus faecalis] [sr:streptococcus faecalis] [de:ebsc protein] [sp:p36922] [db:swissprot] |
| 34667767_c3_84 | 2602 | 6256 | 417 | 138 | 294 | 4.10E-26 | [ac:p51835] [gn:ftsy:srb] [or:bacillus subtilis] [de:cell division protein ftsy homolog] [sp:p51835] [db:swissprot] |
| 35081_c2_12 | 2603 | 6257 | 216 | 71 | 54 | 0.093 | [ln:ggsnail1p] [acy09905] [pn:snail like protein] [or:gallus gallus] [sr:chicken] [db:genpept-vrt] [de:g.gallus mrna for snail like protein.] [le:19] [re:789] [di:direct] |
| 35156887_f1_4 | 2604 | 6258 | 372 | 123 | 278 | 9.50E-24 | [ac:s60782] [pn:transposase] [or:bacillus thuringiensis] [db:pir] |
| 35158388_c1_14 | 2605 | 6259 | 354 | 117 | 334 | 2.40E-30 | [ac:p42979] [ac:ypjd:ojd] [or:bacillus subtilis] [de:hypothetical 13.0 kd protein in qcrc-dapb intergenic region] [sp:p42979] [db:swissprot] |
| 35164037_f3_35 | 2606 | 6260 | 270 | 89 | 65 | 0.41 | [ln:pcu09263] [ac:u09263] [pn:cytochrome b] [or:mitochondrion piaya cayana] [sr:squirrel cuckoo] [db:genpept-vrt] [de:piaya cayana mitochondrion cytochrome b gene, partial cds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 35165812_c3_42 | 2607 | 6261 | 1143 | 380 | 615 | 3.90E-60 | [acc:q06240] [gn:vans] [or:*enterococcus faecium*] [sr:*streptococcus faecium*] [ec:2.7.3.—] [de:(vancomycin histidine protein kinase)] [sp:q06240] [db:swissprot] |
| 35167257_f3_8 | 2608 | 6262 | 957 | 318 | 931 | 1.30E-93 | [acc:p08577] [gn:ruvb] [or:*escherichia coli*] [de:holliday junction dna helicase ruvb] [sp:p08577] [db:swissprot] |
| 35172062_f1_1 | 2609 | 6263 | 972 | 323 | 456 | 2.80E-43 | [acc:a69867] [pn:conserved hypothetical protein ykul] [gn:ykut] [or:*bacillus subtilis*] [db:pir] |
| 35173457_c3_85 | 2610 | 6264 | 498 | 165 | 539 | 4.50E-52 | [ln:af016233] [acc:af016233] [pn:methyltransferase] [or:*enterococcus faecalis*] [db:genpept-bct] [de:*enterococcus faecalis* methyltransferase gene, partial cds; alkylhydrogen peroxide reductase gene, complete cds; and thioredoxinreductase gene, partial cds.] |
| 35177258_c3_31 | 2611 | 6265 | 186 | 61 | 52 | 0.3 | [ln:ihvrna] [acc:x73872] [pn:1 protein] [gn:1] [or:infectious hematopoietic necrosis virus] [db:genpept-vrl] [de:infectious hematopoietic necrosis virus n, m1, m2, g, putative nv, and partial 1 genes.] [le:4862] [re:2466] [di:direct] |
| 35181563_c3_50 | 2612 | 6266 | 1203 | 400 | 151 | 6.10E-08 | [acc:a69804] [pn:abc transporter (atp-binding protein) homolog yfin] [gn:yfin] [or:*bacillus subtilis*] [db:pir] |
| 35187941_c1_92 | 2613 | 6267 | 579 | 192 | 70 | 0.0033 | [ln:u88974] [acc:88974] [pn:orf19] [or:*streptococcus thermophilus*] [db:genpept-bct] [de:*streptococcus thermophilus* bacteriophage 01205 dna sequence.] [le:10397] [re:10864] [di:direct] |
| 35187941_c3_85 | 2614 | 6268 | 717 | 238 | 144 | 8.80E-13 | [ln:labikorf] [acc:y11901] [pn:hypothetical protein] [or:*lactococcus lactis*] [db:genpept-bct] [de:*l.lactis* abik gene, gene encoding dutpase and 8 orf's.] [nt:orf1] [le:638] [re:1213] [di:direct] |
| 35188262_c3_195 | 2615 | 6269 | 1059 | 352 | 991 | 5.60E-100 | [ln:efu09422] [acc:u09422] [or:*enterococcus faecalis*] [db:genpept-bct] [de:*enterococcus faecalis* ds16 transposon tn916, (tet(m)), (xis-tn), (int-tn) genes, orfs 1–24, complete cds, complete sequence.] [nt:orf21] [le:1081] [re:2466] [di:direct] |
| 35189757_c2_18 | 2616 | 6270 | 753 | 250 | 424 | 6.80E-40 | [acc:g69766] [pn:conserved hypothetical protein ycxe] [gn:ycxe] [or:*bacillus subtilis*] [db:pir] |
| 35192191_f1_1 | 2617 | 6271 | 1383 | 460 | 461 | 8.20E-44 | [acc:p76273:o07980] [gn:yebu] [or:*escherichia coli*] [de:hypothetical 53.4 kd protein in prc-prpa intergenic region] [sp:p76273:o07980] [db:swissprot] |
| 35196025_c3_59 | 2618 | 6272 | 273 | 90 | 64 | 0.12 | [acc:p18635] [or:*saccharomyces cerevisiae*] [sr:baker's yeast] [de:hypothetical 11.4 kd protein in atp10 region] [sp:p18635] [db:swissprot] |
| 35197018_c2_3 | 2619 | 6273 | 774 | 258 | 101 | 0.0024 | [ln:lbaprel] [acc:d296674] [pn:dna-binding protein] [or:*lactobacillus sp.*] [sr:*lactobacillus sp.* (strain no.1)] dna, clone pmp45] [db:genpept-bct] [de:*lactobacillus sp.* gene for dna-binding protein, complete cds.] [le:328] [re:1602] [di:direct] |
| 35198452_f3_14 | 2620 | 6274 | 921 | 306 | 320 | 7.20E-29 | [ln:styflga] [acc:d25292] [pn:orf3] [gn:orf3] [or:*salmonella typhimurium*] [sr:*salmonella typhimurium* (strain:lt2) dna] [db:genpept-bct] [de:*salmonella typhimurium* flg (a,b,m,n) and orf (2,3) genes forflagella.] [le:3746] [re:4669] [di:complement] |
| 35204002_f3_34 | 2621 | 6275 | 225 | 74 | 182 | 3.00E-14 | [ln:bsz75208] [acc:z75208] [pn:hypothetical protein] [gn:ysoc] [or:*bacillus subtilis*] [db:genpept-bct] [de:*b.subtilis* genomic sequence 89009bp.] [nt:unknown function; putative] [le:80592] [re:81206] [di:complement] |
| 35211627_f2_7 | 2622 | 6276 | 462 | 153 | 439 | 1.80E-41 | [acc:54464] [gn:yqey] [or:*bacillus subtilis*] [de:hypothetical 16.8 kd protein in rpsu-phoh interegenic region] [sp:p54464] [db:swissprot] |
| 35235667_f2_9 | 2623 | 6277 | 2154 | 717 | 2224 | 1.20E-230 | [acc:o06993] [gn:yvdk] [or:*bacillus subtilis*] [de:hypothetical 88.3 kd protein in clpp-crh intergenic region] [sp:o06993] [db:swissprot] |
| 35252267_c1_15 | 2624 | 6278 | 852 | 283 | 617 | 2.40E-60 | [acc:p42977] [gn:paps] [or:*bacillus subtilis*] [ec:2.7.7.19] [de:poly(a) polymerase, (pap)] [sp:p42977] [db:swissprot] |

TABLE 2-continued

| Orf | NT Seq ID | AA Seq ID | NT Orf length | AA Orf length | Score | Probability | Description |
|---|---|---|---|---|---|---|---|
| 35261087_f3_30 | 2625 | 6279 | 420 | 139 | 277 | 2.60E-24 | [ac:p39694] [gn:comea:come1] [or:*bacillus subtilis*] [de:come operon protein 1] [sp:p39694] [dbsswissprot] |
| 35288_c3_9 | 2626 | 6280 | 288 | 95 | 138 | 1.60E-08 | [ac:p35649] [or:*eikenella corrodens*] [de:hypothetical 66.3 kd protein in hag2 5'region] [sp:p35649] [dbsswissprot] |
| 35289075_f1_2 | 2627 | 6281 | 894 | 297 | 501 | 4.70E-48 | [ac:g70080] [pn:conserved hypothetical protein yxkd] [gn:yxkd] [or:*bacillus subtilis*] [db:pir] |
| 35314168_c2_42 | 2628 | 6282 | 1545 | 514 | 469 | 1.20E-44 | [ac:g70002] [pn:hypothetical protein ytwp] [gn:ytwp] [or:*bacillus subtilis*] [db:pir] |
| 35317766_c3_44 | 2629 | 6283 | 1023 | 340 | 79 | 0.5 | [ln:af017790] [ac:af017790] [pn:retinoblastoma-associated protein hec] [gn:hec] [or:*homo sapiens*] [sr:human] [db:genpept-pri2] [de:*homo sapiens* retinoblastoma-associated protein hec mrna, completecds.] [nt:nuclear protein] [le:105] [re:2033] [di:direct] |
| 35328501_f1_7 | 2630 | 6284 | 1191 | 396 | 1458 | 1.80E-149 | [ac:p18255:p06570] [gn:thrs:thrsv] [or:*bacillus subtilis*] [ec:6.1.1.3] [de:(thrrs)] [sp:p18255:p06570] [dbsswissprot] |
| 35329635_f1_1 | 2631 | 6285 | 336 | 111 | 158 | 1.10E-11 | [ac:g69984] [pn:rrna methylase homolog ysga] [gn:ysga] [or:*bacillus subtilis*] [db:pir] |
| 35329687_c3_46 | 2632 | 6286 | 1071 | 356 | 401 | 1.90E-37 | [ln:sgu81957] [ac:u81957] [or:*streptococcus gordonii*] [db:genpept-bct] [gn:comyb] [de:*streptococcus gordonii* rna polymerase beta' subunit (rpoc), putative dna binding protein, putative abc transporter subunitcomy |
| 35345437_c1_54 | 2633 | 6287 | 774 | 257 | 128 | 6.80E-07 | [ac:g69054] [pn:fuculose-1-phosphate aldolase] [gn:mth1406] [or:*methanobacterium thermoautotrophicum*] [db:pir] |
| 35347327_c1_99 | 2634 | 6288 | 861 | 286 | 127 | 6.90E-05 | [ac:a64505] [pn:p115 homolog] [or:*methanococcus jannaschii*] [db:pir] [mp:for1623481–1626990] |
| 35348452_c2_52 | 2635 | 6289 | 777 | 258 | 323 | 7.10E-29 | [ac:p54493] [gn:yqgp] [or:*bacillus subtilis*] [de:hypothetical 56.4 kd protein in soda-comga intergenic region] [sp:p54493] [dbsswissprot] |
| 35350282_c1_38 | 2636 | 6290 | 1617 | 538 | 138 | 1.20E-06 | [ac:s74772] [pn:hypothetical protein slr1071] [or:synechocystis sp.] [sr:pcc 6803, , pcc 6803] [sr:pcc 6803] [db:pir] |
| 35352137_c1_55 | 2637 | 6291 | 522 | 173 | 213 | 1.60E-17 | [ac:a69866] [pn:hypothetical protein ykul] [gn:ykul] [or:*bacillus subtilis*] [db:pir] |
| 35354052_c2_63 | 2638 | 6292 | 648 | 215 | 131 | 5.60E-12 | [ln:d90829] [ac:d90829:ab001340] [pn:isochorismatase (ec 3.3.2.1) (2,3 dihydro-2,3] [gn:yecd] [or:*escherichia coli*] [sr:*escherichia coli* (strain:k12) dna, clone_lib:kohara lambda minise] [db:genpept-bct] [de:*e.coli* genomic dna, kohara clone #337(41.9–42.3 |
| 35355340_f1_2 | 2639 | 6293 | 453 | 150 | 686 | 1.20E-67 | [ln:ehy13922] [ac:y13922:y15222] [gn:yllb] [or:*enterococcus hirae*] [db:genpept-bct] [de:*enterococcus hirae* mrar, pbp3s, mray, murd, murg, ftsq and ftsagenes., mraw, yllc and ftsz partial genes.] [le:57] [re:503] [di:direct] |
| 35359755_f3_30 | 2640 | 6294 | 315 | 104 | 138 | 1.20E-08 | [ac:s61993:s66874:s72142] [pn:probable membrane protein yor009w:hypothetical protein o2549:hypothetical protein unb487] [or:*saccharomyces cerevisiae*] [db:pir] [mp:15r] |
| 35363437_f2_73 | 2641 | 6295 | 195 | 64 | 67 | 0.53 | [ln:af007261] [ac:af007261] [pn:haem lyase] [gn:yejr] [or:mitochondrion reclinomonas americana] [sr:*reclinomonas americana*] [db:genpept-inv] [de:*reclinomonas americana* mitochondrial dna, complete genome.] [le:43382] [re:45295] [di:complement] |
| 35368885_c2_248 | 2642 | 6296 | 504 | 167 | 77 | 0.2 | [ac:d69830] [pn:hypothetical protein yhff] [gn:hyff] [or:*bacillus subtilis*] [db:pir] |
| 35370437_c3_165 | 2643 | 6297 | 693 | 230 | 335 | 1.80E-30 | [ac:s69588] [pn:hypothetical protein ydt533c] [or:*saccharomyces cerevisiae*] [db:pir] [mp:4r] |

TABLE 2-continued

| Orf | NT Seq ID | AA Seq ID | NT Orf length | AA Orf length | Score | Probability | Description |
|---|---|---|---|---|---|---|---|
| 35370885_c2_69 | 2644 | 6298 | 381 | 126 | 77 | 0.69 | [acp:56128] [gn:args:hp0319] [or:helicobacter pylori] [sr:;campylobacter pylori] [ec:6.1.1.19] [de:arginyl-trna synthetase, (arginine--trna ligase) (argrs)] [sp:p56128] [db:swissprot] |
| 35406518_c3_56 | 2645 | 6299 | 234 | 77 | 101 | 1.20E-05 | [acp:p50839] [gn:ypsb] [or:bacillus subtilis] [de:hypothetical 11.6 kd protein in cotd-kdud intergenic region] [sp:p50839] [db:swissprot] |
| 35409431_c1_6 | 2646 | 6300 | 795 | 264 | 152 | 3.60E-09 | [acp54485] [gn:yuqb] [or:bacillus subtilis] [de:hypothetical 28.2 kd protein in ccca-soda intergenic region] [sp:p54485] [db:swissprot] |
| 35409449_c1_7 | 2647 | 6301 | 508 | 169 | 218 | 4.60E-18 | [acp:37261] [gn:yclx8c] [or:saccharomyces cerevisiae] [sr:baker's yeast] [de:hypothetical 21.1 kd protein in fus1-agp1 intergenic region] [sp:p37261] [db:swissprot] |
| 35409459_c2_18 | 2648 | 6302 | 437 | 145 | 244 | 8.10E-21 | [acp14193] [gn:prs] [or:bacillus subtilis] [ec:2.7.6.1] [de:pyrophosphate synthetase) [sp:p14193] [db:swissprot] |
| 35412807_c1_43 | 2649 | 6303 | 678 | 225 | 616 | 3.10E-60 | [aca69787] [pn:hypothetical protein ydih] [gn:ydih] [or:bacillus subtilis] [db:pir] |
| 35414062_f1_1 | 2650 | 6304 | 1053 | 350 | 381 | 2.50E-35 | [ln:af032386] [aca:af032386] [pn:aldose-1-epimerase-like protein] [gn:gp40] [or:nicotiana tabacum] [sr:common tobacco] [db:genpept-pln] [de:nicotiana tabacum aldose-1-epimerase-like protein (gp40) mrna, complete cds.] [nt:gp40; glycoprotein with terminal ] |
| 35417188_c3_61 | 2651 | 6305 | 564 | 187 | 606 | 3.50E-59 | [aca69637] [pn:transcription elongation factor grea] [gn:grea] [or:bacillus subtilis] [db:pir] |
| 35429712_f3_8 | 2652 | 6306 | 911 | 304 | 330 | 6.30E-30 | [acp:21955] [gn:galm] [or:streptococcus thermophilus] [ec:5.1.3.3] [de:aldose 1-epimerase, (mutarotase)] [sp:p21955] [db:swissprot] |
| 35430443_c2_70 | 2653 | 6307 | 402 | 133 | 78 | 0.51 | [ln:spu59235] [acc:u59235] [pn:unknown] [or:synechococcus pcc7942] [db:genpept-bct] [de:synechococcus pcc7942 orf327, orf249, orf376, elongation factor p(efp), biotin carboxyl carrier protein (accb), orf1000, and orf409genes, complete cds.] [nt:orf376] [le |
| 35448508_c2_170 | 2654 | 6308 | 1941 | 646 | 2108 | 2.40E-218 | [acp14951] [gn:uvrc] [or:bacillus subtilis] [de:excinuclease abc subunit c] [sp:p14951] [db:swissprot] |
| 35579687_c3_35 | 2655 | 6309 | 1305 | 435 | 1548 | 5.30E-159 | [acp:21458:p21459] [gn:spoiiie] [or:bacillus subtilis] [de:stage iii sporulation protein e] [sp:p21458:p21459] [db:swissprot] |
| 35558711_f1_7 | 2656 | 6310 | 759 | 252 | 516 | 1.20E-49 | [nt:instranspo] [ac:1346751 [pn:transposase] [or:insertion sequence is1251] [sr:insertion sequence is1251 dna] [db:genpept-bct] [de:insertion sequence is1251 from enterococcus faecium transposasegene, complete cds.] [nt:putative] [le:128] [re:1417] [di:di |
| 35584841_f1_21 | 2657 | 6311 | 954 | 317 | 61 | 0.76 | [acp:41016] [gn:cspb] [or:bacillus caldolyticus] [de:cold shock protein cspb] [sp:p41016] [db:swissprot] |
| 35625342_f3_21 | 2658 | 6312 | 228 | 75 | 56 | 0.77 | [acp:48582] [gn:bro1] [or:saccharomyces cerevisiae] [sr:baker's yeast] [de:bro1 protein] [sp:p48582] [db:swissprot] |
| 35642650_f2_27 | 2659 | 6313 | 210 | 69 | 89 | 0.00078 | [ln:cek11d9] [ac:z928071] [pn:k11d9.d] [or:caenorhabditis elegans] [db:genpept-inv] [de:caenorhabditis elegans cosmid k11d9, complete sequence.] [nt:protein predicted using genefinder; preliminary] [le:14723:15982] [re:14898:16531] [di:directjoin] |
| 35674032_c1_11 | 2660 | 6314 | 225 | 75 | 67 | 0.063 | [acp:46731] [or:mycobacterium avium] [de:18 kd antigen 2 (clone mavc83)] [sp:p46731] [db:swissprot] |
| 35680406_c1_21 | 2661 | 6315 | 429 | 142 | 98 | 0.00065 | [acq01033] [gn:48:edlf5] [or:herpesvirus saimiri] [sr:11,] [de:hypothetical gene 48 protein] [sp:q01033] [db:swissprot] |

TABLE 2-continued

| Orf | NT Seq ID | AA Seq ID | NT Orf length | AA Orf length | Score | Probability | Description |
|---|---|---|---|---|---|---|---|
| 35683517_c3_5 | 2662 | 6316 | 192 | 64 | 58 | 0.14 | [ln:chkvicoll] [ac:j05475] [or:gallus gallus] [sr:chicken adult liver dna, clones lambda [5,8,13]] [db:genpept-vrt] [de:chicken type vi collagen alpha 2 (vi) subunit (col6a2) gene, 5′ end.] [nt:type vi collagen] [le:909:1056:1644:1951:2065] [re:947:1100:16 |
| 35711691_f1_1 | 2663 | 6317 | 658 | 220 | 354 | 1.80E-32 | [ac:p23524] [gn:yhad] [or:escherichia coli] [de:(f408)] [sp:p23524] [dbswissprot] |
| 35742943_c1_20 | 2664 | 6318 | 690 | 229 | 341 | 4.30E-31 | [ac:h64425] [pn:phosphate transport system regulatory protein homolog] [or:methanococcus jannaschii] [db:pir] [mp:rev939905–939195] |
| 35744062_f2_15 | 2665 | 6319 | 1464 | 487 | 503 | 2.90E-48 | [ac:c69785] [pn:cellobiose phosphotransferase system enzym homolog ydho] [gn:ydho] [or:bacillus subtilis] [db:pir] |
| 35757177_c2_15 | 2666 | 6320 | 849 | 282 | 870 | 3.70E-87 | [ac:f69708] [pn:uridylate kinase smba] [gn:smba] [or:bacillus subtilis] [db:pir] |
| 35757816_f1_1 | 2667 | 6321 | 711 | 236 | 389 | 3.50E-36 | [ac:b69377] [pn:abc transporter, atp-binding protein homolog] [or:archaeoglobus fulgidus] [db:pir] |
| 35759562_f1_1 | 2668 | 6322 | 393 | 130 | 343 | 2.60E-31 | [ac:p54479] [gn:yqfv] [or:bacillus subtilis] [de:ferric uptake regulation protein homolog 1] [sp:p54479] [db:swissprot] |
| 35781292_f3_10 | 2669 | 6323 | 825 | 274 | 238 | 3.50E-20 | [ac:q02150] [or:lactococcus lactis] [sr:subsplactis::streptococcus lactis] [de:hypothetical 31.3 kd protein in hisie 3′region (orf13)] [sp:q02150] [db:swissprot] |
| 35808418_f1_6 | 2670 | 6324 | 761 | 254 | 91 | 0.2 | [ln:celc27h5] [ac:u14635] [gn:c27h5.3] [or:caenorhabditis elegans] [sr:caenorhabditis elegans strain=bristol n2] [db:genpept-inv] [de:caenorhabditis elegans cosmid c27h5.] [nt:weakly similar to nucleolin; coded for c.] [le:724:1027:1514:1746:2080] [re: |
| 35812501_f3_58 | 2671 | 6325 | 354 | 117 | 77 | 0.37 | [ac:g69808] [pn:multidrug resistance protein homolog yfkl] [gn:yfkl] [or:bacillus subtilis] [db:pir] |
| 35817062_c2_5 | 2672 | 6326 | 186 | 61 | 47 | 0.34 | [ac:p41508] [or:mycoplasma hyorhinis] [de:p115 protein] [sp:p41508] [db:swissprot] |
| 35817167_c3_146 | 2673 | 6327 | 357 | 118 | 411 | 1.60E-38 | [ln:charpqtou] [ac:z50854] [pn:arpt] [gn:arpt] [or:enterococcus hirae] [db:genpept-bct] [de:e.hirae arp[q,r,s,t,u] genes.] [le:857] [re:1153] [di:direct] |
| 35829712_c2_53 | 2674 | 6328 | 1137 | 378 | 57 | 0.99 | [ln:mratef1b2] [ac:m16353] [or:rhizomucor racemosus] [sr:m.racemosus (atcc 1216b) germling dna] [db:genpept-pln] [de:m.racemosus elongation factor 1-alpha (tef-2) gene, 3′ end.] [nt:elongation factor tef-2] [le:<1] [re:140] [di:direct] |
| 35839515_c1_37 | 2675 | 6329 | 1239 | 412 | 1058 | 4.50E-107 | [ac:s37549:s67927] [pn:transposase] [or:streptococcus thermophilus] [db:pir] |
| 35937505_c2_7 | 2676 | 6330 | 198 | 65 | 70 | 0.022 | [ln:mgu01771] [ac:u01771] [pn:unknown] [or:mycoplasma genitalium] [db:genpept-bct] [de:mycoplasma genitalium random genomic clone hsb12, partial cds.] [le:<1] [re:295] [di:direct] |
| 35937580_f3_5 | 2677 | 6331 | 309 | 102 | 57 | 0.55 | [ln:arbmtnd5a] [ac:m79454:m35541] [pn:nadh dehydrogenase subunit 5] [gn:nd5] [or:mitochondrion arbacia lixula] [sr:mitochondrion arbacia lixula (organelle mitochondrion arbaci] [db:genpept-inv] [de:arbacia lixula mitochondrial nadh dehydrogenase subunit 5 |
| 35937592_c2_51 | 2678 | 6332 | 183 | 60 | 72 | 0.044 | [ac:p47643] [gn:atpf:mg403] [or:mycoplasma genitalium] [ec:3.6.1.34] [de:atp synthase b chain,] [sp:p47643] [db:swissprot] |
| 35937755_f1_9 | 2679 | 6333 | 507 | 168 | 111 | 8.60E-05 | [ln:spbc3d5] [ac:z95620] [pn:unknown] [gn:spbc3d5.14c] [or:schizosaccharomyces pombe] [sr:fission yeast] [db:genpept-pln] [de:s.pombe chromosome ii cosmid c3d5.] [nt:spbc3d5.14c, unknown; partial; serine rich,] [le:31398] [re: |

TABLE 2-continued

| Orf | NT Seq ID | AA Seq ID | NT Orf length | AA Orf length | Score | Probability | Description |
|---|---|---|---|---|---|---|---|
| 35937827_c1_97 | 2680 | 6334 | 387 | 128 | 90 | 0.00025 | [ac:p54481] [gn:yqfx] [or:bacillus subtilis] [de:hypothetical 13.9 kd protein in ccca-soda intergenic region] [sp:p54481] [db:swissprot] |
| 35938380_f1_7 | 2681 | 6335 | 741 | 246 | 337 | 1.10E-30 | [ac:p76038:p77761] [gn:ycjl] [or:escherichia coli] [de:hypothetical 28.5 kd protein in sapa-aldh intergenic region] [sp:p76038:p77761] [db:swissprot] |
| 35938_c3_66 | 2682 | 6336 | 1005 | 334 | 538 | 5.70E-52 | [ac:a69627] [pn:fructose 1-phosphate kinase frub] [gn:frub] [or:bacillus subtilis] [db:pir] |
| 35939183_f2_6 | 2683 | 6337 | 222 | 73 | 125 | 3.30E-08 | [ac:c69786] [pn:conserved hypothetical protein ydib] [gn:ydib] [or:bacillus subtilis] [db:pir] |
| 35945138_c2_1 | 2684 | 6338 | 291 | 97 | 201 | 1.40E-15 | [ac:g70019] [pn:conserved hypothetical protein yurx] [gn:yurx] [or:bacillus subtilis] [db:pir] |
| 35947011_f2_11 | 2685 | 6339 | 486 | 161 | 177 | 1.00E-13 | [ac:s57951] [gn:mj0531] [or:methanococcus jannaschii] [de:hypothetical protein mj0531] [sp:q57951] [db:swissprot] |
| 35947562_c1_30 | 2686 | 6340 | 1587 | 528 | 1725 | 9.30E-178 | [ac:d70009] [pn:abc transporter (atp-binding protein) homolog yufo] [gn:yufo] [or:bacillus subtilis] [db:pir] |
| 35952_c2_65 | 2687 | 6341 | 1275 | 424 | 1162 | 4.30E-118 | [ac:p12039] [pn:purd] [or:bacillus subtilis] [ec:6.3.4.13] [de:ribonucleotide synthetase) (phosphoribosylglycinamide synthetase)] [sp:p12039] [db:swissprot] |
| 35960061_c1_91 | 2688 | 6342 | 225 | 74 | 89 | 0.0022 | [ac:s61292:s61289] [pn:transcription initiation factor sigma mysa:sigma factor mysa] [gn:mysa] [cl:transcription initiation factor sigma katf:transcription initiation factor sigma katf homology] [or:mycobacterium smegmatis] [db:pir] |
| 35977142_c3_18 | 2689 | 6343 | 2472 | 823 | 2478 | 1.50E-257 | [ln:spparcetp] [ac:z67739] [pn:dna topoisomerase iv] [gn:parc] [or:streptococcus pneumoniae] [db:genpept-bct] [des,pneumoniae parc, pare and transposase genes and unknown orf.] [nt:parc subunit] [le:3618] [re:6089] [di:direct] |
| 35985887_c3_70 | 2690 | 6344 | 189 | 62 | 79 | 0.01 | [ln:phu62565] [ac:u62565] [pn:tonb] [gn:tonb] [fn:energy transducer] [or:pasteurella haemolytica] [db:genpept-bct] [de:pasteurella haemolytica exbb (exbb) exbd (exbd) and tonb (tonb)genes, complete cds and cysz (cysz) gene, partial cds.] [nt:membrane prot |
| 35990893_c1_120 | 2691 | 6345 | 198 | 65 | 78 | 0.024 | [ln:ceb0218] [ac:u58752] [gn:b0218.5] [or:caenorhabditis elegans] [sr:caenorhabditis elegans strain=bristol n2] [db:genpept-inv] [de:caenorhabditis elegans cosmid b0218.] [nt:similar to casein kinases] [le:8827:9147:9601] [re:9102:9554:10020] [di:complem |
| 35992200_c2_136 | 2692 | 6346 | 426 | 141 | 95 | 0.0055 | [ln:celw05h9] [ac:u40946] [gn:w05h9.1] [or:caenorhabditis elegans] [sr:caenorhabditis elegans strain=bristol n2] [db:genpept-inv] [de:caenorhabditis elegans cosmid w05h9.] [nt:coded for by c. elegans cdna yk100c12.5; coded for] [le:24487:24798:24971:25179 |
| 35992212_c3_48 | 2693 | 6347 | 312 | 103 | 276 | 3.30E-24 | [ln:efu38590] [ac:u38590] [pn:prgn] [gn:prgn] [fn:involved in negative control of conjugation and] [or:enterococcus faecalis] [sr:enterococcus faecalis strain=sp7] [db:genpept-bct] [de:enterococcus faecalis plasmid pcf10 prgn, prgo, and prgp genes,complet |
| 36015628_c2_26 | 2694 | 6348 | 2415 | 804 | 182 | 2.70E-21 | [ac:p06839] [gn:rad3:rem1:yer171w] [or:saccharomyces cerevisiae] [sr:baker's yeast] [de:dna repair helicase rad3] [sp:p06839] [db:swissprot] |
| 36016878_c2_14 | 2695 | 6349 | 639 | 212 | 742 | 1.40E-73 | [ac:ldgappgk] [ac:aj000339] [pn:phosphoglycerate kinase] [gn:pgk] [or:lactobacillus delbrueckii] [db:genpept-bct] [ec:2.7.2.3] [de:lactobacillus delbrueckii ygap, gap, pgk, tpi, and ycse genes.] [le:2369] [re:3580] [di:direct] |
| 36020007_f3_6 | 2696 | 6350 | 2154 | 717 | 2280 | 1.40E-236 | [ac:o66993] [gn:yvdk] [or:bacillus subtilis] [de:hypothetical 88.3 kd protein in clpp-crh intergenic region] [sp:o66993] [db:swissprot] |

TABLE 2-continued

| Orf | NT Seq ID | AA Seq ID | NT Orf length | AA Orf length | Score | Probability | Description |
|---|---|---|---|---|---|---|---|
| 36023462_c2_20 | 2697 | 6351 | 804 | 267 | 534 | 1.50E-51 | [ac:p39805] [gn:licu:n15a] [or:bacillus subtilis] [de:transcription antiterminator lict] [sp:p39805] [db:swissprot] |
| 36024062_c3_61 | 2698 | 6352 | 975 | 324 | 663 | 3.20E-65 | [ln:celf08f3] [ac:u64847] [or:caenorhabditis elegans] [gn:if08f3.4] [or:caenorhabditis elegans] [sr:caenorhabditis elegans strain=bristol n2] [db:genpept-inv] [de:caenorhabditis elegans cosmid f08f3.] [le:1515:1817:2044:2841] [re:1758:1994:2276:3110] [di:directjoin] |
| 36024193_c1_26 | 2699 | 6353 | 2733 | 910 | 357 | 3.30E-52 | [ac:h69818] [pn:conserved hypothetical protein yhan] [gn:yhan] [or:bacillus subtilis] [db:pir] |
| 36046965_f2_4 | 2700 | 6354 | 411 | 136 | 160 | 2.20E-11 | [ln:efu09422] [ac:u09422] [or:enterococcus faecalis] [db:genpept-bct] [de:enterococcus faecalis ds16 transposon tn916, (tet(m)), (xis-tn),(int-tn) genes, orfs 1–24, complete cds, complete sequence.] [nt:orf20] [le:2861] [re:3850] [di:direct] |
| 36047176_f1_2 | 2701 | 6355 | 1035 | 344 | 468 | 1.50E-44 | [ac:p15294] [gn:prtm] [or:lactococcus lactis] [sr:subsplactis.streptococcus lactis] [de:protease maturation protein precursor] [sp:p15294] [db:swissprot] |
| 36067842_c2_56 | 2702 | 6356 | 891 | 296 | 146 | 3.00E-08 | [ac:c69427] [or:membrane protein homolog] [or:archaeoglobus fulgidus] [db:pir] |
| 36070317_c1_18 | 2703 | 6357 | 216 | 71 | 59 | 0.28 | [ac:p24649] [or:bombyx mori nuclear polyhedrosis virus] [sr:;bmnpv] [de:protein (nucleocapsid protein)] [sp:p24649] [db:swissprot] |
| 36120692_c2_229 | 2704 | 6358 | 213 | 70 | 52 | 0.33 | [ln:tenu70731] [ac:u70731] [pn:putative poly(a)-binding protein fabm] [gn:fabm] [or:emericella nidulans] [db:genpept-pln] [de:emericella nidulans putative poly(a)-binding protein (fabm) gene,complete cds.] [nt:pabp homolog] [le:635:27749] [re:2686:2814] [di |
| 36120887_c1_43 | 2705 | 6359 | 2469 | 822 | 2084 | 8.50E-216 | [ac:a69682] [pn:primosomal replication factor y pria] [gn:pria] [or:bacillus subtilis] [db:pir] |
| 36125000_f3_121 | 2706 | 6360 | 852 | 283 | 181 | 1.70E-12 | [ac:jc6007] [pn:transcriptional activator plcr] [gn:plcr] [or:bacillus thuringiensis] [db:pir] |
| 36126562_f1_12 | 2707 | 6361 | 201 | 66 | 65 | 0.023 | [ln:spadca] [ac:z71552] [pn:zn-binding lipoprotein] [gn:adca] [or:streptococcus pneumoniae] [db:genpept-bct] [de:streptococcus pneumoniae adcba operon.] [le:1527] [re:2471] [di:direct] |
| 36126568_c2_21 | 2708 | 6362 | 1731 | 576 | 1815 | 2.70E-187 | [ac:g69682] [pn:prolyl-trna synthetase pros] [gn:pros] [or:bacillus subtilis] [db:pir] |
| 36131432_c3_129 | 2709 | 6363 | 327 | 108 | 69 | 0.41 | [ln:celf42a9] [ac:u61952] [gn:f42a9.3] [or:caenorhabditis elegans] [sr:caenorhabditis elegans strain=bristol n2] [db:genpept-inv] [de:caenorhabditis elegans cosmid f42a9.] [le:11746:11926:12438] [re:11873:12028:12614] [di:directjoin] |
| 36131455_f1_4 | 2710 | 6364 | 504 | 167 | 313 | 4.00E-28 | [ac:e69808] [pn:protein-tyrosine phosphatase homolog yfkj] [gn:yfkj] [or:bacillus subtilis] [db:pir] |
| 36132637_c1_27 | 2711 | 6365 | 891 | 296 | 1212 | 2.10E-123 | [ln:spu09239] [ac:u09239] [pn:glucose-1-phosphate thymidyl transferase] [gn:cps19f1] [or:streptococcus pneumoniae] [db:genpept-bct] [de:streptococcus pneumoniae type 19f capsular polysaccharidebiosynthesis operon, (cps19fabcdefghijklmno) genes, complete c |
| 36132765_c1_10 | 2712 | 6366 | 510 | 169 | 116 | 3.00E-07 | [ln:mtcy441] [ac:z80225] [pn:hypothetical protein mtcy441.38] [gn:mtcy441.38] [or:mycobacterium tuberculosis] [db:genpept-bct] [de:mycobacterium tuberculosis cosmid y441.] [nt:mtcy441.38, unknown, len: 156, some similarity to] [le:27768] [re:28238] [di:di |
| 36132837_c1_42 | 2713 | 6367 | 396 | 131 | 262 | 1.00E-22 | [ac:p76243] [gn:yeao] [or:escherichia coli] [de:hypothetical 14.2 kd protein in gapa-rnd intergenic region] [sp:p76243] [db:swissprot] |
| 36132930_c1_17 | 2714 | 6368 | 582 | 193 | 456 | 2.80E-43 | [ln:ehnapbc] [ac:aj000346] [pn:napb protein] [gn:napb] [fn:putative regulatory protein] [or:enterococcus hirae] [db:genpept-bct] [de:enterococcus hirae napb and napc genes.] [le:129] [re:581] [di:direct] |

TABLE 2-continued

| Orf | NT Seq ID | AA Seq ID | NT Orf length | AA Orf length | Score | Probability | Description |
|---|---|---|---|---|---|---|---|
| 36134437_c2_33 | 2715 | 6369 | 939 | 312 | 1239 | 3.00E-126 | [ac:p54380] [gn:glyq] [or:bacillus subtilis] [ec:6.1.1.14] [de:alpha chain) (glyrs)] [sp:p54380] [db:swissprot] |
| 36134843_c3_43 | 2716 | 6370 | 282 | 93 | 95 | 5.00E-05 | [ac:h64966] [pn:yefm protein] [gn:yefm] [or:escherichia coli] [db:pir] |
| 36135262_f3_10 | 2717 | 6371 | 1245 | 414 | 207 | 3.20E-22 | [n:spu40453] [ac:u40453:m19350] [pn:integrase] [gn:int] [or:streptococcus pyogenes phage t12] [db:genpept-phg] [de:streptococcus pyogenes phage t12 repressor, excisionase (xis), integrase (int) and erythrogenic toxin a precursor (spea) genes,complete cds. |
| 36135938_f3_15 | 2718 | 6372 | 957 | 318 | 638 | 1.40E-62 | [ac:p18579:p16669:p37581] [gn:murb] [or:bacillus subtilis] [ec:1.1.1.158] [de:acetylmuramate dehydrogenase)] [sp:p18579:p16669:p37581] [db:swissprot] |
| 36136061_f3_26 | 2719 | 6373 | 1041 | 346 | 439 | 1.80E-41 | [ac:p46828] [gn:ccpa] [or:bacillus megaterium] [de:glucose-resistance amylase regulator (catabolite control protein)] [sp:p46828] [db:swissprot] |
| 36142192_c2_84 | 2720 | 6374 | 459 | 152 | 321 | 5.60E-29 | [ac:q02420] [gn:mtlf] [or:streptococcus mutans] [ec:2.7.1.69] [de:(ec 2.7.1.69) (eiii–mtl)] [sp:q02420] [db:swissprot] |
| 36142775_f1_28 | 2721 | 6375 | 198 | 65 | 67 | 0.043 | [n:celt22d1] [ac:af039052] [gn:t22d1.10] [or:caenorhabditis elegans] [sr:caenorhabditis elegans strain=bristol n2] [db:genpept-inv] [de:caenorhabditis elegans cosmid t22d1.] [nt:contains similarity to atpases; coded for by c.] [le:26459:27153:27357] [re: |
| 36148513_f3_34 | 2722 | 6376 | 858 | 285 | 818 | 1.20E-81 | [ac:e69751] [pn:abc transporter (atp-binding protein) homolog ybxa] [gn:ybxa] [or:bacillus subtilis] [db:pir] |
| 36150187_c3_65 | 2723 | 6377 | 282 | 93 | 69 | 0.16 | [n:tb256279] [ac:z56279] [pn:integral membrane protein] [gn:cglf] [or:thermoanaerobacter brockii] [db:genpept-bct] [de:t.brockii cglf, cglg, xgls and cglt genes.] [le:191] [re:1102] [di:direct] |
| 36187800_c3_64 | 2724 | 6378 | 627 | 208 | 253 | 9.00E-22 | [ac:q01466] [gn:mrec] [or:bacillus subtilis] [de:rod shape-determining protein mrec] [sp:q01466] [db:swissprot] |
| 36194062_c2_123 | 2725 | 6379 | 441 | 146 | 108 | 2.10E-06 | [n:lbphigle] [ac:x98106] [gn:rorf115] [or:bacteriophage phigle] [db:genpept-phg] [de:lactobacillus bacteriophage phigle complete genomic dna.] [le:33364] [re:33711] [di:complement] |
| 36203136_c2_112 | 2726 | 6380 | 1476 | 491 | 1700 | 4.20E-175 | [ac:p37870] [gn:rpob:rfm:crse] [or:bacillus subtilis] [ec:2.7.7.6] [de:beta chain) (rna polymerase beta subunit)] [sp:p37870] [db:swissprot] |
| 36204088_c2_44 | 2727 | 6381 | 1167 | 388 | 75 | 0.032 | [ac:h69803] [pn:abc transporter (atp-binding protein) homolog yfim] [gn:yfim] [or:bacillus subtilis] [db:pir] |
| 36205013_c1_46 | 2728 | 6382 | 1653 | 550 | 347 | 7.30E-36 | [n:u88974] [ac:u88974] [pn:orf27] [or:streptococcus thermophilus] [db:genpept-bct] [de:streptococcus thermophilus bacteriophage 01205 dna sequence.] [nt:putative portal protein] [le:15560] [re:17065] [di:direct] |
| 36205063_c3_68 | 2729 | 6383 | 582 | 193 | 55 | 0.95 | [ac:s04874] [pn:hypothetical protein 73 (nifs 5' region)] [or:bradyrhizobium japonicum] [db:pir] |
| 36209755_f1_11 | 2730 | 6384 | 309 | 102 | 141 | 6.70E-10 | [ac:g69876] [pn:conserved hypothetical protein ylmg] [gn:ylmg] [or:bacillus subtilis] [db:pir] |
| 36210892_f1_5 | 2731 | 6385 | 1479 | 492 | 1287 | 2.40E-131 | [ac:c70014] [pn:rhamnulokinase homolog yulc] [gn:yulc] [or:bacillus subtilis] [db:pir] |
| 36210900_c1_124 | 2732 | 6386 | 645 | 214 | 64 | 0.31 | [ac:p29583] [or:methanobacterium thermoformicicum] [de:hypothetical 9.7 kd protein (orf7)] [sp:p29583] [db:swissprot] |
| 36210938_c1_40 | 2733 | 6387 | 522 | 173 | 374 | 1.40E-34 | [n:lpargcl] [ac:x99978] [fn:unknown] [or:lactobacillus plantarum] [db:genpept-bct] [de:l.plantarum cara & orf8 partial cds, argc,j,b,d,f & orf7 citrullinebiosynthetic operon.] [nt:orf7; hydophobic protein] [le:6236] [re:6742] [di:direct] |

TABLE 2-continued

| Orf | NT Seq ID | AA Seq ID | NT Orf length | AA Orf length | Score | Probability | Description |
|---|---|---|---|---|---|---|---|
| 36210953_c1_74 | 2734 | 6388 | 441 | 146 | 151 | 5.80E-11 | [ln:lcu28163] [ac:u28163] [pn:eiia-man] [gn:mana] [or:lactobacillus curvatus] [db:genpept-bct] [de:lactobacillus curvattus phosphoenolpyruvate: mannosephosphotransferase eiia-man (mana), eiib-man (manb), and eiic-man(manc) genes, complete cds and eiid-man ( |
| 36210961_c3_43 | 2735 | 6389 | 2040 | 679 | 1373 | 1.90E-140 | [ac:p71353] [gn:hi0568] [or:haemophilus influenzae] [de:hypothetical protein hi0568] [sp:p71353] [db:swissprot] |
| 36210962_c3_55 | 2736 | 6390 | 876 | 291 | 396 | 6.30E-37 | [ac:b47092] [pn:copy control protein repb] [gn:repb] [or:enterococcus faecalis] [db:pir] |
| 36210963_c3_202 | 2737 | 6391 | 930 | 309 | 692 | 2.70E-68 | [ln:efu09422] [ac:u09422] [or:enterococcus faecalis] [db:genpept-bct] [de:enterococcus faecalis ds16 transposon tn916, (tet(m)), (xis-tn),(int-tn) genes, orfs 1-24, complete cds, complete sequence.] [nt:orf13] [1e:10814] [re:11746] [di:direct] |
| 36211013_f3_37 | 2738 | 6392 | 306 | 101 | 75 | 0.029 | [ac:170091] [pn:hypothetical protein yydh] [gn:yydh] [or:bacillus subtilis] [db:pir] |
| 36211556_c2_122 | 2739 | 6393 | 846 | 281 | 454 | 4.50E-43 | [ac:p08188] [gn:manz:ptsm:gptb] [or:escherichia coli] [de:(eii-m-man)] [sp:p08188] [db:swissprot] |
| 36214637_c2_85 | 2740 | 6394 | 951 | 316 | 1388 | 4.80E-142 | [ac:q47741] [gn:pyrd] [or:enterococcus faecalis] [sr:,streptococcus faecalis] [ec:1.3.3.1] [de:(dhodehase)] [sp:q47741] [db:swissprot] |
| 36219000_c1_118 | 2741 | 6395 | 237 | 78 | 67 | 0.066 | [ln:gsu33482] [ac:u33482] [pn:ependymin] [or:gasteropelecus sp.] [db:genpept-vrt] [de:gasteropelecus sp. ependymin mrna, partial cds.] [nt:glycoprotein, extracellular matrix from fish brain] [1e:<1] [re: |
| 36220678_c1_54 | 2742 | 6396 | 309 | 102 | 74 | 0.0084 | [ac:q06425] [gn:orf83] [or:bacteriophage p2] [de:hypothetical 10.2 kd protein in gpa 5'region (orf4)] [sp:q06425] [db:swissprot] |
| 36220678_c2_122 | 2743 | 6397 | 375 | 124 | 237 | 4.50E-20 | [ln:charpqtou] [ac:z50854] [gn:orf1] [or:enterococcus hirae] [db:genpept-bct] [de:e.hirae arp[q,r,s,t,u] genes.] [1e:<1] [re:150] [di:direct] |
| 36222917_c3_80 | 2744 | 6398 | 1200 | 399 | 159 | 2.50E-08 | [ac:p12957:q90756:q90761:q92018:q99230:q03698] [gn:cald1:cad] [or:gallus gallus] [sr:,chicken] [de:caldesmon (cdm)] [sp:p12957:q90756: q90761:q92018:q99230:q03698] [db:swissprot] |
| 36224037_f1_4 | 2745 | 6399 | 459 | 152 | 301 | 7.40E-27 | [ac:69857] [pn:conserved hypothetical protein ykma] [gn:ykma] [or:bacillus subtilis] [db:pir] |
| 36225017_c2_24 | 2746 | 6400 | 654 | 217 | 153 | 1.30E-09 | [ac:s67570] [pn:hypothetical protein yd1037:chypothetical protein d2734] [or:saccharomyces cerevisiae] [db:pir] [mp:41] |
| 36225326_c2_29 | 2747 | 6401 | 654 | 217 | 488 | 1.10E-46 | [ac:p10346] [gn:glnq] [or:escherichia coli] [de:glutamine transport atp-binding protein glnq] [sp:p10346] [db:swissprot] |
| 36225387_c2_71 | 2748 | 6402 | 240 | 79 | 78 | 0.0034 | [ln:celc33g8] [ac:u53154] [gn:c33g8.3] [or:caenorhabditis elegans] [sr:caenorhabditis elegans strain=bristol n2] [db:genpept-inv] [de:caenorhabditis elegans cosmid c33g8.] [1e:27678:27899:28087] [re:27848:27952:28290] [di:direction] |
| 36225691_c3_93 | 2749 | 6403 | 2049 | 682 | 128 | 0.032 | [ac:64474] [pn:hypothetical protein mj396] [or:methanococcus jannaschii] [db:pir] [mp:for1347709-1356393] |
| 36225926_c2_39 | 2750 | 6404 | 1182 | 393 | 938 | 2.30E-94 | [ac:d70006] [pn:conserved hypothetical protein yuba] [gn:yuba] [or:bacillus subtilis] [db:pir] |
| 36226567_c2_32 | 2751 | 6405 | 1764 | 587 | 484 | 5.90E-76 | [ac:q46189] [or:clostridium pasteurianum] [de:hypothetical protein in hydrogenase 1 5'region (fragment)] [sp:q46189] [db:swissprot] |
| 36227013_c3_84 | 2752 | 6406 | 330 | 109 | 354 | 1.80E-32 | [ln:charpqtou] [ac:z50854] [pn:arpr] [gn:arpr] [or:enterococcus hirae] [db:genpept-bct] [de:e.hirae arp[q,r,s,t,u] genes.] [1e:327] [re:638] [di:direct] |
| 36229712_f2_17 | 2753 | 6407 | 480 | 159 | 224 | 1.10E-18 | [ac:p44789] [gn:mscl:hi0626] [or:haemophilus influenzae] [db:swissprot] [de:large conductance mechanosensitive channel] [sp:p44789] |

TABLE 2-continued

| Orf | NT Seq ID | AA Seq ID | NT Orf length | AA Orf length | Score | Probability | Description |
|---|---|---|---|---|---|---|---|
| 36316_f1_26 | 2754 | 6408 | 246 | 81 | 49 | 0.98 | [ac:q05275] [gn:62] [or:mycobacteriophage 15] [de:gene 62 protein (gp62)] [sp:q05275] [db:swissprot] |
| 36348753_c3_76 | 2755 | 6409 | 285 | 94 | 62 | 0.15 | [ln:mlu15183] [acu15183] [pn:u1740g] [or:mycobacterium leprae] [db:genpept-bct] [de:mycobacterium leprae cosmid b1740.] [le:9848] [re:10078] [di:direct] |
| 36359576_c2_21 | 2756 | 6410 | 960 | 319 | 336 | 9.10E-34 | [nt:haa70664] [acu70664] [pn:2-keto-3-deoxygluconate kinase] [or:haloferax alicantei] [db:genpept-bct] [de:haloferax alicantei 2-dehydro-3-deoxyphosphogluconate aldolase,2-keto-3 deoxygluconate kinase, beta-d-galactosidase (bgah) genes, complete cds, and |
| 36370187_c3_35 | 2757 | 6411 | 471 | 156 | 522 | 2.80E-50 | [ac:c69843] [pn:conserved hypothetical protein yjbd] [gn:yjbd] [or:bacillus subtilis] [db:pir] |
| 36376084_c1_12 | 2758 | 6412 | 1028 | 342 | 294 | 4.10E-26 | [ac:s75327] [pn:hypothetical protein] [or:synechocystis sp.] [sr:pcc 6803, , pcc 6803] [sr:pcc 6803,] [db:pir] |
| 36376557_f2_3 | 2759 | 6413 | 378 | 125 | 75 | 0.35 | [nt:cclzk54] [acu58737] [gn:zk54.1] [or:caenorhabditis elegans] [sr:caenorhabditis elegans strain=bristol n2] [db:genpept-inv] [de:caenorhabditis elegans cosmid zk54.] [nt:similar to sodium-dependent inorganic phosphate] [le:402:563:791:1506] [re:513:743 |
| 36377267_c3_150 | 2760 | 6414 | 1218 | 405 | 182 | 1.50E-11 | [ac:d69143] [pn:lps biosynthesis rfbu related protein] [gn:mth338] [or:methanobacterium thermoautotrophicum] [db:pir] |
| 36379693_c2_118 | 2761 | 6415 | 471 | 156 | 76 | 0.1 | [ln:efu09422] [acu09422] [or:enterococcus faecalis] [db:genpept-bct] [de:enterococcus faecalis ds16 transposon tn916, (tet(m)), (xis-tn),(int-tn) genes, orfs 1–24, complete cds, complete sequence.] [nt:orf9] [le:14388] [re:14741] [di:complement] |
| 36386505_c2_179 | 2762 | 6416 | 183 | 60 | 61 | 0.37 | [ac:s72780] [pn:b1496_f2_65 protein] [or:mycobacterium leprae] [db:pir] |
| 36437875_c2_37 | 2763 | 6417 | 1011 | 336 | 103 | 0.00052 | [ac:p22751] [gn:pelx] [or:erwinia chrysanthemi] [ec:4.2.2.9] [de:exopolygalacturonate lyase precursor, (exopl)] [sp:p22751] [db:swissprot] |
| 36501653_c3_268 | 2764 | 6418 | 1197 | 398 | 126 | 3.50E-12 | [ac:p54567] [gn:yqkd] [or:bacillus subtilis] [de:hypothetical 34.6 kd protein in glnq-ansr intergenic region] [sp:p54567] [db:swissprot] |
| 36523412_c3_196 | 2765 | 6419 | 189 | 62 | 47 | 0.26 | [nt:u89959] [acu89959] [pn:mago nashi-like protein] [gn:t7i23.7] [or:arabidopsis thaliana] [sr:thale cress] [db:genpept-pln] [de:arabidopsis thaliana bac t7i23, complete sequence.] [nt:similar to mago nashi, genbank accession number] [le:53855:54159:5457 |
| 36523515_c2_33 | 2766 | 6420 | 1020 | 339 | 964 | 4.10E-97 | [ac:b70015] [pn:thioredoxin reductase homolog yumc] [gn:yumc] [or:bacillus subtilis] [db:pir] |
| 36524051_c2_46 | 2767 | 6421 | 1314 | 437 | 1332 | 4.10E-136 | [ac:p30053] [gn:thiss] [or:streptococcus equisimilis] [ec:6.1.1.21] [de:(hisrs)] [sp:p30053] [db:swissprot] |
| 36526563_c2_21 | 2768 | 6422 | 1668 | 555 | 2245 | 7.40E-233 | [ac:s16989] [pn:dihydrolipoamide s-acetyltransferase,:pyruvate dehydrogenase multienzyme complex e2 chain] [cl:lipoyl/biotin-binding homology] [or:enterococcus faecalis] [ec:2.3.1.12] [db:pir] |
| 36527212_c3_37 | 2769 | 6423 | 342 | 113 | 362 | 2.50E-33 | [ac:q59484] [or:lactobacillus acidophilus] [ec:2.7.1.113=2.7.1.76] [de:(ec 2.7.1.76) subunit 2] [sp:q59484] [db:swissprot] |
| 36531277_c3_82 | 2770 | 6424 | 762 | 253 | 520 | 4.60E-50 | [ac:f69830] [pn:conserved hypothetical protein yhfi] [gn:yhfi] [or:bacillus subtilis] [db:pir] |
| 36540712_f3_20 | 2771 | 6425 | 1173 | 390 | 360 | 4.10E-33 | [ac:p44550] [gn:hi0172] [or:haemophilus influenzae] [de:hypothetical lipoprotein hi0172 precursor] [sp:p44550] [db:swissprot] |
| 36562686_c2_135 | 2772 | 6426 | 390 | 129 | 78 | 0.15 | [ac:q58399] [gn:mj0992] [or:methanococcus jannaschii] [de:hypothetical protein mj0992] [sp:q58399] [db:swissprot] |
| 36564682_c3_172 | 2773 | 6427 | 747 | 248 | 420 | 1.80E-39 | [ac:h69299] [pn:nadh oxidase (noxa-3) homolog] [or:archaeoglobus fulgidus] [db:pir] |

TABLE 2-continued

| Orf | NT Seq ID | AA Seq ID | NT Orf length | AA Orf length | Score | Probability | Description |
|---|---|---|---|---|---|---|---|
| 36570267_f2_3 | 2774 | 6428 | 792 | 263 | 273 | 6.90E-24 | [ac:b64937] [pn:hypothetical protein b1770] [or:escherichia coli] [db:pir] |
| 36570317_c3_74 | 2775 | 6429 | 1326 | 441 | 546 | 8.10E-53 | [ln:ypu22837] [accu22837] [pn:hmsr] [fn:involved the regulation of the hms locus hemin] [or:yersinia pestis] [db:genpept-bct] [de:yersinia pestis hemin binding proteins: hmsh (hmsh), hmsf (hmsf), hmsr (hmsr) and hmss (hmss) genes, complete cds.] |
| 36570468_c2_19 | 2776 | 6430 | 282 | 93 | 95 | 5.00E-05 | [ln:lbphihol] [acx90511] [gn:gp162] [or:bacteriophage phige] [db:genpept-phg] [de:lactobacillus bacteriophage phigle dna for rorf162, holin, lysin, and rorf175 genes.] [le:431] [re:919] [di:direct] |
| 36581891_f2_4 | 2777 | 6431 | 1566 | 521 | 917 | 3.90E-92 | [ln:llu81166] [acu81166] [pn:histidine kinase llkina] [gn:llkina] [or:lactococcus lactis cremoris] [db:genpept-bct] [de:lactococcus lactis subsp. cremoris mg1363 histidine kinase (llkina) gene, complete cds.] [le:1] [re:1473] [di:direct] |
| 36584702_f1_4 | 2778 | 6432 | 324 | 107 | 78 | 0.0032 | [ac:p39302] [gn:sgab] [or:escherichia coli] [ec:2.7.1.69] [de: (cc 2.7.1.69)] [sp:p39302] [db:swissprot] |
| 36589056_f2_39 | 2779 | 6433 | 1242 | 413 | 159 | 2.30E-10 | [ac:s33851:s32631] [pn:fibronectin-binding protein precursor] [gn:fnbb] [or:streptococcus dysgalactiae] [db:pir] |
| 36601563_f2_34 | 2780 | 6434 | 480 | 159 | 391 | 2.10E-36 | [ac:q54431:p96469] [gn:ffh] [or:streptococcus mutans] [de:signal recognition particle protein (fifty-four homolog)] [sp:q54431:p96469] [db:swissprot] |
| 36601662_c1_27 | 2781 | 6435 | 411 | 136 | 319 | 9.20E-29 | [ac:p37582] [gn:glnr] [or:bacillus subtilis] [de:regulatory protein glnr] [sp:p37582] [db:swissprot] |
| 36615636_c2_72 | 2782 | 6436 | 294 | 97 | 72 | 0.014 | [ac:p05351] [gn:virb2] [or:agrobacterium tumefaciens] [de:virb2 protein precursor] [sp:p05351] [db:swissprot] |
| 36615967_c2_30 | 2783 | 6437 | 1887 | 628 | 193 | 6.80E-24 | [ac:p46321] [gn:celr] [or:bacillus subtilis] [de:putative cel operon regulator] [sp:p46321] [db:swissprot] |
| 375_c3_54 | 2784 | 6438 | 843 | 281 | 64 | 0.81 | [ac:s29571] [pn:ig light chain] [or:gadus morhua] [sr:, atlantic cod] [db:pir] |
| 37760_f1_2 | 2785 | 6439 | 216 | 71 | 58 | 0.18 | [ac:p48875] [gn:cob:cytb] [or:chondrus crispus] [sr:, carragheen] [ec:1.10.2.2] [de: cytochrome b,] [sp:p48875] [db:swissprot] |
| 37762_c1_8 | 2786 | 6440 | 204 | 68 | 54 | 0.67 | [ac:p15899] [gn:8] [or:spiroplasma virus spv1-r8a2 b] [de:gene 8 protein] [sp:p15899] [dbswissprot] |
| 377_f1_7 | 2787 | 6441 | 390 | 129 | 197 | 2.70E-14 | [ln:af023459] [acaf023459] [pn:lustrin a] [or:haliotis rufescens] [sr:california red abalone] [db:genpept-inv] [de:haliotis rufescens lustrin a mrna, complete cds.] |
| 38461078_c2_24 | 2788 | 6442 | 330 | 109 | 66 | 0.25 | [nt:extracellular matrix protein; modular structure] [le:26] [re:4312] [di:direct] [ln:f19p19] [ac:ac000104] [gn:f19p19.28] [or:arabidopsis thaliana] [sr:thale cress] [db:genpept-pln] [de:sequence of bac f19p19 from arabidopsis thaliana chromosome 1, complete sequence.] [nt:strong similarity to arabidopsis rev3c] [le:86973:87484:87845:88 |
| 38574627_c2_4 | 2789 | 6443 | 810 | 269 | 558 | 4.30E-54 | [ac:b70020] [pn:conserved hypothetical protein yusa] [gn:yusa] [or:bacillus subtilis] [db:pir] |
| 38592_f3_42 | 2790 | 6444 | 1356 | 451 | 974 | 3.60E-98 | [ac:c69853] [pn:tagaturonate reductase homolog yjmj] [gn:yjmj] [or:bacillus subtilis] [db:pir] |
| 39053_c1_23 | 2791 | 6445 | 633 | 210 | 697 | 8.00E-69 | [ac:s68609] [pn:recombinase sin] [or:staphylococcus aureus] [db:pir] |
| 3906313_f1_2 | 2792 | 6446 | 957 | 318 | 216 | 7.50E-18 | [ac:c69827] [pn:glycerophosphodiester phosphodiesterase homolog yhdw] [gn:yhdw] [or:bacillus subtilis] [db:pir] |
| 3907135_c3_80 | 2793 | 6447 | 258 | 85 | 72 | 0.021 | [ln:lllpk214] [accx92946:cy10522] [pn:hypothetical protein] [gn:orf12] [or:lactococcus lactis] [db:genpept-bct] [de:lactobacillus lactis plasmid pk214, complete sequence.] [nt:phnb-like] [le:11879] [re:12331] [di:direct] |
| 390716_f1_5 | 2794 | 6448 | 1131 | 376 | 697 | 8.00E-69 | [ac:d69771] [pn:conserved hypothetical protein ydbi] [gn:ydbi] [or:bacillus subtilis] [db:pir] |
| 39077_c2_53 | 2795 | 6449 | 639 | 212 | 273 | 6.90E-24 | [ac:c69879] [pn:hypothetical protein ylos] [gn:ylos] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 3907968_c2_22 | 2796 | 6450 | 2721 | 906 | 337 | 3.00E-33 | [ac:c69477] [pn:hypothetical protein af1820] [or:*archaeoglobus fulgidus*] [db:pir] |
| 3909802_f1_4 | 2797 | 6451 | 225 | 74 | 52 | 0.83 | [ln:ratmuscpho] [ac:118752] [pn:muscle glycogen phosphorylase] [gn:mgp] [fn:phosphorylysis of glycogen] [or:*rattus norvegicus*] [sr:*rattus norvegicus* female dna] [db:genpept-rod] [ec:2.4.1.1] [de:*rattus norvegicus* muscle glycogen phosphorylase (mgp) gene. |
| 3910887_c2_12 | 2798 | 6452 | 222 | 73 | 67 | 0.16 | [ac:q02736] [gn:catb] [or:*clostridium butyricum*] [ec:2.3.1.28] [de:chloramphenicol acetyltransferase, (cat)] [sp:q02736] [db:swissprot] |
| 3912511_c1_20 | 2799 | 6453 | 1287 | 428 | 887 | 5.90E-89 | [ac:c69793] [pn:rna methyltransferase homolog yefa] [gn:yefa] [or:*bacillus subtilis*] [db:pir] |
| 3912943_f2_9 | 2800 | 6454 | 549 | 182 | 219 | 3.60E-18 | [ln:af036487] [ac:af036487] [pn:unknown] [or:plasmid pnz4000] [db:genpept] [de:plasmid pnz4000 origin of replication orit1, mobilization protein(moba), putative mobilization protein (mobb), putative mobilization protein (mobc), replication protein (repb3). |
| 3913150_f2_34 | 2801 | 6455 | 1080 | 359 | 126 | 2.40E-05 | [ac:b64499] [pn:hypothetical protein mj1595] [or:*methanococcus jannaschii*] [db:pir] [mp:rev1567340-1566330] |
| 3913180_f2_5 | 2802 | 6456 | 1170 | 389 | 948 | 2.00E-95 | [ln:stu69493] [ac:u69493] [pn:phnw] [fn:2-aminoethylphosphonate:pyruvate] [or:*salmonella typhimurium*] [db:genpept-bct] [de:*salmonella typhimurium* thij and orfl genes, partial cds, and phnx, phnw, phnr, phns, phnt, phnu and phnv genes, complete cds.] [le:10 |
| 3913387_f2_14 | 2803 | 6457 | 264 | 87 | 71 | 0.16 | [ac:s60140:c55521:s49556] [pn:viirs protein] [gn:viirs] [or:*clostridium perfringens*] [db:pir] |
| 3914033_c3_163 | 2804 | 6458 | 210 | 69 | 61 | 0.43 | [ac:s34499:s34867] [pn:hypothetical protein 177 (psbc 3' region)] [or:chloroplast *euglena gracilis*] [db:pir] |
| 3914033_f3_10 | 2805 | 6459 | 216 | 71 | 64 | 0.41 | [ac:s67072] [pn:probable membrane protein yor180c:hypothetical protein o4718] [gn:ehd2] [or:*saccharomyces cerevisiae*] [db:pir] [mp:15r] |
| 391575_f3_22 | 2806 | 6460 | 915 | 304 | 600 | 1.50E-58 | [ac:g69777] [pn:transcriptional regulator (arac/xyls famil) homolog ydee] [gn:ydee] [or:*bacillus subtilis*] [db:pir] |
| 3916432_f2_8 | 2807 | 6461 | 207 | 68 | 55 | 0.72 | [ln:spac2e11] [ac:z98850] [pn:hypothetical protein] [gn:spac2e11.03c] [or:*schizosaccharomyces pombe*] [sr:fission yeast] [db:genpept-pln] [de:*s. pombe* chromosome i cosmid c2e11.] [nt:spac2e11.03c, unknown, len:124aa] [le:1909] [re:2283] [di:complement] |
| 3917155_c1_75 | 2808 | 6462 | 189 | 62 | 68 | 0.057 | [ac:d69368] [pn:conserved hypothetical protein af0948] [or:*archaeoglobus fulgidus*] [db:pir] |
| 392877_c2_29 | 2809 | 6463 | 192 | 63 | 56 | 0.49 | [ac:q58262] [gn:mtrf:mj0852] [pn:methyltransferase 12 kd subunit] [or:*methanococcus jannaschii*] [ec:2.1.1.86] [de:methyltransferase 12 kd subunit] [sp:q58262] [db:swissprot] |
| 3928805_c2_73 | 2810 | 6464 | 357 | 118 | 112 | 7.90E-07 | [ac:s52994] [pn:arabinogalactan-like protein] [or:*pinus taeda*] [sr:, loblolly pine] [db:pir] |
| 3931555_c3_16 | 2811 | 6465 | 537 | 178 | 213 | 1.60E-17 | [ac:p54503] [gn:yxgz] [or:*bacillus subtilis*] [de:hypothetical 14.8 kd protein in soda-comga intergenic region] [sp:p54503] [db:swissprot] |
| 3931713_c1_123 | 2812 | 6466 | 348 | 115 | 74 | 0.2 | [ac:q57889] [gn:mj0447] [or:*methanococcus jannaschii*] [de:hypothetical protein mj0447] [sp:q57889] [db:swissprot] |
| 3932838_c2_13 | 2813 | 6467 | 264 | 87 | 233 | 1.20E-19 | [ln:bapla103] [ac:d55703] [pn:repa] [or:*lactobacillus acidophilus*] [sr:*lactobacillus acidophilus* (isolate:tk8912) plasmid:pla103 dna] [db:genpept-bct] [de:*lactobacillus acidophilus* plasmid pla103 dna for repa, complete cds.] [le:206] [re:1054] [di:direct] |
| 3933187_c3_104 | 2814 | 6468 | 792 | 263 | 286 | 2.90E-25 | [ac:p44068] [gn:hi0882] [or:*haemophilus influenzae*] [de:hypothetical protein hi0882] [sp:p44068] [db:swissprot] |

TABLE 2-continued

| Orf | NT Seq ID | AA Seq ID | NT Orf length | AA Orf length | Score | Probability | Description |
|---|---|---|---|---|---|---|---|
| 3937562_c2_64 | 2815 | 6469 | 477 | 158 | 198 | 3.70E-15 | [ac:p37349;p76013] [gn:yegc] [or:escherichia coli] [de:hypothetical 51.6 kd protein in trea-pth intergenic region] [sp:p37349;p76013] [db:swissprot] |
| 3937577_c1_14 | 2816 | 6470 | 972 | 323 | 1127 | 2.20E-114 | [ac:p00512] [or:bacillus stearothermophilus] [cc:2.7.1.11] [de: (phosphohexokinase)] [sp:p00512] [db:swissprot] |
| 3940875_c2_23 | 2817 | 6471 | 960 | 319 | 84 | 0.6 | [ln:ae001154] [ac:ac001154;ae000783] [pn:aldose reductase, putative] [gn:bb0528] [or:borrelia burgdorferi] [sr:lyme disease spirochete] [db:genpept-bct] [de:borrelia burgdorferi (section 40 of 70) of the complete genome.] [nt:similar to spp46336 pid:9042 |
| 3940927_c3_277 | 2818 | 6472 | 189 | 62 | 61 | 0.2 | [ln:pfcompirb] [ac:x95276] [gn:orf105] [or:plasmodium falciparum] [sr: malaria parasite] [db:genpept-inv] [de:p. falciparum complete gene map of plastid-like dna (ir-b).] [le:13636] [re:14001] [di:direct] |
| 3942677_c1_108 | 2819 | 6473 | 1368 | 455 | 860 | 4.30E-86 | [ac:p54505] [gn:yqhb] [or:bacillus subtilis] [de:hypothetical 50.0 kd protein in soda-comga intergenic region] [sp:p54505] [db:swissprot] |
| 3942917_c3_46 | 2820 | 6474 | 198 | 65 | 66 | 0.058 | [ac:p47702;p77418] [gn:ytek] [or:escherichia coli] [de:hypothetical 13.7 kd protein in pdkk-cysm intergenic region] [sp:p47702;p77418] [db:swissprot] |
| 3944212_c2_224 | 2821 | 6475 | 1002 | 333 | 187 | 2.10E-14 | [ln:apu46857] [ac:u46857] [pn:vitellogenin] [fn:precursor of yolk proteins, serum transport] [or:anolis pulchellus] [db:genpept-vrt] [de:anolis pulchellus vitellogenin mrna, partial cds.] [nt:apvtg5; similar to chicken and xenopus phosvitin] [le:<1] [re: |
| 3945462_f2_9 | 2822 | 6476 | 267 | 88 | 65 | 0.16 | [ln:efas48c] [ac:y12234] [pn:as-48c1 protein] [gn:as-48c1] [fn:putative abc transporter] [or:enterococcus faecalis] [db:genpept-bct] [de:e. faecalis plasmid dna containing gene cluster involved inproduction and immunity to peptide antibiotic as-48.] [le:30 |
| 3946930_c2_48 | 2823 | 6477 | 669 | 222 | 532 | 2.50E-51 | [ac:q06750] [gn:cysc:cysa] [or:bacillus subtilis] [ec:2.3.1.30] [de:serine acetyltransferase, (sat)] [sp:q06750] [db:swissprot] |
| 3946942_f1_1 | 2824 | 6478 | 264 | 87 | 66 | 0.58 | [ac:a69829] [pn:abc transporter (atp-binding protein) homolog yhei] [gn:yhei] [or:bacillus subtilis] [db:pir] |
| 3947165_c3_58 | 2825 | 6479 | 714 | 237 | 93 | 0.075 | [ln:cele42d4] [ac:u41991] [gn:c42d4.7] [or:caenorhabditis elegans] [sr: caenorhabditis elegans strain=bristol n2] [db:genpept-inv] [de:caenorhabditis elegans cosmid c42d4.] [le:21;693;834:1242:1417] [re:58:785:1181:1365:1575] [di:direct|join] |
| 3948337_f3_8 | 2826 | 6480 | 867 | 288 | 341 | 4.30E-31 | [ln:efm09422] [ac:u09422] [or:enterococcus faecalis] [db:genpept-bct] [de: enterococcus faecalis ds16 transposon tn916, (tet(m)), (xis-tn), (int-tn) genes, orfs 1–24, complete cds, complete sequence.] [nt:orf20] [le:2861] [re:3850] [di:direct] |
| 3948338_f3_4 | 2827 | 6481 | 852 | 283 | 563 | 1.30E-54 | [ac:p77791] [gn:ylad] [or:escherichia coli] [de:20.0 kd protein in tesb-hha intergenic region] [sp:p77791] [db:swissprot] |
| 3948453_c1_118 | 2828 | 6482 | 354 | 117 | 76 | 0.083 | [ln:cee01g4] [ac:z83223] [pn:c01g4.2] [or:caenorhabditis elegans] [db: genpept-inv] [de:caenorhabditis elegans cosmid e01g4, complete sequence.] [le:8150:9988:12303] [re:8254:10515:12659] [di:complement|join] |
| 395130_c3_38 | 2829 | 6483 | 873 | 290 | 136 | 8.50E-07 | [ln:mtcy7h7b] [ac:z95557] [pn:unknown] [gn:mtcy07h7b.19] [or:mycobacterium tuberculosis] [db:genpept-bct] [de:mycobacterium tuberculosis region b of cosmid scy07h7.] [nt:mtcy07h7b.19, unknown, len: 303 aa] [le:15374] [re:16285] [di:direct] |
| 3955063_c3_44 | 2830 | 6484 | 192 | 63 | 63 | 0.79 | [ac:p37388] [gn:xylg] [or:escherichia coli] [de:d-xylose transport atp-binding protein xylg] [sp:p37388] [db:swissprot] |
| 395962_f2_14 | 2831 | 6485 | 522 | 173 | 379 | 4.00E-35 | [ln:isu40482] [ac:u40482] [or:insertion sequence is 1353] [db:genpept-bct] [de:insertion sequence is 1353 orfa and orfb genes, complete cds.] [nt:orfb; possible alternate start site at nt 686] [le:671] [re:1585] [di:direct] |

TABLE 2-continued

| Orf | NT Seq ID | AA Seq ID | NT Orf length | AA Orf length | Score | Probability | Description |
|---|---|---|---|---|---|---|---|
| 3959686_c3_80 | 2832 | 6486 | 975 | 324 | 896 | 6.60E-90 | [ac:p13714] [gn:ldh:lcte] [or:bacillus subtilis] [ec:1.1.1.27] [de:l-lactate dehydrogenase,] [sp:p13714] [db:swissprot] |
| 3960062_c3_36 | 2833 | 6487 | 471 | 156 | 142 | 5.20E-10 | [ln:ae001148] [ac:ae001148:ae000783] [pn:b. burgdorferi predicted coding region bb0426] [gn:bb0426] [or:borrelia burgdorferi] [sr:lyme disease spirochete] [db:genpept-bct] [de:borrelia burgdorferi (section 34 of 70) of the complete genome.] [nt:hypothetic |
| 3960892_c2_44 | 2834 | 6488 | 231 | 76 | 70 | 0.041 | [ac:p35012] [gn:atpg] [or:cyanidium caldarium] [sr:, galdieria sulphuraria] [ec:3.6.1.34] [de:atp synthase b' chain, (subunit ii)] [sp:p35012] [db:swissprot] |
| 3962712_c2_246 | 2835 | 6489 | 942 | 313 | 629 | 1.30E-61 | [ac:o07637] [gn:ylam] [or:bacillus subtilis] [de:hypothetical 34.0 kd protein in npre-pyca intergenic region] [sp:o07637] [db:swissprot] |
| 39818_c1_17 | 2836 | 6490 | 1086 | 361 | 857 | 8.90E-86 | [ac:d70020] [pn:abc transporter (atp-binding protein) homolog yusc] [gn:yusc] [or:bacillus subtilis] [db:pir] |
| 39818_f1_2 | 2837 | 6491 | 1248 | 415 | 1138 | 1.50E-115 | [ac:p39762] [gn:amps] [or:bacillus subtilis] [ec:3.4.11.—] [de:aminopeptidase amps,] [sp:p39762] [db:swissprot] |
| 39818_f3_98 | 2838 | 6492 | 621 | 206 | 386 | 7.30E-36 | [ac:p14194] [gn:ctc] [or:bacillus subtilis] [de:general stress protein ctc] [sp:p14194] [db:swissprot] |
| 399032_c2_14 | 2839 | 6493 | 840 | 279 | 376 | 8.30E-35 | [ac:p10345] [gn:glnp] [or:escherichia coli] [de:glutamine transport system permease protein glnp] [sp:p10345] [db:swissprot] |
| 3992893_f2_25 | 2840 | 6494 | 198 | 65 | 64 | 0.014 | [ac:q60328] [gn:mj0012] [or:methanococcus jannaschii] [de:hypothetical protein mj0012] [sp:q60328] [db:swissprot] |
| 3995288_c1_148 | 2841 | 6495 | 321 | 106 | 429 | 2.00E-40 | [ac:p43455] [gn:ntpg:ntpq] [or:enterococcus hirae] [ec:3.6.1.34] [de:translocating atpase subunit g)] [sp:p43455] [db:swissprot] |
| 400716_c1_28 | 2842 | 6496 | 378 | 125 | 52 | 0.95 | [ac:p16077] [gn:stm:flma] [or:escherichia coli] [de:stable plasmid inheritance protein (f leading maintenance protein)] [sp:p16077] [db:swissprot] |
| 4010937_c2_19 | 2843 | 6497 | 888 | 295 | 1134 | 4.00E-115 | [ac:p42361] [or:streptococcus gordonii challis] [de:29 kd membrane protein in psaa 5'region orf1)] [sp:p42361] [db:swissprot] |
| 401386_f2_12 | 2844 | 6498 | 207 | 68 | 57 | 0.54 | [ln:kpnifh02] [ac:x01007] [or:klebseilla pneumoniae] [db:genpept-bct] [de:klebsiella pneumoniae open reading frame upstream of nifh.] [nt:urf] [sp:p03833] [le:118] [re:501] [di:direct] |
| 4021917_f1_4 | 2845 | 6499 | 189 | 62 | 61 | 0.18 | [ln:af016026] [ac:af016026] [pn:cytochrome oxidase ii] [gn:coii] [or:mitochondrion wasmannia auropunctata] [sr:wasmannia auropunctata] [db:genpept-inv] [de:wasmannia auropunctata cytochrome oxidase i (coi) gene, partial cds; trna-leu gene, complete sequenc |
| 4022268_f2_40 | 2846 | 6500 | 1137 | 378 | 78 | 0.026 | [ac:p75173] [gn:rpso] [or:mycoplasma pneumoniae] [de:30s ribosomal protein s15] [sp:p75173] [db:swissprot] |
| 4022338_f1_23 | 2847 | 6501 | 645 | 214 | 84 | 0.16 | [ln:bbu45423] [ac:u45423] [gn:rep+] [or:borrelia burgdorferi] [sr:lyme disease spirochete strain=297] [db:genpept-bct] [de:borrelia burgdorferi 2.9–3 locus, orf-c gene, partial cds, orf-d, rep+, rep−, and lipoprotein (lp) genes, complete cds.] [nt:repeat m |
| 4023427_c2_60 | 2848 | 6502 | 402 | 133 | 53 | 0.93 | [ln:spu20837] [ac:u20837] [gn:emml] [or:streptococcus pyogenes] [db:genpept-bct] [de:streptococcus pyogenes m type pt5757 (emml) gene, partial cds,] [le:<1] [re: |
| 4023427_c3_47 | 2849 | 6503 | 2418 | 805 | 147 | 2.80E-09 | [ln:llu50902] [ac:u50902] [pn:ltrc] [gn:ltrc] [or:lactococcus lactis] [sr:lactococcus lactis strain=m13] [db:genpept-bct] [de:lactococcus lactis lactis prs01 ltrc (ltre), ltrd (ltrd), ltre (ltre), relaxase (ltrb) and putative maturase (ltra) |

TABLE 2-continued

| Orf | NT Seq ID | AA Seq ID | NT Orf length | AA Orf length | Score | Probability | Description |
|---|---|---|---|---|---|---|---|
| 4023593_c2_78 | 2850 | 6504 | 1248 | 415 | 62 | 0.79 | [ln:hsitgad01] [ac:u40274] [pn:beta-2 integrin alphad subunit [gn:itgad] [or:*homo sapiens*] [sr:human] [db:genpept-pri2] [de:human beta-2 integrin alphad subunit (itgad) gene, partial exons 14 and 15, and partial cds.] [le:<1:190] [re:99: |
| 4026518_c1_55 | 2851 | 6505 | 309 | 102 | 77 | 0.011 | [ac:p33256] [gn:atpf] [or:*mycoplasma gallisepticum*] [ec:3.6.1.34] [de:atp synthase b chain,] [sp:p33256] [db:swissprot] |
| 4027_c3_25 | 2852 | 6506 | 360 | 119 | 189 | 5.50E-15 | [ac:p05650] [gn:yaaa] [or:*bacillus subtilis*] [de:hypothetical 7.9 kd protein in dnan-recf intergenic region] [sp:p05650] [db:swissprot] |
| 403437_f1_1 | 2853 | 6507 | 1848 | 615 | 1368 | 6.30E-140 | [ac:a70023] [pn:oligoendopeptidase homolog yusx] [gn:yusx] [or:*bacillus subtilis*] [db:pir] |
| 4038412_f3_38 | 2854 | 6508 | 288 | 95 | 91 | 0.0022 | [ac:q57986] [gn:mj0566] [or:*methanococcus jannaschii*] [de:ferrous iron transport protein b homolog] [sp:q57986] [db:swissprot] |
| 4042202_c3_47 | 2855 | 6509 | 495 | 164 | 80 | 0.1 | [ac:p25956] [gn:comgd:comg4] [or:*bacillus subtilis*] [de:comg operon protein 4 precursor] [sp:p25956] [db:swissprot] |
| 4062535_c3_197 | 2856 | 6510 | 711 | 236 | 104 | 0.0023 | [ac:s68606:s45085] [pn:hypothetical protein zeta] [or:*streptococcus pyogenes*] [db:pir] |
| 4062767_c1_96 | 2857 | 6511 | 285 | 94 | 130 | 2.60E-08 | [ac:i40868] [pn:hypothetical protein 3] [or:*clostridium perfringens*] [db:pir] |
| 4064078_c3_144 | 2858 | 6512 | 828 | 275 | 81 | 0.0075 | [ln:ss284024] [ac:z84024] [pn:tropomyosin tm30-p1] [or:*sus scrofa*] [sr:pig] [db:genpept-cst8] [de:*s. scrofa* mrna; expressed sequence tag (5'; clone c12c07).] [nt:similar to human tropomyosin tm30-p1] [le:<5] [re:283] [di:direct] |
| 4067277_c2_66 | 2859 | 6513 | 390 | 129 | 88 | 0.014 | [ln:ae001130] [ac:ae001130:ae000783] [pn:protoporphyinogen oxidase, putative] [gn:bb0197] [or:*borrelia burgdorferi*] [sr:lyme disease spirochete] [db:genpept-bct] [de:*borrelia burgdorferi* (section 16 of 70) of the complete genome.] [nt:similar to sp:p4587 |
| 4068750_c3_44 | 2860 | 6514 | 495 | 164 | 66 | 0.12 | [ln:hsker65b] [ac:x05419] [or:*homo sapiens*] [sr:human] [db:genpept-pri1] [de:human dna for 65 kd keratin type ii (exon 2).] [nt:keratin type ii (aa216–289) (2722 is 2nd base in] [sp:p12035] [le:52] [re:272] [di:direct] |
| 406883_c3_6 | 2861 | 6515 | 318 | 106 | 144 | 2.80E-09 | [ac:p71040] [gn:ywne] [or:*bacillus subtilis*] [de:hypothetical 55.8 kd protein in spoiiq-mta intergenic region] [sp:p71040] [db:swissprot] |
| 470317_f3_112 | 2862 | 6516 | 657 | 218 | 106 | 7.70E-06 | [ln:af020798] [ac:af020798] [pn:repressor] [or:*streptococcus thermophilus* bacteriophage tp-j34] [db:genpept] [de:*streptococcus thermophilus* bacteriophage lysogeny module, integrase homolog (int), putative host cell surface-exposed lipoprotein, putative meta |
| 4072187_f3_44 | 2863 | 6517 | 273 | 90 | 56 | 0.49 | [ac:p34674] [gn:zk688.4] [or:*caenorhabditis elegans*] [de:hypothetical 7.8 kd protein zk688.4 in chromosome iii] [sp:p34674] [db:swissprot] |
| 4073875_c3_59 | 2864 | 6518 | 930 | 309 | 129 | 5.00E-08 | [ln:af020798] [ac:af020798] [pn:repressor] [or:*streptococcus thermophilus*] [db:genpept-bct] [de:*streptococcus thermophilus* bacteriophage tp-j34] [db:genpept] [de:*streptococcus thermophilus* bacteriophage lysogeny module, integrasehomolog (int), putative host cell surface-exposed lipoprotein, putative meta |
| 4074027_f2_2 | 2865 | 6519 | 759 | 252 | 393 | 1.30E-36 | [ac:d70044] [pn:transcriptional regulator (gntr family) homolog yvoa] [gn:yvoa] [or:*bacillus subtilis*] [db:pir] |
| 4079635_c2_137 | 2866 | 6520 | 189 | 62 | 124 | 3.20E-07 | [ln:stis11193] [ac:y137l3] [pn:transposase] [or:*streptococcus thermophilus*] [db:genpept-bct] [de:*streptococcus thermophilus* insertion sequence is 1193 transposase gene.] [le:130] [re:1386] [di:direct] |
| 4080326_f1_4 | 2867 | 6521 | 618 | 205 | 95 | 0.0033 | [ln:mtcy78] [ac:z77165] [pn:unknown] [gn:mtcy78.09] [or:*mycobacterium tuberculosis*] [db:genpept-bct] [de:*mycobacterium tuberculosis* cosmid y78.] [nt:mtcy78.09, acetyltransferase, len: 158, highly] [le:7111] [re:7587] [di:direct] |
| 4084568_c2_252 | 2868 | 6522 | 918 | 305 | 555 | 9.00E-54 | [ac:s53879] [pn:hypothetical protein 1] [or:*lactococcus lactis* subsp. *lactis* biovar diacetylactis] [db:pir] |

TABLE 2-continued

| Orf | NT Seq ID | AA Seq ID | NT Orf length | AA Orf length | Score | Probability | Description |
|---|---|---|---|---|---|---|---|
| 4084568_c3_15 | 2869 | 6523 | 705 | 234 | 114 | 0.00013 | [acc:q02150] [or:*lactococcus lactis*] [sr:,subsp:lactis:*streptococcus lactis*] [de:hypothetical 31.3 kd protein in hisic 3'region (orfl3)] [sp:q02150] [db:swissprot] |
| 4084568_c3_19 | 2870 | 6524 | 918 | 305 | 565 | 7.80E-55 | [acs:s53879] [pn:hypothetical protein 1] [or:*lactococcus lactis* subsp. *lactis biovar diacetylactis*] [db:pir] |
| 4084568_c3_22 | 2871 | 6525 | 918 | 305 | 566 | 6.10E-55 | [acs:s53879] [pn:hypothetical protein 1] [or:*lactococcus lactis* subsp. *lactis biovar diacetylactis*] [db:pir] |
| 4084568_c3_55 | 2872 | 6526 | 198 | 66 | 43 | 0.26 | [ln:d88353] [acc:d88353] [pn:nsp4] [or:human rotavirus c] [sr:human rotavirus c (strain:chime9301, specific_host:*homo sapiens*] [db:genpept-vrl] [de:human rotavirus c mrna for nsp4, complete cds.] [le:39] [re:491] [di:direct] |
| 4084568_f1_16 | 2873 | 6527 | 918 | 305 | 566 | 6.10E-55 | [acs:s53879] [pn:hypothetical protein 1] [or:*lactococcus lactis* subsp. *lactis biovar diacetylactis*] [db:pir] |
| 4084568_f2_1 | 2874 | 6528 | 375 | 125 | 138 | 4.50E-09 | [acs:s53879] [pn:hypothetical protein 1] [or:*lactococcus lactis* subsp. *lactis biovar diacetylactis*] [db:pir] |
| 4084568_f2_32 | 2875 | 6529 | 918 | 305 | 567 | 4.80E-55 | [acs:s53879] [pn:hypothetical protein 1] [or:*lactococcus lactis* subsp. *lactis biovar diacetylactis*] [db:pir] |
| 4084568_f3_22 | 2876 | 6530 | 201 | 66 | 94 | 0.00032 | [acs:s53879] [pn:hypothetical protein 1] [or:*lactococcus lactis* subsp. *lactis biovar diacetylactis*] [db:pir] |
| 4084568_f3_35 | 2877 | 6531 | 918 | 305 | 553 | 1.50E-53 | [acs:s53879] [pn:hypothetical protein 1] [or:*lactococcus lactis* subsp. *lactis biovar diacetylactis*] [db:pir] |
| 40932_f1_26 | 2878 | 6532 | 2010 | 669 | 613 | 2.00E-59 | [ln:mmu67916] [acu67916] [pn:dentin sialophosphoprotein precursor] [gn:dspp] [or:*mus musculus*] [sr:house mouse] [db:genpept] [de:*mus musculus* dentin sialophosphoprotein precursor (dspp) mrna, complete cds.] [nt: encodes dentin sialoprotein, dentin phosphop |
| 4094061_f2_17 | 2879 | 6533 | 270 | 89 | 106 | 3.40E-06 | [acc:g64974] [pn:hypothetical protein b2080] [or:*escherichia coli*] [db:pir] |
| 4095463_c1_17 | 2880 | 6534 | 1353 | 450 | 483 | 3.70E-74 | [acs:43914] [pn:hypothetical protein 1] [or:*bacillus stearothermophilus*] [db:pir] |
| 4097077_c2_153 | 2881 | 6535 | 408 | 135 | 57 | 0.6 | [ln:bbu59857] [acu59857] [or:*borrelia burgdorferi*] [sr:lyme disease spirochete] [db:genpept-bct] [de:*borrelia burgdorferi* strain 297 6.6 kda lipoprotein gene, complete cds.] [nt:orf1] [le:408] [re: |
| 4099077_f3_9 | 2882 | 6536 | 687 | 228 | 586 | 4.70E-57 | [acc:69859] [pn:two-component response regulator [ykoh] homolog ykog] [gn:ykog] [or:*bacillus subtilis*] [db:pir] |
| 4100078_c1_43 | 2883 | 6537 | 621 | 206 | 535 | 1.20E-51 | [acs:68609] [pn:recombinase sin] [or:*staphylococcus aureus*] [db:pir] |
| 4100318_c2_48 | 2884 | 6538 | 2367 | 788 | 1968 | 1.70E-203 | [acg:70027] [pn:conserved hypothetical protein yvaj] [gn:yvaj] [or:*bacillus subtilis*] [db:pir] |
| 4101077_c3_78 | 2885 | 6539 | 1008 | 335 | 334 | 2.40E-30 | [ln:u89974] [acc:u89974] [pn:orf31] [or:*streptococcus thermophilus*] [db:genpept-bct] [de:*streptococcus thermophilus* bacteriophage 01205 dna sequence.] [nt:putative structural protein] [le:19121] [re:20167] [di:direct] |
| 4101512_f3_13 | 2886 | 6540 | 324 | 107 | 172 | 1.00E-12 | [ln:tecouw82] [ac:110328] [pn:rbs repressor] [gn:rbsr (cg site no. 12086)] [or:*escherichia coli*] [sr:*escherichia coli* k12 strain mg1655; lambda clones ec14–52] [db:genpept-bct] [de:*e. coli*; the region from 81.5 to 84.5 minutes.] [le:127615] [re:128607] [di |
| 4101561_f2_52 | 2887 | 6541 | 354 | 117 | 88 | 0.001 | [acd:49898] [pn:cellobiose phosphotransferase system celc] [or:*bacillus stearothermophilus*] [db:pir] |
| 4102191_f1_3 | 2888 | 6542 | 978 | 325 | 118 | 0.00025 | [acp:p39835] [gn:gnt:rusga:gntm] [or:*escherichia coli*] [de:system]] [sp:p39835] [db:swissprot] |
| 4102318_c1_21 | 2889 | 6543 | 216 | 71 | 233 | 1.20E-19 | [acs:s05347] [pn:ribosomal protein 135] [gn:rpmi] [cl:*escherichia coli* ribosomal protein 135] [or:*bacillus stearothermophilus*] [db:pir] |

TABLE 2-continued

| Orf | NT Seq ID | AA Seq ID | NT Orf length | AA Orf length | Score | Probability | Description |
|---|---|---|---|---|---|---|---|
| 4103407_c3_25 | 2890 | 6544 | 246 | 81 | 64 | 0.49 | [ln:hau70664] [acc:u70664] [pn:2-keto-3-deoxygluconate kinase] [or:haloferax alicantei] [db:genpept-bct] [de:haloferax alicantei 2-dehydro-3-deoxy-phosphogluconate aldolase,2-keto-3 deoxygluconate kinase, beta-d-galactosidase (bgah) genes, complete cds, and |
| 4103427_f3_14 | 2891 | 6545 | 600 | 199 | 177 | 1.00E-13 | [acc:69833] [pn:conserved hypothetical protein yhje] [gn:yhje] [or:bacillus subtilis] [db:pir] |
| 4103433_c3_104 | 2892 | 6546 | 906 | 301 | 205 | 1.90E-15 | [acc:q04778] [gn:alsr] [or:bacillus subtilis] [de:als operon regulatory protein] [sp:q04778] [db:swissprot] |
| 4103441_c2_46 | 2893 | 6547 | 945 | 314 | 639 | 1.10E-62 | [acc:d69692] [pn:riboflavin kinase/fad synthase ribc] [gn:ribc] [or:bacillus subtilis] [db:pir] |
| 4104682_f2_53 | 2894 | 6548 | 495 | 164 | 346 | 1.30E-31 | [ln:fmu81185] [acc:u81185] [pn:malh] [gn:malh] [or:fusobacterium mortiferum] [db:genpept-bct] [de:fusobacterium mortiferum maltose permease iib subunit (malh) gene, partial cds, and maltose 6-p hydrolase (malh) gene, complete cds.] [nt:6-phospho-alpha-gluco |
| 4105462_c2_119 | 2895 | 6549 | 1605 | 534 | 172 | 1.50E-09 | [ln:hsu29343] [acc:u29343] [pn:hyaluronan receptor] [gn:rhamm] [or:homo sapiens] [sr:human] [db:genpept-pri2] [de:humanhyaluronan receptor (rhamm) mrna, complete cds.] [le:110] [re:2287] [di:direct] |
| 4109452_c1_47 | 2896 | 6550 | 1107 | 368 | 98 | 3.90E-05 | [acc:a69017] [pn:dihydroorotase] [gn:mth1127] [or:methanobacterium thermoautotrophicum] [db:pir] |
| 4110932_c3_263 | 2897 | 6551 | 429 | 142 | 264 | 6.20E-23 | [ln:cbaj2527] [acc:aj002527] [pn:gutb] [gn:gutb] [fn:enzyme iiagut] [or:clostridium beijerinckii] [db:genpept-bct] [de:clostridium beijerinckii glucitol transport gene system.] [le:2578] [re:2946] [di:direct] |
| 4110943_c3_94 | 2898 | 6552 | 273 | 90 | 76 | 0.055 | [ln:llu74322] [acc:u74322] [pn:6-phosphogluconate dhydrogenase] [or:lactococcus lactis] [db:genpept-bct] [ec:1.1.1.44] [de:lactococcus lactis 6-phosphogluconate dehydrogenase gene, complete cds, and potassium transporter homolog gene, partial cds.] [le:898 |
| 4110952_c1_16 | 2899 | 6553 | 714 | 237 | 292 | 6.60E-26 | [acc:45514] [gn:sapb] [or:bacillus subtilis] [de:sapb protein] [sp:q45514] [db:swissprot] |
| 4114041_c3_24 | 2900 | 6554 | 2166 | 722 | 2512 | 3.80E-261 | [acc:p13267] [gn:polc:dnae:dnaf:muti] [or:bacillus subtilis] [ec:2.7.7.7] [de:dna polymerase iii, alpha chain,] [sp:p13267] [db:swissprot] |
| 4114137_f3_150 | 2901 | 6555 | 528 | 175 | 105 | 0.00014 | [acc:g69518] [pn:isochorismatase (entb) homolog] [or:archaeoglobus fulgidus] [db:pir] |
| 4114192_c2_47 | 2902 | 6556 | 270 | 89 | 173 | 2.70E-13 | [acc:a70028] [pn:hypothetical protein yval] [gn:yval] [or:bacillus subtilis] [db:pir] |
| 4117143_f2_2 | 2903 | 6557 | 810 | 269 | 575 | 2.00E-55 | [ln:llu78771] [acc:u78771] [pn:dna polymerase i (poli)] [gn:pola] [fn:protein implicated in dna repair and plasmid] [or:lactococcus lactis] [db:genpept-bct] [de:lactococcus lactis dna polymerase i (pola) gene, complete cds.] [le:504] [re:3137] [di:direct] |
| 4117875_f2_13 | 2904 | 6558 | 645 | 214 | 93 | 0.0041 | [ln:tbu01849] [acc:u01849] [gn:cr4] [or:kinetoplast trypanosoma brucei] [sr:trypanosoma brucei] [db:genpept-inv] [de:trypanosoma brucei catro 164 kinetoplast (cr4) mrna, complete cds.] [nt:orf1] [le:148] [re:588] [di:direct] |
| 4119203_c1_9 | 2905 | 6559 | 1539 | 512 | 1653 | 4.00E-170 | [acc:p26829] [gn:ahpf:ndh] [or:bacillus sp] [sr:yn−1,] [ec:1.6.99.3] [de:nadh dehydrogenase, (alkyl hydroperoxide reductase)] [sp:p26829] [db:swissprot] |
| 4120393_c1_49 | 2906 | 6560 | 519 | 172 | 86 | 0.00075 | [acc:q09411] [gn:k10d2.5] [or:caenorhabditis elegans] [de:hypothetical 13.8 kd protein k10d2.5 in chromosome iii] [sp:q09411] [db:swissprot] |
| 4121077_c1_30 | 2907 | 6561 | 804 | 267 | 536 | 9.30E-52 | [acc:p37522] [gn:soj] [or:bacillus subtilis] [de:soj protein] [sp:p37522] [db:swissprot] |

TABLE 2-continued

| Orf | NT Seq ID | AA Seq ID | NT Orf length | AA Orf length | Score | Probability | Description |
|---|---|---|---|---|---|---|---|
| 4144000_c2_66 | 2908 | 6562 | 1584 | 527 | 1307 | 1.80E-133 | [ac:p35854] [gn:dlt:dae] [or:*lactobacillus casei*] [ec:6.3.2.—] [de:carrier protein ligase) (dcl)] [sp:p35854] [db:swissprot] |
| 4148593_f1_7 | 2909 | 6563 | 1227 | 408 | 589 | 2.20E-57 | [ac:b70065] [pn:antibiotic resistance protein homolog ywog] [gn:ywog] [or:*bacillus subtilis*] [db:pir] |
| 4149013_f1_2 | 2910 | 6564 | 537 | 178 | 506 | 1.40E-48 | [ac:d69840] [pn:conserved hypothetical protein yitk] [gn:yitk] [or:*bacillus subtilis*] [db:pir] |
| 4149086_c2_54 | 2911 | 6565 | 258 | 85 | 67 | 0.14 | [ln:jrabla] [acx97853] [pn:rabla] [gn:rabla] [fn:gtp-binding protein] [or:*lotus japonicus*] [db:genpept-pln] [de:*l. japonicus* mrna for small gtp-binding protein rabla.] [le:129] [re:734] [di:direct] |
| 4160135_c3_108 | 2912 | 6566 | 216 | 71 | 71 | 0.017 | [ac:s67091] [pn:probable membrane protein yor199w:hypothetical protein o4821] [or:*saccharomyces cerevisiae*] [db:pir] [mp:15r] |
| 4161578_f3_28 | 2913 | 6567 | 537 | 178 | 637 | 1.80E-62 | [ac:p02391] [gn:rplf] [or:*bacillus stearothermophilus*] [de:50s ribosomal protein 16 (b110)] [sp:p02391] [db:swissprot] |
| 4179558_f3_27 | 2914 | 6568 | 585 | 194 | 134 | 3.70E-09 | [ac:s77054] [pn:hypothetical protein] [or:synechocystis sp.] [sr:pcc 6803, , pcc 6803,] [db:pir] |
| 4180262_c3_28 | 2915 | 6569 | 1173 | 390 | 705 | 1.10E-69 | [ac:g70007] [pn:conserved hypothetical protein yuef] [gn:yuef] [or:*bacillus subtilis*] [db:pir] |
| 4182713_c3_18 | 2916 | 6570 | 606 | 202 | 62 | 0.42 | [ac:s74972] [pn:virulence-associated protein vapc;protein ss12923;protein ss12923] [gn:vapc] [cl:virulence-associated protein vapc] [or:synechocystis sp.] [sr:pcc 6803, , pcc6803,] [db:pir] |
| 4182812_c1_23 | 2917 | 6571 | 390 | 129 | 410 | 2.10E-38 | [ln:ab000631] [ac:ab000631] [or:*streptococcus mutans*] [sr:*streptococcus mutans* dna] [db:genpept-bct] [de:*streptococcus mutans* dna for sigma 42 protein,dtdp-4-keto-1-rhamnose reductase, complete cds.] [nt:unnamed protein product] [le:1869] [re:2204] [di:di |
| 4183192_c1_43 | 2918 | 6572 | 198 | 65 | 64 | 0.18 | [ln:af015672] [ac:af015672] [pn:virulence determinant] [gn:uk] [or:african swine fever virus] [db:genpept] [de:african swine fever virus isolate haiti virulence determinant (uk)gene, complete cds.] [le:18] [re:488] [di:direct] |
| 4183427_f3_51 | 2919 | 6573 | 318 | 105 | 87 | 0.011 | [ln:rndrpla] [ac:x89453] [gn:drpla] [or:*rattus norvegicus*] [sr:norway rat] [db:genpept-rod] [de:*r. norvegicus* mrna for drpla protein.] [le:120] [re:3668] [di:direct] |
| 4187943_c2_30 | 2920 | 6574 | 1278 | 425 | 1236 | 6.20E-126 | [ac:p54596] [gn:yhcl] [or:*bacillus subtilis*] [de:hypothetical 49.0 kd protein in cspb-glpp intergenic region] [sp:p54596] [db:swissprot] |
| 4188750_f3_35 | 2921 | 6575 | 588 | 195 | 104 | 0.0011 | [ac:q49414] [gn:mg313] [or:*mycoplasma genitalium*] [de:hypothetical protein mg313] [sp:q49414] [db:swissprot] |
| 4189030_c3_38 | 2922 | 6576 | 195 | 64 | 70 | 0.022 | [ac:p37450] [gn:pduc] [or:*salmonella typhimurium*] [ec:4.2.1.30] [de:glycerol dehydratase, (fragment)] [sp:p37450] [db:swissprot] |
| 4192577_c3_10 | 2923 | 6577 | 1896 | 631 | 1162 | 4.30E-118 | [ac:h69590] [pn:asparagine synthetase asnb] [gn:asnb] [or:*bacillus subtilis*] [db:pir] |
| 4194706_c3_42 | 2924 | 6578 | 477 | 158 | 533 | 1.90E-51 | [ac:q47746] [gn:vanyb] [or:*enterococcus faecalis*] [sr:,*streptococcus faecalis*] [ec:3.4.16.4] [de:(dd-carboxypeptidase)] [sp:q47746] [db:swissprot] |
| 4195137_c2_52 | 2925 | 6579 | 204 | 67 | 66 | 0.48 | [ac:s39079] [pn:puff c-8 protein] [or:*rhynchosciara americana*] [db:pir] |
| 4195137_c3_70 |  | 6580 | 360 | 119 | 191 | 3.40E-15 | [ac:h69773] [pn:conserved hypothetical protein ydck] [gn:ydck] [or:*bacillus subtilis*] [db:pir] |
| 4195137_f1_19 | 2927 | 6581 | 456 | 151 | 86 | 0.28 | [ln:rdu36563] [ac:u36563] [pn:viral structural protein] [or:rice dwarf virus] [sr:rice dwarf virus strain=chinese strain] [db:genpept-vrl] [de:rice dwarf virus structural protein mrna, complete cds.] [le:22] [re:2427] [di:direct] |
| 4195137_f2_27 | 2928 | 6582 | 249 | 82 | 74 | 0.044 | [ac:s54157] [pn:extensin-like protein] [or:*vigna unguiculata*] [sr:, cowpea] [db:pir] |

TABLE 2-continued

| Orf | NT Seq ID | AA Seq ID | NT Orf length | AA Orf length | Score | Probability | Description |
|---|---|---|---|---|---|---|---|
| 4195187_f2_13 | 2929 | 6583 | 714 | 237 | 293 | 5.20E-26 | [ac:f70023] [pn:hypothetical protein yutd] [gn:yutd] [or:*bacillus subtilis*] [db:pir] |
| 4195436_f1_1 | 2930 | 6584 | 615 | 204 | 100 | 0.0011 | [ac:s76927] [pn:hypothetical protein] [or:synechocystis sp.] [sr:pcc 6803, , pcc 6803, ] [db:pir] |
| 4195438_f1_3 | 2931 | 6585 | 918 | 305 | 211 | 2.50E-17 | [ac:p26833] [or:*clostridium perfringens*] [de:hypothetical 31.2 kd protein in nagh 5'region (orfb)] [sp:p26833] [db:swissprot] |
| 4196052_c2_17 | 2932 | 6586 | 1005 | 334 | 655 | 2.30E-64 | [ac:p08186] [gn:manx:ptsl:gptb] [or:*escherichia coli*] [ec:2.7.1.69] [de:(ec 2.7.1.69) (ciii-man)] [sp:p08186] [db:swissprot] |
| 421937_f2_14 | 2933 | 6587 | 1779 | 592 | 1332 | 4.10E-136 | [ac:jc0043:s51115] [pn:adenine deaminase,] [gn:ade] [or:*bacillus subtilis*] [ec:3.5.4.2] [db:pir] |
| 422550_c3_144 | 2934 | 6588 | 189 | 62 | 61 | 0.65 | [ln:hiu32842] [ac:u32842:142023] [pn:lsg locus hypothetical] [gn:hi1697] [or:*haemophilus influenzae*] [db:genpept-bct] [de:*haemophilus influenzae* from bases 1758573 to 1770233 (section 157 of 163) of the complete genome.] [nt:similar to gb:m94855_4 percent |
| 42286_f2_12 | 2935 | 6589 | 423 | 140 | 560 | 2.70E-54 | [ac:p12875] [gn:rpln] [or:*bacillus subtilis*] [de:50s ribosomal protein l14] [sp:p12875] [db:swissprot] |
| 42342_f3_14 | 2936 | 6590 | 1098 | 365 | 137 | 7.60E-13 | [ac:q58487] [gn:mj1087] [or:*methanococcus jannaschii*] [ec:2.7.1.36] [de:mevalonate kinase, (mk)] [sp:q58487] [db:swissprot] |
| 423438_f1_3 | 2937 | 6591 | 396 | 131 | 674 | 2.20E-66 | [ac:p19775] [gn:tnp] [or:*staphylococcus aureus*] [de:transposase for insertion sequence element is 256 in transposon tn4001] [sp:p19775] [db:swissprot] |
| 423838_c1_99 | 2938 | 6592 | 1605 | 534 | 1640 | 9.50E-169 | [ln:af034786] [ac:af034786] [pn:modification subunit] [gn:hsdm] [fn:lldi type i restriction modification] [or:*lactococcus lactis* bv. *diacetylactis*] [db:genpept-bct] [de:*lactococcus lactis* bv. *diacetylactis*, plasmid pnd861, lldi type restriction subunit ( |
| 423838_f3_22 | 2939 | 6593 | 1608 | 535 | 1636 | 2.50E-168 | [ln:af034786] [ac:af034786] [pn:modification subunit] [gn:hsdm] [fn:lldi type i restriction modification] [or:*lactococcus lactis* bv. *diacetylactis*] [db:genpept-bct] [de:*lactococcus lactis* bv. *diacetylactis*, plasmid pnd861, lldi type restriction subunit ( |
| 424092_c2_130 | 2940 | 6594 | 291 | 96 | 76 | 0.021 | [ln:af007380] [ac:af007380] [pn:lambda phage h tail component homolog] [or:*salmonella typhimurium*] [db:genpept-bct] [de:*salmonella typhimurium* lambda phage k tail component homolog gene, partial cds, lambda phage 1 tail component homolog, copper-zinc supero |
| 428383_f2_4 | 2941 | 6595 | 540 | 179 | 322 | 4.40E-29 | [ac:p36088] [gn:yk1069w:yk1340] [or:*saccharomyces cerevisiae*] [sr:baker's yeast] [de:hypothetical 19.7 kd protein in lhs1-nup100 intergenic region] [sp:p36088] [db:swissprot] |
| 4296961_f3_54 | 2942 | 6596 | 333 | 110 | 141 | 6.70E-10 | [ln:cesgtsggp] [ac:x85757] [pn:unknown] [gn:internal of g1669] [or:*saccharomyces cerevisiae*] [sr:baker's yeast] [db:genpept-pln] [de:*s. cerevisiae* g1651, g1654, trna-lys1, sua5, pmr1, g1667, & g1669 genes.] [ie:6964] [re:77365] |
| 4298467_f3_24 | 2943 | 6597 | 783 | 260 | 76 | 0.024 | [ln:ab001684] [ac:ab001684] [gn:tmv] [or:chloroplast *chlorella vulgaris*] [sr:*chorella vulgaris* chloroplast dna] [db:genpept-pln] [de:*chlorella vulgaris* c-27 chloroplast dna, complete sequence,] [nt:orf67] [ie:53481] [re:53684] [di:direct] |
| 4300040_c3_86 | 2944 | 6598 | 249 | 82 | 61 | 0.052 | [ac:p73530] [gn:rpslaxslr1356] [or:synechocystis sp] [sr:pcc 6803.] [de:30s ribosomal protein s1 homolog a] [sp:p73530] [db:swissprot] |
| 430375_c3_35 | 2945 | 6599 | 747 | 248 | 398 | 3.90E-37 | [ac:s42932] [pn:probable transmembrane protein smpb] [gn:smpb] [or:*staphylococcus hominis*] [db:pir] |

TABLE 2-continued

| Orf | NT Seq ID | AA Seq ID | NT Orf length | AA Orf length | Score | Probability | Description |
|---|---|---|---|---|---|---|---|
| 4303927_c1_54 | 2946 | 6600 | 345 | 114 | 239 | 2.70E-20 | [ln:bc09719] [acc:y09719] [pn:putative glutamate racemase protein] [gn:glr] [or:bacillus cereus] [db:genpept-bct] [de:b. cereus bct1 gene and glr gene.] [le:1655] [re:2464] [di:direct] |
| 4307062_c2_45 | 2947 | 6601 | 1014 | 337 | 766 | 3.90E-76 | [ac:g69726] [pn:trma pseudouridine 5s synthase trub] [gn:trub] [or:bacillus subtilis] [db:pir] |
| 4312818_f1_37 | 2948 | 6602 | 858 | 285 | 398 | 3.90E-37 | [acc:p44540] [gn:hi0143] [or:haemophilus influenzae] [de:hypothetical protein hi0143] [sp:p44540] [db:swissprot] |
| 4313787_c1_9 | 2949 | 6603 | 183 | 60 | 60 | 0.0069 | [ln:af012247] [ac:af012247] [gn:urfz] [or:mitochondrion physarum polycephalum] [sr:slime mold] [db:genpept-inv] [de:physarum polycephalum strain m3 region of mitochondria containing similarity to mf plasmid, urfx gene, partial cds, urfy gene, complete cds. |
| 4313886_f3_134 | 2950 | 6604 | 231 | 76 | 56 | 0.76 | [ln:bpcplxx1] [acc:47794] [gn:orff] [fn:unknown] [or:bacteriophage cp-1] [db:genpept-phg] [de:bacteriophage cp-1 dna, complete genome,] [le:5976] [re:6419] [di:complement] |
| 4328201_f3_12 | 2951 | 6605 | 471 | 156 | 262 | 1.00E-22 | [acc:p52309] [or:listeria monocytogenes] [de:hypothetical 17.1 kd protein in dnag/dnac 5'region (p17)] [sp:p52309] [db:swissprot] |
| 4329201_f1_21 | 2952 | 6606 | 201 | 66 | 59 | 0.28 | [ln:psdnabfru] [acx85328] [pn:invertase] [gn:bfruct1] [fn:hydrlyze sucrose into fructose and glucose] [or:pisum sativum] [sr:pea] [db:genpept-pln] [ec:3.2.1.26] [de:p. sativum bfruct 1 gene.] [nt:beta-fructofuranosidase] [le:2130:2416:2688] [re:2310:2424 |
| 433438_c1_45 | 2953 | 6607 | 1047 | 348 | 513 | 2.50E-49 | [acc:p40681] [gn:galm] [or:escherichia coli] [ec:5.1.3.3] [de:aldose 1-epimerase, (mutarotase)] [sp:p40681] [db:swissprot] |
| 4335963_c1_98 | 2954 | 6608 | 360 | 119 | 65 | 0.073 | [ac:o10371] [or:orgyia pseudotsugata multicapsid polyhedrosis virus] [sr, opmnpv] [de:occlusion-derived virus envelope protein e18 (odv-e18] [sp:o10371] [db:swissprot] |
| 4336082_c3_67 | 2955 | 6609 | 1092 | 363 | 1061 | 2.20E-107 | [ac:f69786] [pn:glycoprotein endopeptidase homolog ydie] [or:bacillus subtilis] [db:pir] |
| 4336088_f1_1 | 2956 | 6610 | 366 | 121 | 366 | 9.60E-34 | [acc:p54457] [gn:yqel] [or:bacillus subtilis] [de:hypothetical 13.3 kd protein in arod-corner intergenic region] [sp:p54457] [db:swissprot] |
| 4337563_c1_21 | 2957 | 6611 | 627 | 208 | 422 | 1.10E-39 | [ac:h70006] [pn:n-acetylmuramoyl-1-alanine amidase homolog yube] [gn:yube] [or:bacillus subtilis] [db:pir] |
| 4339213_c1_40 | 2958 | 6612 | 663 | 220 | 232 | 1.50E-19 | [acc:q94529:o02536] [gn:gsll] [or:drosophila melanogaster] [sr:fruit fly] [de:gs1-like protein] [sp:q94529:o02536] [db:swissprot] |
| 4345686_f1_1 | 2959 | 6613 | 684 | 227 | 120 | 1.40E-05 | [ln:mtcy8d5] [acc:292669] [pn:probable regulatory protein] [gn:mtcy08d5.28] [or:mycobacterium tuberculosis] [db:genpept-bct] [de:mycobacterium tuberculosis cosmid scy08d5.] [nt:mtcy08d5.28, probable regulatory protein, len: 229] [le:32828] [re:33517] [di:d |
| 4347501_f1_6 | 2960 | 6614 | 345 | 114 | 75 | 0.9 | [ln:xlu37373] [acc:u37373] [gn:gene 5] [or:xenopus laevis] [sr:african clawed frog] [db:genpept-vrt] [de:xenopus laevis tail-specific thyroid hormone up-regulated (gene 5) mrna, complete cds.] [nt:up-regulated by thyroid hormone in tadpoles;] [le:4] [re:299 |
| 4351432_f1_3 | 2961 | 6615 | 1168 | 390 | 1208 | 5.70E-123 | [acc:p27451] [gn:int] [or:streptococcus pneumoniae] [de:transposase (integrase) (transposon tn1545)] [sp:p27451] [db:swissprot] |
| 4375211_f2_7 | 2962 | 6616 | 594 | 197 | 191 | 3.40E-15 | [acc:p51561] [gn:tetr] [or:pasteurella multocida] [de:tetracycline repressor protein class h] [sp:p51561] [db:swissprot] |
| 4376342_f3_24 | 2963 | 6617 | 441 | 146 | 255 | 5.50E-22 | [acc:p46319] [gn:celc] [or:bacillus subtilis] [sp:p46319] [db:swissprot] [de:(ec 2.7.1.69) (ciii-cel)] |
| 4380_f1_2 | 2964 | 6618 | 402 | 133 | 186 | 1.10E-14 | [acc:p42248] [gn:ycbp] [or:bacillus subtilis] [de:hypothetical 14.1 kd protein in pcp 5'region (orf15)] [sp:p42248] [db:swissprot] |

TABLE 2-continued

| Orf | NT Seq ID | AA Seq ID | NT Orf length | AA Orf length | Score | Probability | Description |
|---|---|---|---|---|---|---|---|
| 4395333_c2_28 | 2965 | 6619 | 903 | 301 | 298 | 1.50E-25 | [ac:h69724] [pn:dna topoisomerase iii topb] [gn:topb] [or:bacillus subtilis] [db:pir] |
| 4398544_c2_6 | 2966 | 6620 | 221 | 73 | 59 | 0.054 | [ln:cel f41c3] [ac:u23521] [gn:f41c3.8] [or:caenorhabditis elegans] [sr:caenorhabditis elegans strain=bristol n2] [db:genpept-inv] [de:caenorhabditis elegans cosmid f41c3,] [le:2330:2705:2844:3191] [re:2406:2788:3136:3564] [di:direct join] |
| 4414077_f1_7 | 2967 | 6621 | 939 | 312 | 95 | 0.15 | [ac:p43556] [gn:yfl047w] [or:saccharomyces cerevisiae] [sr:baker's yeast] [de:hypothetical 82.2 kd protein in cmp47-sec53 intergenic region] [sp:p43556] [db:swissprot] |
| 4414561_c3_55 | 2968 | 6622 | 531 | 176 | 376 | 8.30E-35 | [ac:p94462] [gn:def] [or:bacillus subtilis] [ec:3.5.1.31] [de:deformylase] [sp:p94462] [db:swissprot] |
| 4415893_c3_10 | 2969 | 6623 | 243 | 80 | 63 | 0.12 | [ac:c69815] [pn:hypothetical protein ygab] [gn:ygab] [or:bacillus subtilis] [db:pir] |
| 4416068_c1_50 | 2970 | 6624 | 366 | 122 | 225 | 8.40E-19 | [ac:p54455] [gn:yqej] [or:bacillus subtilis] [de:hypothetical 22.2 kd protein in arod-comer intergenic region] [sp:p54455] [db:swissprot] |
| 4423430_c3_36 | 2971 | 6625 | 468 | 155 | 300 | 9.40E-27 | [ln:lgapfa] [ac:y08498] [pn:aggregation promoting protein] [gn:apfa] [or:lactobacillus gasseri] [de:l. gasseri apfa gene.] [le:125] [re:1018] [di:direct] |
| 4428777_c1_28 | 2972 | 6626 | 270 | 89 | 286 | 2.90E-25 | [ac:p20384] [gn:bin3] [or:staphylococcus aureus] [de:potential dna-invertase bin3 (transposon tn552)] [sp:p20384] [db:swissprot] |
| 4430443_f2_7 | 2973 | 6627 | 1647 | 548 | 117 | 0.00085 | [ac:p13735] [or:trypanosoma brucei] [ec:4.1.1.49] [de:(glycosomal protein p60)] [sp:p13735] [db:swissprot] |
| 4460937_f2_1 | 2974 | 6628 | 642 | 213 | 106 | 0.00055 | [ac:p43221] [gn:tlpa] [or:bradyrhizobium japonicum] [de:protein tlpa)] [sp:p43221] [db:swissprot] |
| 4472963_c1_22 | 2975 | 6629 | 927 | 308 | 1119 | 1.50E-113 | [ac:p56067] [gn:cysk:hp0107] [or:helicobacter pylori] [sr:campylobacter pylori] [ec:4.2.99.8] [de:(o-acetylserine (thiol)-lyase) (csase)] [sp:p56067] [db:swissprot] |
| 4477177_f2_99 | 2976 | 6630 | 309 | 102 | 70 | 0.23 | [ac:p53880] [gn:yn1179:cn1648] [or:saccharomyces cerevisiae] [sr:baker's yeast] [de:hypothetical 17.6 kd protein in npr1-rps3 intergenic region] [sp:p53880] [db:swissprot] |
| 4480311_f1_39 | 2977 | 6631 | 948 | 315 | 242 | 9.90E-20 | [ac:p23545] [gn:phor] [or:bacillus subtilis] [ec:2.7.3.—] [de:alkaline phosphatase synthesis sensor protein phor,] [sp:p23545] [db:swissprot] |
| 4489213_c2_26 | 2978 | 6632 | 1347 | 448 | 1615 | 1.00E-169 | [ac:f69729] [pn:exinuclease abc (subunit a) uvra] [gn:uvra] [or:bacillus subtilis] [db:pir] |
| 4490840_c3_26 | 2979 | 6633 | 1284 | 427 | 272 | 9.90E-21 | [ac:s75806] [pn:hypothetical protein] [cl:unassigned atp-binding cassette proteins:malk protein homology] [or:synechocystis sp.] [sr:pcc 6803, , pcc 6803) sr:pcc 6803, ] [db:pir] |
| 4490930_c3_71 | 2980 | 6634 | 723 | 240 | 270 | 1.40E-23 | [ac:p54179] [gn:ypms] [or:bacillus subtilis] [de:hypothetical 21.1 kd protein in ilva 3'region] [sp:p54179] [db:swissprot] |
| 4491683_c2_77 | 2981 | 6635 | 1008 | 335 | 907 | 4.50E-91 | [ac:a69653] [pn:transmembrane lipoprotein lplb] [gn:lplb] [or:bacillus subtilis] [db:pir] |
| 4492202_c3_155 | 2982 | 6636 | 447 | 148 | 93 | 0.031 | [ln:mhu21963] [ac:u21963] [pn:lmpl] [gn:lmpl] [or:mycoplasma hominis] [db:genpept-bct] [de:mycoplasma hominis mh81 lmpl (lmpl) gene, complete cds.] [le:171] [re:2321] [di:direct] |
| 4492943_f3_6 | 2983 | 6637 | 939 | 312 | 894 | 1.10E-89 | [ac:p77883] [gn:pyrb] [or:lactobacillus plantarum] [ec:2.1.3.2] [de:transcarbamylase) (atcase)] [sp:p77883] [db:swissprot] |
| 4494030_c1_25 | 2984 | 6638 | 450 | 149 | 147 | 1.00E-13 | [ac:p47472] [gn:mrdi:mg230] [or:mycoplasma genitalium] [de:nrdi protein] [sp:p47472] [db:swissprot] |

TABLE 2-continued

| Orf | NT Seq ID | AA Seq ID | NT Orf length | AA Orf length | Score | Probability | Description |
|---|---|---|---|---|---|---|---|
| 4494812_c1_36 | 2985 | 6639 | 2328 | 775 | 2539 | 5.20E-264 | [ln:bsu86377] [ac:u86377] [pn:(p)ppgpp synthetase] [gn:rcla] [or:*bacillus subtilis*] [db:genpept-bct] [de:*bacillus subtilis* (p)ppgpp synthetase (rela) and adeninephosphoribosyltransferase (apt) genes, complete cds.] [nt:allele: spot; rela] [le:902] [re:310 |
| 4496068_c3_67 | 2986 | 6640 | 1896 | 631 | 1542 | 2.30E-158 | [ac:a69814] [pn:abc transporter (atp-binding protein) homolog yfmr] [gn:yfmr] [or:*bacillus subtilis*] [db:pir] |
| 4501075_c3_56 | 2987 | 6641 | 549 | 182 | 101 | 0.0056 | [ac:p02977] [gn:emm5:smp5] [or:*streptococcus pyogenes*] [de:m protein, serotype 5 precursor] [sp:p02977] [db:swissprot] |
| 4508392_f1_8 | 2988 | 6642 | 1251 | 416 | 1069 | 3.10E-108 | [ac:p37535] [gn:yaan] [or:*bacillus subtilis*] [de:hypothetical 43.8 kd protein in xpac-abtb intergenic region] [sp:p37535] [db:swissprot] |
| 4534441_f2_52 | 2989 | 6643 | 951 | 316 | 563 | 1.30E-54 | [ln:atceld] [ac:z77855] [pn:sugar-binding transport protein] [or:*anaerocellum thermophilum*] [db:genpept-bct] [de:*a. thermophilum* celd gene.] [nt:putative] [le:3925] [re:4836] [di:direct] |
| 4538201_f3_27 | 2990 | 6644 | 1449 | 482 | 812 | 5.20E-81 | [ac:p40739] [gn:bglp:n17c] [or:*bacillus subtilis*] [ec:2.7.1.69] [de:enzyme ii, abc component), (eii-bgl)] [sp:p40739] [db:swissprot] |
| 4555406_f2_2 | 2991 | 6645 | 1080 | 359 | 1137 | 1.90E-115 | [ln:lacals] [ac:l16975] [pn:alpha-acetolactate synthase] [gn:als] [or:*lactococcus lactis*] [sr:*lactococcus lactis* (strain dsm 20384, sub_species *lactis*) dna] [db:genpept-bct] [de:*lactococcus lactis* alpha-acetolactate synthase (als) gene, complete cds.] [le: |
| 4567318_c2_56 | 2992 | 6646 | 537 | 178 | 354 | 1.80E-32 | [ac:p54452] [gn:yqeg] [or:*bacillus subtilis*] [de:hypothetical 20.1 kd protein in nucb-arod intergenic region] [sp:p54452] [db:swissprot] |
| 4578937_c2_44 | 2993 | 6647 | 276 | 91 | 78 | 0.019 | [ln:ae001122] [ac:ae001122:ac000783] [pn:conserved hypothetical protein] [gn:bb0099] [or:*borrelia burgdorferi*] [sr:lyme disease spirochete] [db:genpept-bct] [de:*borrelia burgdorferi* (section 8 of 70) of the complete genome.] [nt:similar to gb:142023 sp:p4 |
| 4579702_c1_12 | 2994 | 6648 | 243 | 80 | 73 | 0.023 | [ln:ecomukef] [ac:d26440] [pn:hypothetical protein] [or:*escherichia coli*] [sr:*escherichia coli* (sub_strain w3110, strain k-12) dna] [db:genpept-bct] [de:*escherichia coli* genes for smta, mukf, muke (complete cds) and gene for mukb (partial cds).] [le:<1] [r |
| 4579702_c2_40 | 2995 | 6649 | 243 | 80 | 73 | 0.023 | [ln:ecomukef] [ac:d26440] [pn:hypothetical protein] [or:*escherichia coli*] [sr:*escherichia coli* (sub_strain w3110, strain k-12) dna] [db:genpept-bct] [de:*escherichia coli* genes for smta, mukf, muke (complete cds) and gene for mukb (partial cds).] [le:<1] [r |
| 4584687_f3_39 | 2996 | 6650 | 234 | 77 | 59 | 0.28 | [ac:p17592] [or:human adenovirus type 7] [de:early e3 7.7 kd protein] [sp:p17592] [db:swissprot] |
| 4586067_c3_194 | 2997 | 6651 | 1119 | 372 | 1206 | 9.30E-123 | [ln:silct] [ac:y07622] [pn:lactate oxidase] [gn:lcto] [fn:lactate utilisation] [or:*streptococcus iniac*] [db:genpept-bct] [de:*s. iniac* lctp & lcto genes and orf1.] [le:2763] [re:3974] [di:direct] |
| 4586642_c1_62 | 2998 | 6652 | 1356 | 451 | 419 | 2.30E-39 | [ac:p27644] [gn:pgl] [or:*agrobacterium tumefaciens*] [ec:3.2.1.15] [de:polygalacturonase, (pectinase) (pgl)] [sp:p27644] [db:swissprot] |
| 4586688_c2_12 | 2999 | 6653 | 528 | 175 | 161 | 5.10E-12 | [ln:smu75471] [ac:u75471] [pn:high affinity branched chain amino acid] [gn:livg] [or:*streptococcus mutans*] [db:genpept-bct] [de:*streptococcus mutans* putative high affinity branched chain aminoacid transport protein (livg) gene, partial cds.] [le:<1] [re: |
| 4687552_f1_15 | 3000 | 6654 | 201 | 66 | 58 | 0.58 | [ac:p14369] [or:fowlpox virus] [sr:,isolate hp-438[munich]] [de:antithrombin-iii homolog] [sp:p14369] [db:swissprot] |
| 4687827_c2_24 | 3001 | 6655 | 516 | 171 | 145 | 2.50E-10 | [ac:b69048] [pn:hypothetical protein mth1362] [gn:mth1362] [or:*methanobacterium thermoautotrophicum*] [db:pir] |

TABLE 2-continued

| Orf | NT Seq ID | AA Seq ID | NT Orf length | AA Orf length | Score | Probability | Description |
|---|---|---|---|---|---|---|---|
| 4688778_c2_151 | 3002 | 6656 | 1890 | 629 | 1225 | 9.00E-125 | [ln:cdiiorf] [ac:x98606] [or:clostridium difficile] [db:genpept-bct] [de:c. difficile transposon group ii intron with potential coding region.] [nt: potential coding region] [le:742] [re:2571] [di:direct] |
| 4688818_c1_42 | 3003 | 6657 | 600 | 199 | 432 | 9.70E-41 | [ac:p43711] [gn:fabh:hi0157] [or:haemophilus influenzae] [db:swissprot] [de:ketoacyl-acp synthase iii) (kas iii)] [sp:p43711] |
| 4692338_f3_4 | 3004 | 6658 | 1326 | 441 | 1557 | 5.90E-160 | [ac:p20964] [gn:obg] [or:bacillus subtilis] [de:spo0b-associated gtp-binding protein] [sp:p20964] [db:swissprot] |
| 4693967_c1_29 | 3005 | 6659 | 429 | 142 | 374 | 1.40E-34 | [ac:p19079] [gn:cdd] [or:bacillus subtilis] [ec:3.5.4.5] [de:cytidine deaminase, (cytidine aminohydrolase) (cda)] [sp:p19079] [db:swissprot] |
| 4694660_f3_123 | 3006 | 6660 | 1122 | 373 | 1339 | 7.50E-137 | [ac:p39300] [gn:yifr] [or:escherichia coli] [de:hypothetical 40.3 kd protein in aidb-rpsf intergenic region (f356)] [sp:p39300] [db:swissprot] |
| 4709386_f2_23 | 3007 | 6661 | 453 | 150 | 390 | 2.70E-36 | [ac:p45947] [gn:yycm] [or:bacillus subtilis] [de:putative arsenate reductase] [sp:p45947] [db:swissprot] |
| 4709643_f1_20 | 3008 | 6662 | 768 | 255 | 87 | 0.12 | [ac:q04314] [gn:ipbg] [or:shigella dysenteriae] [de:ipbg protein] [sp:q04314] [db:swissprot] |
| 4710952_c2_154 | 3009 | 6663 | 186 | 61 | 59 | 0.08 | [ln:celc18c3] [ac:af000265] [gn:c18c3.2] [or:caenorhabditis elegans] [sr: caenorhabditis elegans strain=bristol n2] [db:genpept-inv] [de: caenorhabditis elegans cosmid c18c3.] [nt:strong similarity to mouse d15kzl (fragment) (nid:] [le:23631:23710:23948:240 |
| 4714038_c1_32 | 3010 | 6664 | 897 | 298 | 567 | 4.80E-55 | [ac:s75507] [pn:3-dehydroquinate synthase:protein slr2130;protein slr2130] [gn:arob] [cl:3-dehydroquinate synthase:3-dehydroquinate synthase homology] [or:synechocystis sp.] [sr:pcc 6803, , pcc 6803] [sr:pcc 6803,] [db:pir] |
| 4719177_c3_82 | 3011 | 6665 | 492 | 163 | 130 | 9.80E-09 | [ac:p32398] [gn:yixd] [or:bacillus subtilis] [de:hypothetical transcriptional regulator in hemy 3'region (orfa)] [sp:p32398] [db:swissprot] |
| 4723452_c3_18 | 3012 | 6666 | 1083 | 360 | 132 | 5.40E-14 | [ac:h69050] [pn:conserved hypothetical protein mth1382] [gn:mth1382] [or: methanobacterium thermoautotrophicum] [db:pir] |
| 4726588_f2_6 | 3013 | 6667 | 666 | 221 | 449 | 1.50E-42 | [ln:shgcpir] [ac:x86780] [pn:abc-transporter] [gn:orfx] [or:streptomyces hygroscopicus] [db:genpept-bct] [de:s. hygroscopicus gene cluster for polyketide immunosuppressant rapamycin.] [le:3056] [re:3763] [di:complement] |
| 4726643_c2_115 | 3014 | 6668 | 2619 | 872 | 124 | 6.30E-06 | [ac:c56976] [pn:transfer complex protein trsk] [gn:trsk] [or:staphylococcus aureus] [db:pir] |
| 4726713_c1_115 | 3015 | 6669 | 324 | 107 | 80 | 0.039 | [ac:p48785] [gn:prh] [or:arabidopsis thaliana] [sr::mouse-ear cress] [de:pathogenesis-related homeodomain protein (prha)] [sp:p48785] [db:swissprot] |
| 4727217_f3_6 | 3016 | 6670 | 702 | 234 | 722 | 1.80E-71 | [ac:p35159] [gn:ypul] [or:bacillus subtilis] [de:hypothetical 26.0 kd protein in spmb-aroc intergenic region (orfx13)] [sp:p35159] [db:swissprot] |
| 4728568_c1_12 | 3017 | 6671 | 318 | 105 | 158 | 1.10E-11 | [ac:q01256] [gn:arsr] [or:staphylococcus xylosus] [de:arsenical resistance operon repressor] [sp:q01256] [db:swissprot] |
| 4730202_f3_28 | 3018 | 6672 | 561 | 186 | 406 | 5.50E-38 | [ac:c69874] [pn:conserved hypothetical protein ylbh] [gn:ylbh] [or:bacillus subtilis] [db:pir] |
| 4736627_c3_70 | 3019 | 6673 | 837 | 278 | 576 | 5.30E-56 | [ac:q46831] [gn:ygga] [or:escherichia coli] [de:hypothetical 24.6 kd protein in spec-glcb intergenic region] [sp:q46831] [db:swissprot] |
| 4737783_c3_177 | 3020 | 6674 | 198 | 65 | 59 | 0.28 | [ln:pbu42580] [ac:u42580:u17055:u32570] [gn:a42251] [or:paramecium bursaria chorella virus 1] [db:genpept-vrl] [de:paramecium bursaria chlorella virus 1, complete genome.] [le:207121] [re:207324] [di:complement] |
| 4742968_f3_71 | 3021 | 6675 | 3084 | 1027 | 166 | 2.70E-11 | [ac:s42798] [pn:fibronectin-binding protein] [or:streptococcus "equisimilis"] [db:pir] |
| 4744188_f1_2 | 3022 | 6676 | 189 | 62 | 56 | 0.49 | [ln:hivser033] [ac:z37845] [pn:envelope protein] [gn:env] [or:human immunodeficiency virus type 1] [db:genpept-vrl] [de:hiv-1 dna v3 region (patient 03, sample serum, clone 03).] [nt:v3 region] [le:<1] [re: |

TABLE 2-continued

| Orf | NT Seq ID | AA Seq ID | NT Orf length | AA Orf length | Score | Probability | Description |
|---|---|---|---|---|---|---|---|
| 4744575_c3_38 | 3023 | 6677 | 255 | 84 | 85 | 0.0021 | [ac:p18148] [gn:psia] [or:escherichia coli] [de:psia protein] [sp:p18148] [db:swissprot] |
| 476450_c3_16 | 3024 | 6678 | 606 | 201 | 735 | 7.60E-73 | [ln:ldgappgk] [ac:aj000339] [pn:phosphoglycerate kinase] [gn:pgk] [or:lactobacillus delbrueckii] [db:genpept-bct] [ec:2.7.2.3] [de:lactobacillus delbrueckii ygap, gap, pgk, tpi, and ycse genes.] [le:2369] [re:3580] [di:direct] |
| 4767187_c3_3 | 3025 | 6679 | 315 | 104 | 69 | 0.19 | [ln:ab009838] [ac:ab009838] [pn:nadh dehydrogenase 3] [or:mitochondrion loligo bleckeri] [sr:loligo bleckeri mitochondrion dna] [db:genpept-inv] [de:loligo bleckeri mitochondrial dna, complete sequence.] [le:1011] [re:1364] [di:direct] |
| 4767277_c3_56 | 3026 | 6680 | 3552 | 1183 | 3131 | 0 | [ac:p37474] [gn:mfd] [or:bacillus subtilis] [de:transcription-repair coupling factor (trcf)] [sp:p37474] [db:swissprot] |
| 4772213_c1_91 | 3027 | 6681 | 600 | 199 | 212 | 2.00E-17 | [ac:d70042] [pn:conserved hypothetical protein yvja] [or:bacillus subtilis] [db:pir] |
| 4772260_f3_29 | 3028 | 6682 | 234 | 77 | 72 | 0.06 | [ac:q10426] [gn:spac1b9.01] [or:schizosaccharomyces pombe]] [sr:,fission yeast] [de:hypothetical protein c1b9.01 in chromosome i (fragment) [sp:q10426] [db:swissprot] |
| 4773463_c3_159 | 3029 | 6683 | 417 | 138 | 81 | 0.092 | [ac:q33320] [gn:infc] [or:serratia marcescens] [de:translation initiation factor if-3] [sp:p33320] [db:swissprot] |
| 4773518_c3_74 | 3030 | 6684 | 1050 | 349 | 1383 | 1.60E-141 | [ln:af010281] [ac:af010281] [pn:groel] [or:lactobacillus zeae] [db:genpept-bct] [de:lactobacillus zeae groes (groes) and groel (groel) genes, complete cds.] [nt:hsp60; molecular chaperone] [le:1149] [re:2783] [di:direct] |
| 4773542_c3_110 | 3031 | 6685 | 393 | 130 | 273 | 6.90E-24 | [ac:p37507] [gn:yyaq] [or:bacillus subtilis] [de:hypothetical 13.9 kd protein in cotf-tetb intergenic region] [sp:p37507] [db:swissprot] |
| 4774083_c3_274 | 3032 | 6686 | 912 | 303 | 638 | 1.40E-62 | [ac:p25148] [gn:gspa:ipa-12d] [or:bacillus subtilis] [de:general stress protein a] [sp:p25148] [db:swissprot] |
| 4775263_c2_56 | 3033 | 6687 | 1488 | 495 | 1487 | 1.60E-152 | [ac:p96994] [gn:galt] [or:streptococcus mutans] [ec:2.7.7.10] [de:galactose-1-phosphate uridylyltransferase,] [sp:p96994] [dbswissprot] |
| 4777205_c1_44 | 3034 | 6688 | 363 | 120 | 168 | 1.70E-12 | [ac:q01466] [gn:mrec] [or:bacillus subtilis] [de:rod shape-determining protein mrec] [sp:q01466] [db:swissprot] |
| 4784407_f1_14 | 3035 | 6689 | 1710 | 569 | 1302 | 6.20E-133 | [ac:g69877] [pn:fibronectin-binding protein homolog yloa] [gn:yloa] [or:bacillus subtilis] [db:pir] |
| 4785150_c2_17 | 3036 | 6690 | 369 | 122 | 459 | 1.30E-43 | [ac:p12310] [gn:gdh] [or:bacillus subtilis] [ec:1.1.1.47] [de:glucose 1-dehydrogenase,] [sp:p12310] [db:swissprot] |
| 4788941_c1_101 | 3037 | 6691 | 1212 | 403 | 1064 | 1.00E-107 | [ac:s37549:s67927] [pn:transposase] [or:streptococcus thermophilus] [db:pir] |
| 4788941_c1_23 | 3038 | 6692 | 1134 | 377 | 994 | 2.70E-100 | [ac:s37549:s67927] [pn:transposase] [or:streptococcus thermophilus] [db:pir] |
| 4788941_c2_12 | 3039 | 6693 | 609 | 202 | 495 | 2.00E-47 | [ac:35881] [or:lactococcus lactis] [sr:,subsplactis:streptococcus lactis] [de:transposase for insertion sequence element is 905] [sp:p35881] [db:swissprot] |
| 4788941_c3_23 | 3040 | 6694 | 399 | 132 | 360 | 4.10E-33 | [ac:p35880] [or:lactobacillus helveticus] [de:transposase for insertion sequence element is 1201] [sp:p35880] [db:swissprot] |
| 4788941_c3_94 | 3041 | 6695 | 1212 | 403 | 1064 | 1.00E-107 | [ac:s37549:s67927] [pn:transposase] [or:streptococcus thermophilus] [db:pir] |
| 4788941_f1_2 | 3042 | 6696 | 1212 | 403 | 1064 | 1.00E-107 | [ac:s37549:s67927] [pn:transposase] [or:streptococcus thermophilus] [db:pir] |
| 4788941_f2_14 | 3043 | 6697 | 1212 | 403 | 1064 | 1.00E-107 | [ac:s37549:s67927] [pn:transposase] [or:streptococcus thermophilus] [db:pir] |
| 4788941_f2_15 | 3044 | 6698 | 1212 | 403 | 1064 | 1.00E-107 | [ac:s37549:s67927] [pn:transposase] [or:streptococcus thermophilus] [db:pir] |
| 4788941_f2_40 | 3045 | 6699 | 240 | 79 | 195 | 4.80E-15 | [ac:35881] [or:lactococcus lactis] [sr:,subsplactis:streptococcus lactis] [de:transposase for insertion sequence element is 905] [sp:p35881] [db:swissprot] |
| 4788941_f3_11 | 3046 | 6700 | 1212 | 403 | 1064 | 1.00E-107 | [ac:s37549:s67927] [pn:transposase] [or:streptococcus thermophilus] [db:pir] |
| 4788941_f3_12 | 3047 | 6701 | 366 | 122 | 302 | 5.80E-27 | [ac:p35881] [or:lactococcus lactis] [sr:,subsplactis:streptococcus lactis] [de:transposase for insertion sequence |

TABLE 2-continued

| Orf | NT Seq ID | AA Seq ID | NT Orf length | AA Orf length | Score | Probability | Description |
|---|---|---|---|---|---|---|---|
| 4788941_f3_25 | 3048 | 6702 | 462 | 153 | 419 | 2.30E-39 | [ac:p35881] [or:*lactococcus lactis*] [sr:,subsp.lactis:*streptococcus lactis*] [de:transposase for insertion sequence element is 905] [sp:p35881] [db:swissprot] |
| 4791533_c3_15 | 3049 | 6703 | 1059 | 352 | 1008 | 8.90E-102 | [ac:g70033] [pn:maltose/maltodextrin-binding protein homolog yvdg] [gn:yvdg] [or:*bacillus subtilis*] [db:pir] |
| 4792003_f3_23 | 3050 | 6704 | 213 | 70 | 60 | 0.078 | [ln:aiqcpmatk] [ac:134114] [pn:maturase] [gn:matk] [or:chloroplast *astilbe japonica x astilbe chinensis*] [db:genpept-pln] [deastilbe japonica x astilbe chinensis* chloroplast maturase (matk) gene, 5'end.] [nt:includes over 2/3 of matk gene; putative] [le: |
| 4797055_f1_1 | 3051 | 6705 | 336 | 111 | 250 | 1.90E-21 | [ac:a69742] [pn:conserved hypothetical protein yaza] [gn:yaza] [or:*bacillus subtilis*] [db:pir] |
| 4798577_f1_1 | 3052 | 6706 | 750 | 249 | 98 | 0.054 | [ln:thusmhc] [ac:d51381] [pn:skeletal myosin heavy chain] [or:*thunnus thynnus*] [sr:*thunnus thynnus* adult fast skeletal muscle cdna to mrna] [db:genpept-vrt] [de:bluefin tuna mrna for skeletal myosin heavy chain, partial cds.] [le:<1] [re:2362] [di:direct] |
| 4799152_c2_49 | 3053 | 6707 | 207 | 68 | 70 | 0.039 | [ln:seqgh] [ac:d50368] [pn:growth hormone] [gn:gh] [or:*seriola quinqueradiata*] [sr:*seriola quinqueradiata* adult male liver dna] [db:genpept-vrt] [de:*seriola quinqueradiata* gene for growth hormone, exon1-6, complete cds.] [le:397:1681:1913:3916:4398] [re:40 |
| 4801822_c2_18 | 3054 | 6708 | 414 | 137 | 393 | 1.30E-36 | [ac:p42360] [or:*streptococcus gordonii challis*] [de:(orf1)] [sp:p42360] [db:swissprot] |
| 4803437_c1_23 | 3055 | 6709 | 1314 | 437 | 561 | 2.10E-54 | [ac:f69796] [pn:sugar-binding protein homolog yeso] [gn:yeso] [or:*bacillus subtilis*] [db:pir] |
| 4804676_c1_96 | 3056 | 6710 | 645 | 214 | 170 | 5.60E-13 | [ac:36387] [gn:clpp] [or:*pinus contorta*] [sr:shore pine:lodgepole pine] [ec:3.4.21.92] [de:probable clpp-like protease, (endopeptidase clp)] [sp:p36387] [db:swissprot] |
| 4804693_c3_49 | 3057 | 6711 | 1032 | 343 | 717 | 6.10E-71 | [ac:s74729] [pn:carboxysome formation protein:protein s110934:protein s110934] [gn:ccma] [or:*synechocystis sp.*] [sr:pcc 6803, , pcc 6803, ] [db:pir] |
| 4817593_c2_125 | 3058 | 6712 | 273 | 90 | 55 | 0.58 | [ln:hsmhcge1] [ac:x03339] [or:*homo sapiens*] [sr:human] [db:genpept-pri1] [de:human class ii invariant gamma-chain gene (5' flank, exon 1).] [nt:gamma chain (aa 1–42) (922 is 2nd base in codon)] [sp:p04233] [le:798] [re:922] [di:direct] |
| 4819682_f2_39 | 3059 | 6713 | 1281 | 426 | 1315 | 2.60E-134 | [ac:p50855] [gn:riba] [or:*actinobacillus pleuropneumoniae*] [sr:*haemophilus pleuropneumoniae*] [ec:3.5.4.25] [de:phosphate synthase (dhbp synthase)] [sp:p50855] [db:swissprot] |
| 4819758_c2_21 | 3060 | 6714 | 954 | 317 | 204 | 5.20E-16 | [ln:ann85709] [ac:u85709] [pn:putative fimbrial-associated protein] [or:*actinomyces naeslundii*] [db:genpept-bct] [de:*actinomyces naeslundii* putative fimbrial-associated protein genes, complete cds.] [le:98] [re:940] [di:direct] |
| 4822187_c2_113 | 3061 | 6715 | 1983 | 660 | 193 | 6.00E-12 | [ac:s52348] [pn:hypothetical protein 2] [or:*lactobacillus leichmannii*] [db:pir] |
| 4823576_f3_103 | 3062 | 6716 | 798 | 265 | 134 | 6.90E-07 | [ac:42926] [pn:hypothetical membrane spanning protein] [or:*staphylococcus aureus*] [db:pir] |
| 4823571_c2_70 | 3063 | 6717 | 393 | 130 | 52 | 0.96 | [ac:p20710] [gn:xis] [or:bacteriophage 154a] [de:excisionase] [sp:p20710] [db:swissprot] |
| 48577_f2_10 | 3064 | 6718 | 210 | 69 | 58 | 0.34 | [ac:p04206] [or:*homo sapiens*] [sr:human] [de:ig kappa chain v-iii region gol) (rheumatoid factor)] [sp:p04206] [db:swissprot] |

TABLE 2-continued

| Orf | NT Seq ID | AA Seq ID | NT Orf length | AA Orf length | Score | Probability | Description |
|---|---|---|---|---|---|---|---|
| 4859376_f2_62 | 3065 | 6719 | 201 | 66 | 55 | 0.58 | [ac:s24994:s19181] [pn:h+-transporting atp synthase, protein 6] [gn:atp6-1] [cl:h+-transporting atp synthase protein 6] [or:mitochondrion sorghum bicolor] [sr:, sorghum] [ec:3.6.1.34] [db:pir] |
| 4859503_c3_58 | 3066 | 6720 | 552 | 183 | 779 | 1.60E-77 | [ac:p26680] [gn:atph] [or:enterococcus faecalis] [sr:, streptococcus faecalis] [ec:3.6.1.34] [de:atp synthase delta chain,] [sp:p26680] [db:swissprot] |
| 4860632_f2_24 | 3067 | 6721 | 333 | 110 | 72 | 0.22 | [ln:d63523] [ac:d63523] [pn:ribosomal protein 116] [gn:rp116] [or:mitochondrion dictyostelium discoideum] [sr:dictyostelium discoideum (strain:ax3) mitochondrion dna] [db:genpept-inv] [de:dictyostelium discoideum mitochondrial genes for ribosomal proteins, |
| 4860662_f2_17 | 3068 | 6722 | 750 | 249 | 830 | 6.50E-83 | [ac:c69793] [pn:conserved hypothetical protein yeei] [gn:yeei] [or:bacillus subtilis] [db:pir] |
| 4860688_c3_3 | 3069 | 6723 | 195 | 64 | 55 | 0.58 | [ln:mmy16462] [ac:y16462] [pn:immunoglobulin kappa light chain variable or:mus musculus] [sr:house mouse] [db:genpept] [de:mus musculus mma for immunoglobulin kappa light chain, variable region, clone pc2871.] [le:<1] [re: |
| 4860961_f3_8 | 3070 | 6724 | 939 | 312 | 647 | 1.60E-63 | [ac:q08291] [or:bacillus stearothermophilus] [ec:2.5.1.10] [de:(fpp synthase)] [sp:q08291] [db:swissprot] |
| 4863956_c1_33 | 3071 | 6725 | 1242 | 413 | 1215 | 1.00E-123 | [ac:b69668] [pn:transcription termination nusa] [gn:nusa] [or:bacillus subtilis] [db:pir] |
| 4864703_c2_45 | 3072 | 6726 | 1293 | 430 | 875 | 1.10E-87 | [ac:b69888] [pn:gtp-binding protein proteinase modulator homolog ynba] [gn:ynba] [or:bacillus subtilis] [db:pir] |
| 4864838_c3_280 | 3073 | 6727 | 201 | 66 | 134 | 3.70E-09 | [ln:llu23376] [ac:u23376] [or:lactococcus lactis] [db:genpept-bct] [de:lactococcus lactis n5-(1-carboxyethyl)-1-ornithine synthase (ceo) gene, complete cds.] [nt:putative 6-kda protein] [le:165] [re:353] [di:direct] |
| 4865706_c3_71 | 3074 | 6728 | 348 | 115 | 76 | 0.63 | [ac:p49578] [or:gallus gallus] [sr:,chicken] [de:muscarinic acetylcholine receptor m3] [sp:p49578] [db:swissprot] |
| 4869017_f2_14 | 3075 | 6729 | 375 | 124 | 228 | 4.00E-19 | [ln:spac57a10] [ac:z94864] [pn:unknown] [gn:spac57a10.03] [or:schizosaccharomyces pombe] [sr:fission yeast] [db:genpept-pln] [de:s. pombe chromosome i cosmid c57a10.] [nt:spac57a10.03, cyclophilin-related, len:156aa.] [le:5344:5414:5521:5779] [re:5373:5455 |
| 4870328_c2_126 | 3076 | 6730 | 1704 | 567 | 239 | 4.30E-17 | [ln:af011378] [ac:af011378] [pn:terminase large subunit] [or:bacteriophage sk1] [db:genpept-phg] [de:bacteriophage sk1 complete genome.] [nt:orf2] [le:788] [re:2410] [di:direct] |
| 4870462_c2_34 | 3077 | 6731 | 957 | 318 | 765 | 5.00E-76 | [ac:g69818] [pn:cmp-binding factor homolog yham] [gn:yham] [or:bacillus subtilis] [db:pir] |
| 4870937_f3_40 | 3078 | 6732 | 249 | 82 | 61 | 0.71 | [ln:celc13d9] [ac:af016420] [gn:c13d9.6] [or:caenorhabditis elegans] [sr:caenorhabditis elegans strain=bristol n2] [db:genpept-inv] [de:caenorhabditis elegans cosmid c13d9.] [nt:contains similarity to somatostatin type-2] [re:4343:4539:5126] [re:4486:4935 |
| 4875443_f3_40 | 3079 | 6733 | 492 | 163 | 67 | 0.18 | [ac:q09385] [gn:k04g7.11] [or:caenorhabditis elegans] [de:hypothetical 11.0 kd protein k04g7.11 in chromosome iii] [sp:q09385] [db:swissprot] |
| 4876643_c2_169 | 3080 | 6734 | 2370 | 789 | 1943 | 7.40E-201 | [ac:d69985] [pn:dna mismatch repair protein homolog yshd] [gn:yshd] [or:bacillus subtilis] [db:pir] |
| 4876662_c1_58 | 3081 | 6735 | 3213 | 1070 | 125 | 8.40E-05 | [ac:p25928] [gn:yhf] [or:salmonella typhimurium] [sp:p25928] [db:swissprot] |
| 4876668_c2_152 | 3082 | 6736 | 564 | 187 | 199 | 4.80E-16 | [ac:q50611] [gn:pgsa:mtcyla11.21c] [or:mycobacterium tuberculosis] [ec:2.7.8.5] [de:synthase)] [sp:q50611] [db:swissprot] |
| 4876688_f3_149 | 3083 | 6737 | 819 | 272 | 297 | 2.00E-26 | [ac:f69841] [pn:conserved hypothetical protein yitu] [gn:yitu] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 4876717_c3_91 | 3084 | 6738 | 909 | 302 | 88 | 0.18 | [ac:s38222] [pn:hypothetical protein] [or:coxiella burnetii] [db:pir] |
| 4881252_c1_141 | 3085 | 6739 | 339 | 112 | 302 | 5.80E-27 | [ac:p14949] [gn:trxa:trx] [sp:p14949] [db:swissprot] [de:thioredoxin (trx)] [or:bacillus subtilis] |
| 4881452_f1_2 | 3086 | 6740 | 1728 | 575 | 1092 | 1.10E-110 | [ac:q11046] [gn:mtcy50.09] [or:mycobacterium tuberculosis] [de:hypothetical abc transporter atp-binding protein cy50.09] [sp:q11046] [db:swissprot] |
| 4881513_c1_103 | 3087 | 6741 | 1215 | 404 | 258 | 2.20E-20 | [n:sau73374] [ac:u73374] [pn:cap81] [gn:cap81] [or:staphylococcus aureus] [db:genpept-bct] [de:staphylococcus aureus type 8 capsule genes, cap8a, cap8b, cap8c, cap8d, cap8e, cap8f, cap8g, cap8h, cap8i, cap8j, cap8k, cap8l, cap8m, cap8n, cap8o, cap8p, compl] |
| 4881912_f3_9 | 3088 | 6742 | 315 | 104 | 282 | 7.60E-25 | [ac:p42923] [gn:rpl;j] [or:bacillus subtilis] [de:50s ribosomal protein l10 (b15)] [sp:p42923] [db:swissprot] |
| 4882587_c1_39 | 3089 | 6743 | 282 | 93 | 197 | 6.30E-15 | [ac:p36043] [gn:ykl201c] [or:saccharomyces cerevisiae] [sr:baker's yeast] [de:64.6 kd protein in tor2-pas1 intergenic region] [sp:p36043] [db:swissprot] |
| 48826762_c3_62 | 3090 | 6744 | 369 | 122 | 211 | 2.50E-17 | [n:celzk354] [ac:u88172] [gn:zk354.7] [or:caenorhabditis elegans] [sr:caenorhabditis elegans strain=bristol n2] [db:genpept-inv] [de:caenorhabditis elegans cosmid zk354.] [le:7269:8132] [re:7868:8206] [di:complement join] |
| 48827864_c2_50 | 3091 | 6745 | 267 | 88 | 228 | 2.80E-18 | [ac:p36043] [gn:ykl201c] [or:saccharomyces cerevisiae] [sr:baker's yeast] [de:64.6 kd protein in tor2-pas1 intergenic region] [sp:p36043] [db:swissprot] |
| 482827_c1_78 | 3092 | 6746 | 705 | 234 | 673 | 2.80E-66 | [ac:p13792] [gn:phop] [or:bacillus subtilis] [de:phop] [sp:p13792] [db:swissprot] |
| 4882838_f1_3 | 3093 | 6747 | 699 | 232 | 121 | 8.00E-05 | [ac:p42377] [or:lactococcus lactis] [sr:subsplactis,streptococcus lactis] [de:hypothetical 70.0 kd protein in dnak 3'region (orf4)] [sp:p42377] [db:swissprot] |
| 4882893_c1_40 | 3094 | 6748 | 750 | 249 | 548 | 5.00E-53 | [ac:g69878] [pn:conserved hypothetical protein yloo] [gn:yloo] [or:bacillus subtilis ] [db:pir] |
| 4882893_c3_16 | 3095 | 6749 | 1548 | 515 | 1016 | 1.30E-102 | [ac:p12011] [gn:gntk] [or:bacillus subtilis] [ec:2.7.1.12] [de:gluconokinase, (gluconate kinase)] [sp:p12011] [db:swissprot] |
| 4882937_f1_3 | 3096 | 6750 | 846 | 281 | 739 | 2.90E-73 | [ac:b69663] [pn:formamidopyrimidine-dna glycosidase mutm] [gn:mutm] [or:bacillus subtilis] [db:pir] |
| 4882953_f1_12 | 3097 | 6751 | 1344 | 447 | 781 | 1.00E-77 | [ac:jc4541;pc4126] [pn:nadh oxidase (h2o-forming),:nox-2 protein] [gn:nox-2] [or:streptococcus mutans] [ec:1.6.-.-] [db:pir] |
| 4883453_c1_35 | 3098 | 6752 | 681 | 226 | 402 | 1.50E-37 | [ac:d70082] [pn:dna-3-methyladenine glycosidase homolog yxlj] [gn:yxlj] [or:bacillus subtilis] [db:pir] |
| 4884637_c1_86 | 3099 | 6753 | 684 | 227 | 484 | 3.00E-46 | [ac:a69121] [pn:conserved hypothetical protein mth1902] [gn:mth1902] [or:methanobacterium thermoautotrophicum] [db:pir] |
| 4884642_f2_26 | 3100 | 6754 | 204 | 67 | 143 | 2.20E-09 | [n:bk5tattp] [ac:144593] [pn:integrase] [gn:int] [fn:site specific recombinase] [or:lactococcus lactis phage bk5-t] [sr:bacteriophage bk5-t dna] [db:genpept-phg] [de:bacteriophage bk5-t orf410, 3'end pf cds, 20 orfs, repressor protein, and cro repressor |
| 4884662_c3_197 | 3101 | 6755 | 1368 | 455 | 630 | 1.00E-61 | [ac:p37061] [gn:nox] [or:enterococcus faecalis] [sr:streptococcus faecalis] [ec:1.6.-.-] [de:nadh oxidase, (noxase)] [sp:p37061] [db:swissprot] |
| 4884687_c3_64 | 3102 | 6756 | 1137 | 378 | 1276 | 3.60E-130 | [ac:p39131] [gn:yvyh] [or:bacillus subtilis] [ec:5.1.3.14] [de:glcnac-2-epimerase] [sp:p39131] [db:swissprot] |
| 4884687_f1_8 | 3103 | 6757 | 1092 | 363 | 1442 | 9.10E-148 | [n:chy13922] [ac:y13922:y15222] [gn:murg] [or:enterococcus hirae] [db:genpept-bct] [de:enterococcus hirae mrar, pbp3s, mray, murd, murg, ftsa genes, mraw, ylic and ftsz partial genes.] [le:6472] [re:7554] [di:direct] |
| 4884687_f2_17 | 3104 | 6758 | 720 | 239 | 335 | 1.80E-30 | [ac:q52419] [gn:dapb] [or:pseudomonas syringae] [sr:pvtabaci] [ec:1.3.1.26] [de:dihydrodipicolinate reductase,] [sp:q52419] [db:swissprot] |

TABLE 2-continued

| Orf | NT Seq ID | AA Seq ID | NT Orf length | AA Orf length | Score | Probability | Description |
|---|---|---|---|---|---|---|---|
| 4884705_c1_98 | 3105 | 6759 | 681 | 226 | 440 | 1.40E-41 | [ac:o06995] [gn:yvdm] [or:bacillus subtilis] [ec:5.4.2.6] [de:putative beta-phosphoglucomutase,] [sp:o06995] [db:swissprot] |
| 4884838_f2_19 | 3106 | 6760 | 246 | 81 | 74 | 0.031 | [ac:q57743] [gn:mj0295] [or:methanococcus jannaschii] [de:hypothetical protein mj0295] [sp:q57743] [db:swissprot] |
| 4885927_f1_1 | 3107 | 6761 | 675 | 224 | 577 | 4.20E-56 | [ac:70049] [pn:conserved hypothetical protein yvye] [gn:yvyc] [or:bacillus subtilis] [db:pir] |
| 4885936_f3_9 | 3108 | 6762 | 213 | 70 | 54 | 0.28 | [ln:ratkiddwca] [ac:128112] [or:rattus norvegicus] [sr:rattus norvegicus (library: lambda gt10) kidney cdna to mrna] [db:genpept-rod] [de:rattus norvegicus mrna, complete cds.] [nt:complete cds] [le:1] [re:939] [di:direct] |
| 4885963_f3_34 | 3109 | 6763 | 645 | 214 | 89 | 0.073 | [ln:atfca8] [ac:z97343] [pn:glycerol-3-phosphate permease homolog] [or:arabidopsis thaliana] [sr:thale cress] [db:genpept-pln] [de:arabidopsis thaliana dna chromosome 4, essa i contig fragment no. 8.] [nt:similarity to glycerol-3-phosphate permease -] [le: |
| 4886017_f3_107 | 3110 | 6764 | 204 | 68 | 138 | 4.70E-09 | [ln:fibril] [ac:af007112] [pn:fibrillarin] [gn:fib] [or:plasmodium falciparum] [sr:malaria parasite] [db:genpept-inv] [de:plasmodium falciparum fibrillarin (fib) gene, partial cds.] [nt:nucleolar protein] [le:<1] [re:906] [di:direct] |
| 4886088_c2_32 4886590_c3_131 | 3111 3112 | 6765 6766 | 936 1218 | 311 405 | 527 121 | 8.30E-51 0.00012 | [ac:g69979] [pn:proteinase homolog yrm] [gn:yrm] [or:bacillus subtilis] [db:pir] [n:d86328] [ac:d86328] [pn:ale-1] [gn:ale-1] [or:staphylococcus capitis] [sr:staphylococcus capitis (strain:epk 1) dna] [db:genpept-bct] [de:staphylococcus capitis dna for ale-1, complete cds.] [le:243] [re:1331] [di:direct] |
| 4886592_c2_20 | 3113 | 6767 | 678 | 225 | 638 | 1.40E-62 | [ac:p39760] [gn:ykqb] [or:bacillus subtilis] [de:hypothetical 24.3 kd protein in kinc-adec intergenic region (orf4)] [sp:p39760] [db:swissprot] |
| 4886593_f3_44 | 3114 | 6768 | 549 | 182 | 517 | 9.50E-50 | [ln:ehocopva] [ac:z46807] [gn:orf u] [or:enterococcus hirae] [db:genpept-bct] [de:e. hirae copa, copy and copz genes.] [le:646] [re:1185] [di:direct] |
| 4886643_c3_97 | 3115 | 6769 | 684 | 227 | 680 | 5.10E-67 | [ac:s49544] [pn:response regulator] [cl:response regulator homology] [or:streptococcus pneumoniae] [db:pir] |
| 4886713_f1_12 | 3116 | 6770 | 795 | 264 | 567 | 4.80E-55 | [ac:h69876] [pn:cell-division protein homolog ylmh] [gn:ylmh] [or:bacillus subtilis] |
| 4890938_c1_38 | 3117 | 6771 | 192 | 63 | 170 | 5.60E-13 | [ac:p21878] [or:bacillus stearothermophilus] [de:hypothetical protein in pdha 5'region (orf1) (fragment)] [sp:p21878] [db:swissprot] |
| 4891711_f2_24 | 3118 | 6772 | 285 | 94 | 70 | 0.15 | [ac:p26449] [gn:bub3;yor026w;or26.16] [or:saccharomyces cerevisiae] [sr:baker's yeast] [de:cell cycle arrest protein bub3] [sp:p26449] [db:swissprot] |
| 4895261_c1_16 | 3119 | 6773 | 600 | 199 | 93 | 0.037 | [ac:f69035] [pn:conserved hypothetical protein mth1261] [gn:mth1261] [or:methanobacterium thermoautotrophicum] [db:pir] |
| 4896933_f3_10 | 3120 | 6774 | 189 | 62 | 198 | 6.10E-16 | [ac:p42923] [gn:rplj] [or:bacillus subtilis] [de:50s ribosomal protein 110 (b15)] [sp:p42923] [db:swissprot] |
| 4897707_c1_105 | 3121 | 6775 | 537 | 178 | 79 | 0.12 | [ac:h69433] [pn:response regulator homolog] [or:archaeoglobus fulgidus] [db:pir] |
| 4898438_f1_1 | 3122 | 6776 | 702 | 233 | 770 | 1.50E-76 | [ac:p39814] [gn:topa;topi] [or:bacillus subtilis] [ec:5.99.1.2] [de:(untwisting enzyme) (swivelase)] [sp:p39814] [db:swissprot] |
| 4898452_c1_22 | 3123 | 6777 | 621 | 206 | 90 | 0.21 | [ln:d87440] [ac:d87440] [gn:kiaa0252] [or:homo sapiens] [sr:homo sapiens male bone marrow mycoblast cell_line:kg-1 cdna] [db:genpept-pri2] [de:human mrna for kiaa0252 gene, partial cds.] [nt:similar to plasmodium falciparum glutamic acid-rich] [le:<1] |
| 4898512_c3_63 | 3124 | 6778 | 1560 | 519 | 858 | 7.00E-86 | [ln:spadca] [ac:z71552] [pn:zn-binding lipoprotein] [gn:adca] [or:streptococcus pneumoniae] [db:genpept-bct] [de:streptococcus pneumoniae adcba operon.] [le:1527] [re:2471] [di:direct] |
| 4899140_f2_6 | 3125 | 6779 | 684 | 227 | 709 | 4.30E-70 | [ac:p19672] [gn:yqxc;yqif] [or:bacillus subtilis] [de:hypothetical 29.7 kd protein in fold-ahrc intergenic region] [sp:p19672] [db:swissprot] |

TABLE 2-continued

| Orf | NT Seq ID | AA Seq ID | NT Orf length | AA Orf length | Score | Probability | Description |
|---|---|---|---|---|---|---|---|
| 4900301_f2_16 | 3126 | 6780 | 417 | 138 | 65 | 0.11 | [ln:cja|754] [aca:t000754] [pn:threonyl-trna synthetase] [gn:thrs] [or:campylobacter jejuni] [db:genpept-bct] [de:campylobacter jejuni thrs gene, partial.] [le:<1] [re: |
| 4900463_c3_113 | 3127 | 6781 | 1017 | 338 | 395 | 8.10E-37 | [ln:atu19620] [acu19620] [pn:mocd] [gn:mocd] [fn:conjugase which splits deoxyfructosyl glutamine] [or:agrobacterium tumefaciens] [db:genpept-bct] [de:agrobacterium tumefaciens plasmid pti15955 moc operon, kinase (moce), conjugase (mocd), repressor (mocr), |
| 4901038_f1_1 | 3128 | 6782 | 903 | 300 | 58 | 0.94 | [aca:36589] [pn:bactenccin 7] [cl:cathelin:cystatin homology] [or:bos primigenius taurus] [sr:, cattle] [db:pir] |
| 4901662_f2_3 | 3129 | 6783 | 867 | 288 | 556 | 7.00E-54 | [acp32436] [gn:degv] [or:bacillus subtilis] [de:degv protein] [sp:p32436] [db:swissprot] |
| 4901707_f2_5 | 3130 | 6784 | 384 | 127 | 440 | 1.40E-41 | [ac:f69695] [pn:ribosomal protein 112 (b19) rpll] [gn:rpll] [or:bacillus subtilis] [db:pir] |
| 4901711_c3_60 | 3131 | 6785 | 1302 | 433 | 1043 | 1.70E-105 | [acp69885] [pn:processing proteinase homolog ymfh] [gn:ymfh] [or:bacillus subtilis] [db:pir] |
| 4901711_f3_20 | 3132 | 6786 | 978 | 325 | 289 | 1.40E-25 | [ac:h69995] [pn:hypothetical protein ytlr] [gn:ytlr] [or:bacillus subtilis] [db:pir] |
| 4902187_c3_59 | 3133 | 6787 | 504 | 167 | 314 | 3.10E-28 | [acp37560] [gn:yabr] [or:bacillus subtilis] [de:hypothetical 14.2 kd protein in divic-spoic intergenic region] [sp:p37560] [db:swissprot] |
| 4939078_c1_41 | 3134 | 6788 | 1566 | 521 | 2562 | 1.90E-266 | [acp26679] [gn:atpa] [or:enterococcus faecalis] [sr:streptococcus faecalis] [ec:3.6.1.34] [de:atp synthase alpha chain,] [sp:p26679] [db:swissprot] |
| 4939377_f2_2 | 3135 | 6789 | 219 | 72 | 54 | 0.06 | [ln:ssu33491] [acu33491] [pn:ependymin] [or:synodontis sp.] [db:genpept-vrt] [de:synodontis sp. ependymin mrna, partial cds.] [nt:glycoprotein, extracellular matrix from fish brain] [le:<1] [re: |
| 4945162_c1_56 | 3136 | 6790 | 411 | 136 | 352 | 2.90E-32 | [acp54689] [gn:ilvehi1193] [or:haemophilus influenzae] [ec:2.6.1.42] [de:b) (bcat] [sp:p54689] [db:swissprot] |
| 4947067_c1_4 | 3137 | 6791 | 837 | 278 | 1039 | 4.60E-105 | [ln:af029727] [aca:f029727] [pn:transposase] [or:enterococcus faecium] [db: genpept-bct] [de:enterococcus faecium insertion sequence is 1485, complete sequence.] [nt:putative transposase] [le:76:330] [re:330:1238] [di:directjoin] |
| 4948555_c1_122 | 3138 | 6792 | 1119 | 372 | 701 | 3.00E-69 | [acp54524] [gn:yqig] [or:bacillus subtilis] [ec:1.—.—.—] [de:probable nadh-dependent flavin oxidoreductase yqig.] [sp:p54524] [db:swissprot] |
| 4954760_f2_21 | 3139 | 6793 | 231 | 76 | 137 | 1.80E-09 | [aca:43397:s35225] [pn:4-oxalocrotonate tautomerase] [gn:xylh] [or:pseudomonas putida] [db:pir] |
| 4955180_c1_45 | 3140 | 6794 | 612 | 203 | 508 | 8.60E-49 | [acp46322] [gn:pgsa] [or:bacillus subtilis] [ec:2.7.8.5] [de:(ec 2.7.8.5) (phosphatidylglycerophosphate synthase) (pgp synthase)] [sp:46322] [dbsswissprot] |
| 4955316_c1_33 | 3141 | 6795 | 870 | 289 | 414 | 7.80E-39 | [ac:s76790] [pn:hypothetical protein] [or:synechocystis sp.] [sr:pcc 6803; , pcc 6803] [sr:pcc 6803, ] [db:pir] |
| 4956578_c1_98 | 3142 | 6796 | 885 | 294 | 57 | 0.97 | [ac:c69920] [pn:hypothetical protein yoqk] [gn:yoqk] [or:bacillus subtilis] [db:pir] |
| 4960010_c3_38 | 3143 | 6797 | 330 | 109 | 92 | 0.0001 | [ln:csgtsggp] [ac:x85757] [pn:unknown] [gn:internal of g1669] [or:saccharomyces cerevisiae] [sr:baker's yeast] [db:genpept-pln] [de:s. cerevisiae g1651, g1654, trna-lys1, sua5, pmr1, g1667, & g1669 genes.] [le:6964] [re:7365] [di:direct] |
| 4960088_c2_165 | 3144 | 6798 | 921 | 306 | 307 | 1.70E-27 | [ln:d76414] [ac:d76414] [pn:n-acetylmuramoyl-1-alanine amidase] [gn:lyth] [or:staphylococcus aureus] [sr:staphylococcus aureus (strain:sr17238) dna] [db:genpept-bct] [de:staphylococcus aureus gene for histidyl-trna synthetase, ppgpphydrolase, lytic enzyme |

TABLE 2-continued

| Orf | NT Seq ID | AA Seq ID | NT Orf length | AA Orf length | Score | Probability | Description |
|---|---|---|---|---|---|---|---|
| 4960818_f2_10 | 3145 | 6799 | 330 | 109 | 302 | 5.80E-27 | [ac:g69998] [pn:thioredoxin h1 homolog ytpl] [gn:ytpp] [or:bacillus subtilis] [db:pir] |
| 4960965_f2_91 | 3146 | 6800 | 204 | 67 | 58 | 0.34 | [ln:mgu01706] [accu01706] [pn:unknown] [or:mycoplasma genitalium] [db:genpept-bct] [de:mycoplasma genitalium random genomic clone esb12, partial cds.] [le:<1] [re: |
| 4961068_c3_22 | 3147 | 6801 | 1182 | 393 | 987 | 1.50E-99 | [ac:b69640] [pn:coproporphyrinogen iii oxidase hemn] [gn:hemn] [or:bacillus subtilis] [db:pir] |
| 4961693_c2_15 | 3148 | 6802 | 585 | 194 | 516 | 1.20E-49 | [ac:p54537] [gn:yqiz] [or:bacillus subtilis] [de:intergenic region] [sp:p54537] [dbswissprot] |
| 4962512_c1_43 | 3149 | 6803 | 663 | 220 | 69 | 0.1 | [ln:mcu60315] [accu60315] [pn:mc1181] [gn:mc1181] [or:molluscum contagiosum virus subtype 1] [db:genpept-vrl] [de:molluscum contagiosum virus subtype 1, complete genome.] [nt:putative virion membrane protein; contains a] [re:139570] [re:139854] [di:comple |
| 4962802_f3_17 | 3150 | 6804 | 201 | 66 | 71 | 0.039 | [ac:p07709] [gn:nd6] [or:drosophila yakuba] [sr:fruit fly] [ec:1.6.5.3] [de:nadh-ubiquinone oxidoreductase chain 6,] [sp:p07709] [dbswissprot] |
| 4962818_f2_10 | 3151 | 6805 | 519 | 172 | 866 | 9.90E-87 | [ac:p23495] [gn:lacb] [or:lactococcus lactis] [sr:subsplactis:streptococcus lactis] [ec:5.-.-.-] [de:galactose-6-phosphate isomerase lacb subunit,] [sp:p23495] [dbswissprot] |
| 4964562_c2_85 | 3152 | 6806 | 348 | 115 | 70 | 0.92 | [ln:ac001137] [ac:ac001137:ac000783] [pn:b. burgdorferi predicted coding region bb0307] [gn:bb0307] [or:borrelia burgdorferi] [sr:lyme disease spirochete] [db:genpept-bct] [de:borrelia burgdorferi (section 23 of 70) of the complete genome.] [nt:hypothetic |
| 4964628_f1_4 | 3153 | 6807 | 840 | 279 | 85 | 0.09 | [ac:p42419] [gn:yxdh:b65b] [or:bacillus subtilis] [de:hypothetical 31.7 kd protein in idh 3'region] [sp:p42419] [dbswissprot] |
| 4964687_c1_50 | 3154 | 6808 | 597 | 198 | 485 | 2.30E-46 | [ac:p42097] [or:lactococcus lactis] [sr:subsplactis:streptococcus lactis] [de:hypothetical 22.2 kd protein in lacx 3'region (orf3)] [sp:p42097] [dbswissprot] |
| 4964687_f1_3 | 3155 | 6809 | 402 | 133 | 70 | 0.23 | [ln:pfamsal ac] [ac:m77717] [pn:major merozoite surface antigen] [gn:p190] [or:plasmodium falciparum] [sr:plasmodium falciparum asexual erythrocytic dna] [db:genpept-inv] [de:p. falciparum major merozoite surface antigen (p190) gene sequence, clone 8.22a.] [l |
| 4964688_f1_8 | 3156 | 6810 | 231 | 76 | 131 | 7.60E-09 | [ac:h70025] [pn:hypothetical protein yuza] [gn:yuza] [or:bacillus subtilis] [db:pir] |
| 4969442_f3_15 | 3157 | 6811 | 1752 | 583 | 953 | 6.00E-96 | [ac:p36672] [gn:treb] [or:escherichia coli] [ec:2.7.1.69] [de:(ec 2.7.1.69) (eii-tre)] [sp:p36672] [dbswissprot] |
| 4969758_f1_6 | 3158 | 6812 | 207 | 68 | 57 | 0.61 | [ln:anu72239] [ac:u72239] [pn:xish] [gn:xish] [or:anabaena sp.] [sr:anabaena sp] [db:genpept-bct] [de:anabaena sp. xish, xisi genes, complete cds.] [le:972] [re:1385] [di:direct] |
| 4976587_c2_114 | 3159 | 6813 | 795 | 264 | 640 | 8.80E-63 | [ln:bk5tattp] [ac:144593] [pn:unidentified] [or:lactococcus lactis phage bk5-t] [sr:bacteriophage bk5-t dna] [db:genpept-phg] [de:bacteriophage bk5-t orf410, 3'end pf cds, 20 orfs, repressor protein, and cro repressor protein genes, complete cds, orf70g |
| 4976587_f3_32 | 3160 | 6814 | 258 | 85 | 126 | 2.60E-08 | [ln:efti09422] [ac:u09422] [or:enterococcus faecalis] [db:genpept-bct] [de:enterococcus faecalis ds16 transposon tn916, (tet(m)), (xis-tn), (int-tn) genes, orfs 1–24, complete cds, complete sequence.] [nt:orf8] [re:15665] [re:15895] [di:direct] |
| 4976630_f1_2 | 3161 | 6815 | 228 | 75 | 69 | 0.028 | [ac:s24443:s19667] [pn:ig heavy chain v region (vh4dj)] [cl:immunoglobulin v region:immunoglobulin homology] [sr:; man] [dbpir] |

TABLE 2-continued

| Orf | NT Seq ID | AA Seq ID | NT Orf length | AA Orf length | Score | Probability | Description |
|---|---|---|---|---|---|---|---|
| 4976687_c3_50 | 3162 | 6816 | 711 | 236 | 510 | 5.30E-49 | [ac:p24247] [gn:pfs] [or:escherichia coli] [de:pfs protein (p46)] [sp:p24247] [db:swissprot] |
| 4977188_c1_123 | 3163 | 6817 | 1311 | 436 | 456 | 2.80E-43 | [ac:p37061] [gn:nox] [or:enterococcus faecalis] [sr:streptococcus faecalis] [ec:1.6.—.—] [de:nadh oxidase, (noxase)] [sp:p37061] [db:swissprot] |
| 4977257_f2_7 | 3164 | 6818 | 567 | 188 | 439 | 1.80E-41 | [ac:q54433] [gn:dfp] [or:streptococcus mutans] [de:dna/pantothenate metabolism flavoprotein homolog (fragment)] [sp:q54433] [db:swissprot] |
| 4977302_c3_77 | 3165 | 6819 | 369 | 122 | 58 | 0.42 | [ln:basrky1224] [ac:d83104] [pn:alpha subunit of dinitrogenase reductase (fe) [gn:nifh] [or:unidentified bacterium] [sr:unidentified bacterium (specific_host: reticulitermes speratus) dna] [db:genpept-bct] [de:bacterial sp. gene for alpha subunit of dinitr |
| 4979680_c2_30 | 3166 | 6820 | 486 | 161 | 400 | 2.40E-37 | [ln:lmu40604] [ac:u40604] [fn:unknown] [or:listeria monocytogenes] [db:genpept-bct] [de:listeria monocytogenes clpc atpase (mec) gene, complete cds.] [nt:orf1; putative 17 kda protein] [le:207] [re:665] [di:direct] |
| 4980426_c2_23 | 3167 | 6821 | 1215 | 404 | 1469 | 1.30E-150 | [ac:d69657] [pn:s-adenosylmethionine synthetase metk] [gn:metk] [or:bacillus subtilis] [db:pir] |
| 5001_c2_35 | 3168 | 6822 | 354 | 117 | 63 | 1 | [ln:smu18783] [ac:u18783] [or:schistosoma mansoni] [sr:blood fluke] [db:genpept-inv] [de:schistosoma mansoni 30 kda glycoprotein mrna, partial cds.] [nt:30 kda glycoprotein] [le:<1] [re:506] [di:direct] |
| 504557_f3_15 | 3169 | 6823 | 264 | 87 | 197 | 1.50E-14 | [ac:p22036] [gn:mgtb] [or:salmonella typhimurium] [ec:3.6.1.—] [de:mg(2+) transport atpase, p-type 2,] [sp:p22036] [db:swissprot] |
| 506878_c3_38 | 3170 | 6824 | 279 | 92 | 70 | 0.022 | [ln:tlocyb] [ac:m62558] [pn:cytochrome b] [or:telophorus bocagei] [sr:telophorus bocagei (sub_species jacksoni) dna] [db:genpept-vrt] [de:telophorus bocagei jacksoni nuclear-encoded mitochondrialcytochrome b gene, 3'end.] [nt:xxx] [le:<1] [re: |
| 506878_c3_53 | 3171 | 6825 | 279 | 92 | 70 | 0.022 | [ln:tlocyb] [ac:m62558] [pn:cytochrome b] [or:telophorus bocagei] [sr:telophorus bocagei (sub_species jacksoni) dna] [db:genpept-vrt] [de:telophorus bocagei jacksoni nuclear-encoded mitochondrialcytochrome b gene, 3'end.] [nt:xxx] [le:<1] [re: |
| 5078135_c2_46 | 3172 | 6826 | 210 | 69 | 167 | 1.20E-12 | [ln:d78257] [ac:d78257] [pn:baca] [gn:baca] [or:enterococcus faecalis] [sr:enterococcus faecalis plasmid:pyi17 dna] [db:genpept-bct] [de:enterococcus faecalis plasmid pyi17 genes for baca, bacb, orf3, orf4, orf5, orf6, orf7, orf8, orf9, orf10, orf11, partia |
| 5078155_c1_9 | 3173 | 6827 | 195 | 64 | 63 | 0.36 | [ac:a38594] [pn:troponin i] [gn:wupa] [cl:troponin i] [or:drosophila melanogaster] [db:pir] |
| 5078380_f3_6 | 3174 | 6828 | 1854 | 617 | 1737 | 5.00E-179 | [ln:sau49821] [ac:u49821] [pn:group b oligopeptidase pepb] [gn:pepb] [or:streptococcus agalactiae] [db:genpept-bct] [de:streptococcus agalactiae group b oligopeptidase pepb (pepb) gene, complete cds.] [le:205] [re:2010] [di:direct] |
| 5080061_c1_67 | 3175 | 6829 | 2580 | 859 | 3282 | 0 | [ln:llaj109] [ac:aj000109] [pn:carbamoylphosphate synthetase] [gn:carb] [or:lactococcus lactis] [db:genpept-bct] [de:lactococcus lactis carb and gpo genes.] [le:986] [re:4180] [di:direct] |
| 5084380_c3_58 | 3176 | 6830 | 1893 | 630 | 942 | 2.00E-117 | [ac:h69877] [pn:calcium-transporting atpase homolog ylob] [gn:ylob] [or:bacillus subtilis] [db:pir] |
| 5085837_c1_57 | 3177 | 6831 | 354 | 117 | 55 | 0.67 | [ln:hivlu06731] [ac:u06731] [pn:gp41] [gn:env] [or:human immunodeficiency virus type 1] [db:genpept-vrl] [de:human immunodeficiency virus type 1 clone 430p-1 gp41 (env) mrna, partial cds.] [le:<1] [re: |
| 5085937_c1_107 | 3178 | 6832 | 1008 | 335 | 421 | 1.40E-39 | [ln:sau81973] [ac:u81973] [pn:cap5k] [gn:cap5k] [or:staphylococcus aureus] [db:genpept-bct] [de:staphylococcus aureus capsule gene cluster cap5a through cap5p genes, complete cds.] [le:10540] [re:11745] [di:direct] |
| 5086691_f1_3 | 3179 | 6833 | 183 | 60 | 60 | 0.23 | [ac:jq2343] [pn:p48h-10 protein precursor] [or:zinnia elegans] [db:pir] |

TABLE 2-continued

| Orf | NT Seq ID | AA Seq ID | NT Orf length | AA Orf length | Score | Probability | Description |
|---|---|---|---|---|---|---|---|
| 5089037_f1_9 | 3180 | 6834 | 387 | 128 | 78 | 0.09 | [ln:seexiv39k] [ac:z69381] [gn:n1102] [fn:involed in cellular morphogenesis of] [or:saccharomyces cerevisiae] [sr:baker's yeast] [db:genpept-pln] [de: s. cerevisiae 38,855 bp segment of chromosome xiv.] [le:<1] [re:451] [di:direct] |
| 5102067_c2_31 | 3181 | 6835 | 1746 | 581 | 1450 | 1.30E-148 | [ac:p37063] [or:lactobacillus plantarum] [sp:p37063] [dbsswissprot] (pyruvic oxidase) (pox)] [sp:p37063] [dbsswissprot] |
| 5104688_f2_55 | 3182 | 6836 | 1299 | 432 | 822 | 4.60E-82 | [ac:q45400] [gn:celb] [or:bacillus stearothermophilus] [de:permease iic component] (phosphotransferase enzyme ii, c component)] [sp:q45400] [dbsswissprot] |
| 5109677_c3_57 | 3183 | 6837 | 321 | 106 | 250 | 1.90E-21 | [ac:p24281] [gn:yaak] [or:bacillus subtilis] [de:hypothetical 11.8 kd protein in dnaz-recr intergenic region] [sp:p24281] [dbsswissprot] |
| 5110925_f1_6 | 3184 | 6838 | 627 | 208 | 260 | 1.60E-22 | [ac:g69838] [pn:hypothetical protein yisx] [gn:yisx] [or:bacillus subtilis] [db:pir] |
| 5110936_c3_140 | 3185 | 6839 | 372 | 123 | 75 | 0.33 | [ac:p15604] [or:paramecium tetraurelia] [de:hypothetical 23.3 kd protein (orf2)] [sp:p15604] [dbsswissprot] |
| 5111037_f1_9 | 3186 | 6840 | 1650 | 549 | 1566 | 6.60E-161 | [ln:bacca14g] [ac:d84648] [pn:exo-alpha-1,4-glucosidase] [or:bacillus stearothermophilus] [sr:bacillus stearothermophilus (strain:atcc12016) dna] [db:genpept-bct] [ec:3.2.1.20] [de:bacillus stearothermophilus dna for exo-alpha-1,4-glucosidase, complete cds |
| 5111393_f2_2 | 3187 | 6841 | 1290 | 429 | 1691 | 3.70E-174 | [ac:p37477] [gn:lyss] [or:bacillus subtilis] [ec:6.1.1.6] [de:lysyl-trna synthetase, (lysine--trna ligase) (lysrs)] [sp:p37477] [dbsswissprot] |
| 5112640_c1_13 | 3188 | 6842 | 213 | 70 | 157 | 1.90E-11 | [ln:bsu02604] [ac:u02604] [pn:orfy] [gn:orfy] [or:bacillus subtilis] [db:genpept-bct] [de:bacillus subtilis marburg 168 clpc adenosine triphosphatase (mecb) gene, complete cds, orfx and orfy, partial cds.] [nt:product homologous to swiss-prot accession num |
| 5112701_f1_14 | 3189 | 6843 | 219 | 72 | 60 | 0.23 | [ac:s50955.s64817] [pn:hypothetical protein yi1065w:hypothetical protein 10536] [db:genpept-bct] [de:e. coli plasmid pmccc7 mcca, b, c, d, e, f genes.] [gn:gin11] [or:saccharomyces cerevisiae] [db:pir] [mp:121] |
| 5113428_f2_65 | 3190 | 6844 | 243 | 80 | 63 | 0.14 | [ln:chy14328] [ac:y14328] [pn:3el protein] [or:entamoeba histolytica] [db:genpept-inv] [de:entamoeba histolytica mrna for 3el protein.] [le:32] [re:418] [di:direct] |
| 5114042_c3_21 | 3191 | 6845 | 1017 | 338 | 295 | 3.20E-26 | [ln:ecmpc7a] [ac:x57583] [gn:mccf] [fn:immunity] [or:escherichia coli] [db:genpept-bct] [de:e. coli plasmid pmccc7 mcca, b, c, d, e, f genes.] [le:5173] [re:6207] [di:complement] |
| 5114455_c3_74 | 3192 | 6846 | 843 | 280 | 688 | 7.20E-68 | [ac:c69693] [pn:ribonuclease h rnh] [gn:rnh] [or:bacillus subtilis] [db:pir] |
| 5115963_c2_28 | 3193 | 6847 | 1272 | 423 | 106 | 0.025 | [ac:p18185] [gn:carbcpab] [or:bacillus subtilis] [ec:6.3.5.5] [de(ec 6.3.5.5) (carbamoyl-phosphate synthetase ammonia chain)] [sp:p18185] [dbsswissprot] |
| 5116404_c2_31 | 3194 | 6848 | 245 | 81 | 281 | 9.70E-25 | [ac:c36933] [pn:orf 5' of diacylglycerol kinase homolog] [or:streptococcus mutans] [db:pir] |
| 5116633_c3_11 | 3195 | 6849 | 201 | 66 | 51 | 0.26 | [ac:p36470] [gn:rps4] [or:rhapis humilis] [de:chloroplast 30s ribosomal protein s4 (fragment)] [sp:p36470] [dbsswissprot] |
| 5117091_c1_56 | 3196 | 6850 | 861 | 286 | 544 | 1.30E-52 | [ac:a56641] [pn:probable membrane transport protein] [or:clostridium perfringens] [db:pir] |
| 5117186_c1_41 | 3197 | 6851 | 231 | 76 | 64 | 0.13 | [ac:p49794] [or:oreochromis mossambicus] [sr:mozambique tilapia: tilapia mossambica] [de:melanin-concentrating hormone precursor (mch)] [sp:p49794] [dbsswissprot] |
| 5117338_c2_167 | 3198 | 6852 | 453 | 150 | 136 | 2.30E-09 | [ac:a69985] [pn:hypothetical protein ysha] [gn:ysha] [or:bacillus subtilis] [db:pir] |
| 5117775_f2_45 | 3199 | 6853 | 285 | 94 | 67 | 0.42 | [ac:p23593] [gn:apod] [or:rattus norvegicus] [sr:rat] [de:apolipoprotein d precursor] [sp:p23593] [dbsswissprot] |

TABLE 2-continued

| Orf | NT Seq ID | AA Seq ID | NT Orf length | AA Orf length | Score | Probability | Description |
|---|---|---|---|---|---|---|---|
| 5117825_f3_46 | 3200 | 6854 | 585 | 194 | 182 | 3.00E-14 | [ac:b70008] [pn:hypothetical protein yuei] [gn:yuei] [or:bacillus subtilis] [db:pir] |
| 5119068_c1_12 | 3201 | 6855 | 189 | 62 | 65 | 0.16 | [ln:hty10888] [ac:y10888] [gn:lox7] [or:helobdella triserialis] [sr:leech] [db:genpept-inv] [de:h. triserialis lox7-htr gene.] [le:2] [re:496] [di:direct] |
| 5119178_c2_73 | 3202 | 6856 | 729 | 243 | 655 | 2.30E-64 | [ac:p54308] [gn:2] [or:bacteriophage sppl] [de:terminase large subunit (g2p)] [sp:p54308] [dbs:swissprot] |
| 5119576_c2_5 | 3203 | 6857 | 219 | 72 | 53 | 0.57 | [ln:cet28f4] [ac:z72517] [pn:t28f4.4] [or:caenorhabditis elegans] [db:genpept-inv] [de:caenorhabditis elegans cosmid t28f4, complete sequence.] [le:20997: 21357:21538] [re:21141:21490:21708] [di:complementjoin] |
| 5120302_c1_13 | 3204 | 6858 | 204 | 67 | 95 | 5.00E-05 | [ln:bpdplorfs] [ac:z93946] [pn:holin] [gn:dph] [fn:pore formation] [or:bacteriophage dp-1] [db:genpept-phg] [de:bacteriophage dp-1 dph and pal genes and 5 open reading frames.] [le:3463] [re:36687] [di:direct] |
| 5120302_c1_16 | 3205 | 6859 | 639 | 212 | 646 | 2.00E-63 | [ac:e70045] [pn:two-component response regulator [yvqe] [homolog yvqe] [gn:yvqc] [or:bacillus subtilis] [db:pir] |
| 5120443_c3_262 | 3206 | 6860 | 1875 | 624 | 384 | 6.50E-33 | [ln:bsu18943] [ac:u18943:x99465] [gn:mtlr] [or:bacillus stearothermophilus] [db:genpept-bct] [de:bacillus stearothermophilus mannitol transport protein (mtla), putative transcriptional regulator (mtlr), mannitol enzyme iia (mtlf) and mannitol-1-phosphate de |
| 5120713_f2_43 | 3207 | 6861 | 1992 | 663 | 625 | 3.40E-61 | [ac:p46321] [gn:celr] [or:bacillus subtilis] [deputative cel operon regulator] [sp:p46321] [dbs:swissprot] |
| 5125687_c1_9 | 3208 | 6862 | 378 | 125 | 279 | 1.60E-24 | [ac:p35881] [or:lactococcus lactis] [sr:,subsplactis:streptococcus lactis] [de: transposase for insertion sequence element is 905] [sp:p35881] [dbs:swissprot] |
| 5129627_c2_121 | 3209 | 6863 | 507 | 168 | 140 | 8.50E-10 | [ln:lcu28163] [ac:u28163] [pn:eiia-man] [gn:mana] [or:lactobacillus curvatus] [db:genpept-bct] [de:lactobacillus curvatus phosphoenolpyruvate: mannosephosphotransferase eiia-man (mana), eiib-man (manb), and eiic-man (manc) genes, complete cds and ciid-man ( |
| 5130327_c1_7 | 3210 | 6864 | 660 | 219 | 686 | 1.20E-67 | [ac:q69484] [or:lactobacillus acidophilus] [ec:2.1.1.113=2.1.1.76] [de: (ec 2.7.1.76) subunit 2] [sp:q59484] [dbs:swissprot] |
| 5132625_f3_7 | 3211 | 6865 | 342 | 113 | 225 | 8.40E-19 | [ac:p39044] [gn:x] [or:bacillus sphaericus] [de:30s ribosomal protein s14 homolog] [sp:p39044] [dbs:swissprot] |
| 5132942_f2_6 | 3212 | 6866 | 2109 | 702 | 1624 | 4.70E-167 | [ac:d69815] [pn:conserved hypothetical protein yfmi] [gn:yfmi] [or:bacillus subtilis] [db:pir] |
| 5136011_c3_90 | 3213 | 6867 | 372 | 123 | 70 | 0.82 | [ac:q02522] [gn:hpt] [or:lactococcus lactis] [sr:,subsplactis:streptococcus lactis] [ec:2.4.2.8] [de:(hgprtase)] [sp:q02522] [dbs:swissprot] |
| 5136578_f2_3 | 3214 | 6868 | 1437 | 478 | 1409 | 2.90E-144 | [ln:lsaj1330] [ac:aj001330] [pn:arginine/ornithine antiporter] [gn:arcd] [or: lactobacillus sake] [db:genpept-bct] [de:lactobacillus sake dna encoding the arginine-deiminase pathway genes.] [le:4720] [re:6147] [di:direct] |
| 5157253_f1_4 | 3215 | 6869 | 561 | 186 | 99 | 0.029 | [ac:q04893] [gn:ymr317w:ynr9924.09] [or:saccharomyces cerevisiae] [sr,: baker's yeast] [de:hypothetical 113.1 kd protein in pre5-fct4 intergenic region] [sp:q04893] |
| 516027_f3_35 | 3216 | 6870 | 579 | 192 | 61 | 0.5 | [ln:humga] [ac:d21238] [pn:glutaredoxin] [or:homo sapiens] [sr:homo sapiens brain cortex (library: lambda zap 11) cdna to mrna] [db:genpept-pri2] [ec: 1.8.4.4.] [de:human mrna for glutaredoxin, complete cds.] [le:4] [re:324] [di:direct] |
| 5162503_f1_8 | 3217 | 6871 | 228 | 75 | 140 | 8.50E-10 | [ac:p53071] [gn:yg1235w] [or:saccharomyces cerevisiae] [sr,:baker's yeast] [de:hypothetical 19.3 kd protein in hap2-ade5,6 intergenic region] [sp:p53071] [dbs:swissprot] |

TABLE 2-continued

| Orf | NT Seq ID | AA Seq ID | NT Orf length | AA Orf length | Score | Probability | Description |
|---|---|---|---|---|---|---|---|
| 5167327_c3_47 | 3218 | 6872 | 195 | 64 | 50 | 0.022 | [ln:cjgfrec] [ac:aj001298] [pn:igfl receptor] [gn:igfl] [fn:growth factor receptor] [or:callithrix jacchus] [db:genpept-pri2] [de:callithrix jacchus mrna fragment for igfl receptor.] [le:<1] re: |
| 5189037_c2_36 | 3219 | 6873 | 711 | 236 | 680 | 5.10E-67 | [ac:q06239] [gn:vanr] [or:enterococcus faecium] [sr:streptococcus faecium] [de:regulatory protein vanr] [sp:q06239] [db:swissprot] |
| 519541_c1_8 | 3220 | 6874 | 552 | 183 | 689 | 5.70E-68 | [ac:p26830] [or:bacillus sp] [sr:syn-t.] [de:hypothetical protein in ndh 5'region (fragment)] [sp:p26830] [db:swissprot] |
| 5197263_f1_1 | 3221 | 6875 | 879 | 292 | 687 | 9.20E-68 | [ac:a69992] [pn:conserved hypothetical protein ytfp] [gn:ytfp] [or:bacillus subtilis] [db:pir] |
| 5198387_c3_27 | 3222 | 6876 | 687 | 229 | 367 | 4.90E-33 | [ac:p38050] [gn:pbpf:pona] [or:bacillus subtilis] [de:penicillin-binding protein 1a (pbp-1a)] [sp:p38050] [db:swissprot] |
| 5199077_c2_233 | 3223 | 6877 | 984 | 327 | 922 | 1.20E-92 | [ac:q60040] [gn:uxua] [or:thermotoga neapolitana] [ec:4.2.1.8] [de:mannonate dehydratase, (d-mannonate hydrolase)] [sp:q60040] [db:swissprot] |
| 5199090_f1_2 | 3224 | 6878 | 363 | 120 | 281 | 9.70E-25 | [ln:af002276] [ac:af002276] [or:lactobacillus sake] [db:genpept-bct] [de:lactobacillus sake inducing peptide preprotein (sppip), histidine protein kinase homolog (sppk), response regulator homolog (sppr), sakeacin p preprotein (sppa), putative sakacin p immu |
| 5203831_f3_6 | 3225 | 6879 | 240 | 79 | 111 | 1.20E-05 | [ac:a70009] [pn:two-component sensor histidine kinase [yuf homolog yuff] [gn:yuff] [or:bacillus subtilis] [db:pir] |
| 5209718_f3_53 | 3226 | 6880 | 342 | 113 | 106 | 7.90E-05 | [ac:p07197] [gn:nefm:nfm] [or:homo sapiens] [sr:human] [de:neurofilament triplet m protein (160 kd neurofilament protein) (nf-m)] [sp:p07197] [db:swissprot] |
| 523938_c2_58 | 3227 | 6881 | 312 | 103 | 64 | 0.22 | [ac:a69851] [pn:hypothetical protein yjia] [gn:yjia] [or:bacillus subtilis] [db:pir] |
| 5250311_c1_19 | 3228 | 6882 | 708 | 235 | 784 | 4.90E-78 | [ln:lcaj3194] [ac:aj003194] [pn:catabolite regulator protein] [gn:ccpa] [or:lactobacillus casei] [db:genpept-bct] [de:lactobacillus casei ccpa & tnp genes.] [le:298] [re:1299] [di:direct] |
| 5255062_c2_250 | 3229 | 6883 | 189 | 62 | 66 | 0.073 | [ln:celf01f1] [ac:u13070] [gn:f01f1.14] [or:caenorhabditis elegans] [sr:caenorhabditis elegans strain=bristol n2] [db:genpept-inv] [de:caenorhabditis elegans cosmid f01f1.] [nt:weakly similar to zk507.4] [le:40057:40316:40417] [re:40271:40369:40549] [di:c |
| 5256593_c1_6 | 3230 | 6884 | 510 | 170 | 209 | 1.20E-16 | [ac:77364] [gn:ybbz] [or:escherichia coli] [de:hypothetical 38.7 kd protein in gip-fdra intergenic region] [sp:p77364] [db:swissprot] |
| 5256941_c3_69 | 3231 | 6885 | 480 | 159 | 493 | 3.30E-47 | [ac:d69633] [pn:glutamine abc transporter (glutamine-binding protein) glnh] [gn:glnh] [or:bacillus subtilis] [db:pir] |
| 5266083_c1_19 | 3232 | 6886 | 1035 | 344 | 420 | 1.80E-39 | [ac:p42422] [gn:yxdk:b65e] [or:bacillus subtilis] [ec:2.7.3—] [de:(ec 2.7.3—] [sp:p42422] [db:swissprot] |
| 5287565_c2_177 | 3233 | 6887 | 198 | 65 | 136 | 1.70E-08 | [ln:instranspo] [ac:134675] [pn:tranposase] [or:insertion sequence is 1251] [sr: insertion sequence is 1251 dna] [db:genpept-bct] [de:insertion sequence is 1251 from enterococcus faecium transposase gene, complete cds.] [nt:putative] [le:128] [re:1417] [di:di |
| 5270942_f2_9 | 3234 | 6888 | 207 | 68 | 52 | 0.022 | [ac:p51030] [gn:wnt-8c] [or:gallus gallus] [sr:chicken] [de:cwnt-8c protein precursor] [sp:p51030] [db:swissprot] |
| 5272126_c3_52 | 3235 | 6889 | 2166 | 721 | 1298 | 1.70E-132 | [ac:p55465] [gn:y4gi] [or:rhizobium sp] [sr:ngr234,] [de:hypothetical 102.8 kd protein y4gi] [sp:p55465] [db:swissprot] |
| 5273317_c3_153 | 3236 | 6890 | 2229 | 742 | 308 | 3.60E-42 | [ln:mtv039] [ac:a1021942] [pn:hypothetical protein] [gn:mtv039.22] [or: mycobacterium tuberculosis] [db:genpept] [de:mycobacterium tuberculosis sequence v039.] [nt:mtv039.22, len: 877. unknown. contains ps06699] [le:25221] [re:27854] [di:direct] |

TABLE 2-continued

| Orf | NT Seq ID | AA Seq ID | NT Orf length | AA Orf length | Score | Probability | Description |
|---|---|---|---|---|---|---|---|
| 5275_f3_25 | 3237 | 6891 | 999 | 332 | 912 | 1.30E-91 | [ac:p46336] [gn:iols:ss92er] [or:bacillus subtilis] [de:iols protein] [sp:p46336] [db:swissprot] |
| 5276411_c3_35 | 3238 | 6892 | 450 | 149 | 356 | 1.10E-32 | [ln:af000954] [ac:af000954] [pn:diacylglycerol kinase] [gn:dgk] [or:streptococcus mutans] [db:genpept-bct] [de:streptococcus mutans diacyglycerol kinase (dgk) gene, complets cds, and g protein (sgp) gene, partial cds.] [le:677] [re:1090] [di:direct] |
| 5277212_f3_5 | 3239 | 6893 | 1311 | 436 | 1825 | 2.40E-188 | [ln:af044978] [ac:af044978] [pn:putative uracil permease] [gn:pyrp] [or:enterococcus faecalis] [db:genpept] [de:enterococcus faecalis pyr operon: attenuation regulatory protein (pyrr) and putative uracil permease (pyrp) genes, complete cds: and aspartate tr |
| 5286562_c1_56 | 3240 | 6894 | 186 | 61 | 51 | 0.057 | [ac:s67981] [pn:hemoglobin beta-i chain] [cl:globin:globin homology] [or:muraena helena] [db:pir] |
| 5289812_c3_11 | 3241 | 6895 | 792 | 263 | 686 | 1.20E-67 | [ac:p37545] [gn:yabd] [or:bacillus subtilis] [de:hypothetical 29.2 kd protein in mets-ksga intergenic region] [sp:p37545] [db:swissprot] |
| 5289816_c2_143 | 3242 | 6896 | 1512 | 503 | 1198 | 6.50E-122 | [ac:h69593] [pn:beta-glucosidase bglh] [gn:bglh] [or:bacillus subtilis] [db:pir] |
| 5291037_c3_74 | 3243 | 6897 | 1887 | 628 | 310 | 2.40E-36 | [ac:b70001] [pn:abc transporter (permease) homolog ytsd] [gn:ytsd] [or:bacillus subtilis] [db:pir] |
| 5292327_c3_67 | 3244 | 6898 | 519 | 172 | 359 | 5.30E-33 | [ac:q06242] [gn:vanz] [or:enterococcus faecium] [sr:streptococcus faecium] [de:vanz protein] [sp:q06242] [db:swissprot] |
| 5312510_f1_6 | 3245 | 6899 | 267 | 88 | 86 | 0.0017 | [ac:p54551] [gn:yqef] [or:bacillus subtilis] [de:precursor] [sp:p54451] [db:swissprot] |
| 5314377_f1_8 | 3246 | 6900 | 219 | 72 | 57 | 0.41 | [ac:s80338] [gn:d5 dopamine receptor] [or:bos taurus] [sr:cattle adrenal chromaffin cells] [db:genpept-mam] [de:d5 dopamine receptor [cattle, adrenal chromaffin cells, mrna partial, 209 nt].] [le:1] [re:209] [di:direct] |
| 5314712_c2_153 | 3247 | 6901 | 306 | 101 | 76 | 0.036 | [ln:ggarbp] [acy14166] [pn:attachment region binding protein] [gn:arbp] [or:gallus gallus] [sr:chicken] [db:genpept-vrt] [de:gallus gallus mrna for attachment region binding protein (arbp).] [le:46] [re: |
| 5315625_f3_20 | 3248 | 6902 | 270 | 89 | 101 | 1.20E-05 | [ln:ce04f8] [ac:z66565] [pn:t04f8.8] [or:caenorhabditis elegans] [db:genpept-inv] [de:caenorhabditis elegans cosmid t04f8, complete sequence.] [nt:cdna est yk12f11.5 comes from this gene] [le:34969] [re:35259] [di:direct] |
| 5319063_c1_13 | 3249 | 6903 | 294 | 97 | 196 | 9.90E-16 | [ac:b69770] [pn:conserved hypothetical protein ydas] [gn:ydas] [or:bacillus subtilis] [db:pir] |
| 5323390_c1_9 | 3250 | 6904 | 1140 | 379 | 761 | 1.30E-75 | [ln:ac000792] [ac:ae000792] [pn:outer surface protein, putative] [gn:bbb07] [or:borrelia burgdorferi] [sr:lyme disease spirochete] [db:genpept-bct] [de:borrelia burgdorferi plasmid cp26, complete plasmid sequence.] [nt:similar to gb:m88764 sp:q09090 pid:4 |
| 5329377_c1_21 | 3251 | 6905 | 993 | 330 | 173 | 6.80E-11 | [ln:u70619] [ac:u70619] [pn:heroin esterase] [gn:her] [fn:hydrolyses c3-acetyl ester and c6-acetyl ester] [or:rhodococcus sp.] [sr:rhodococcus sp] [db:genpept-bct] [de:rhodococcus sp. heroin esterase (her) gene, complete cds.] [nt:acetylmorphine carboxyes |
| 5345406_c2_20 | 3252 | 6906 | 417 | 138 | 288 | 1.10E-24 | [ac:q02469] [or:shewanella putrefaciens] [ec:1.3.99.1] [de:(flavocytochrome c) ] [sp:q02469] [db:swissprot] |
| 5345437_f3_26 | 3253 | 6907 | 201 | 66 | 55 | 0.093 | [ac:a70010] [pn:nadh dehydrogenase homolog yuft] [gn:yuft] [or:bacillus subtilis] [db:pir] |
| 5351552_f3_24 | 3254 | 6908 | 189 | 62 | 52 | 0.87 | [ac:p05338] [gn:trxa] [or:griffithsia pacifica] [de:thioredoxin] [sp:p50338] [db:swissprot] |

TABLE 2-continued

| Orf | NT Seq ID | AA Seq ID | NT Orf length | AA Orf length | Score | Probability | Description |
|---|---|---|---|---|---|---|---|
| 5352162_c2_22 | 3255 | 6909 | 225 | 74 | 246 | 2.00E-20 | [ac:s19723] [pn:dihydrolipoamide dehydrogenase;pyruvate dehydrogenase complex chain c3] [gn:pdhd] [cl:dihydrolipoamide dehydrogenase: dihydrolipoamide dehydrogenase homology] [or:*staphylococcus aureus*] [ec:1.8.1.4] [db:pir] |
| 5352188_f2_72 | 3256 | 6910 | 933 | 310 | 622 | 7.10E-61 | [ac:p42332] [gn:bcra] [or:*bacillus licheniformis*] [de:bacitracin transport atp-binding protein bcra] [sp:p42332] [db:swissprot] |
| 5352312_f2_45 | 3257 | 6911 | 534 | 177 | 61 | 0.43 | [ac:x07671] [or:*mitochondrion artemia sp.*] [sr:artemia sp] [db:genpept-inv] [de:artemia mitochondrial nd2 gene for nadh dehydrogenase subunit 2(part).] [nt:nd-2 protein (83 aa)] [le:<1] [re: |
| 5353386_f3_117 | 3258 | 6912 | 1446 | 481 | 944 | 5.40E-95 | [ac:p09323] [gn:nage;psin] [or:*escherichia coli*] [ec:2.7.1.69] [de:enzyme ii, abc component), (cii-nag)] [sp:p09323] [db:swissprot] |
| 5353588_c2_60 | 3259 | 6913 | 1131 | 376 | 637 | 1.80E-62 | [ac:q47155;q47683] [gn:dinp] [or:*escherichia coli*] [de:dna-damage-inducible protein p] [sp:q47155;q47683] [db:swissprot] |
| 5354713_c1_44 | 3260 | 6914 | 873 | 291 | 988 | 1.20E-99 | [ac:c09662] [pn:udp-n-acetylmuramate-alanine ligase murc] [gn:murc] [or:*bacillus subtilis*] [db:pir] |
| 5355305_c2_58 | 3261 | 6915 | 840 | 279 | 820 | 7.40E-82 | [ac:p37541] [gn:yaat] [or:*bacillus subtilis*] [de:hypothetical 31.2 kd protein in xpac-abrb intergenic region] [sp:p37541] [db:swissprot] |
| 5359753_c2_21 | 3262 | 6916 | 303 | 100 | 196 | 9.90E-16 | [ac:h69891] [pn:hypothetical protein yner] [gn:yner] [or:*bacillus subtilis*] [db:pir] |
| 5361561_f1_1 | 3263 | 6917 | 216 | 71 | 66 | 0.18 | [ac:p24876] [or:*ascaris suum*] [sr:pig roundworm;*ascaris lumbricoides*] [ec:3.6.1.34] [de:atp synthase a chain, (protein 6)] [sp:p24876] [db:swissprot] |
| 5370937_c2_48 | 3264 | 6918 | 1761 | 586 | 1222 | 1.90E-124 | [ac:b69618] [pn:dna polymerase iii (gamma and tau subunits) dnax] [gn:dnax] [or:*bacillus subtilis*] [db:pir] |
| 5371066_c3_184 | 3265 | 6919 | 309 | 102 | 54 | 0.67 | [ac:p39236] [gn:y05m:mobd.6;tk-5] [or:bacteriophage t4] [de:hypothetical 7.1 kd protein in nrdc-tk intergenic region] [sp:p39236] [db:swissprot] |
| 54133_c1_88 | 3266 | 6920 | 2130 | 709 | 67 | 0.58 | [ac:a45692] [pn:polymerase-associated phosphorprotein p] [or:vesicular stomatitis virus nonstructural protein] [or:*vesicular stomatitis new jersey virus*] [db:pir] |
| 54678_f1_4 | 3267 | 6921 | 624 | 207 | 709 | 4.30E-70 | [ac:s68609] [pn:recombinase sin] [or:*staphylococcus aureus*] [db:pir] |
| 546888_c1_56 | 3268 | 6922 | 207 | 68 | 51 | 0.16 | [ln:cec36c5] [ac:af016444] [gn:c36c5.8] [or:*caenorhabditis elegans*] [sr:*caenorhabditis elegans* strain-bristol n2] [db:genpept-inv] [de:*caenorhabditis elegans* cosmid c36c5.] [re:5664:5978:6222] [re:5818:6173:6407] [di:complement|join] |
| 54688_c1_89 | 3269 | 6923 | 711 | 236 | 108 | 5.70E-06 | [ac:g70065] [pn:hypothetical protein ywpe] [gn:ywpe] [or:*bacillus subtilis*] [db:pir] |
| 551552_c1_16 | 3270 | 6924 | 909 | 302 | 70 | 0.13 | [ln:hsved56] [ac:z30676] [pn:ig heavy chain (vh4) v region (vdj)] [or:*homo sapiens*] [sr:human] [db:genpept-pri1] [de:*h. sapiens* mrna for rearranged ig heavy chain variable region (vhr) (vdj) hsved56.] [le:<1] [re: |
| 55437_c3_38 | 3271 | 6925 | 1023 | 340 | 1327 | 1.40E-135 | [ac:p13242] [gn:ctra] [or:*bacillus subtilis*] [ec:6.3.4.2] [de:ctp synthase, (utp-ammonia ligase)] (ctp synthetase)] [sp:p13242] [db:swissprot] |
| 55443_f2_44 | 3272 | 6926 | 825 | 274 | 115 | 1.40E-06 | [ln:af020798] [ac:af020798] [pn:repressor] [or:*streptococcus thermophilus* bacteriophage tp-j34] [db:genpept] [de:*streptococcus thermophilus* bacteriophage lysogeny module, integrase homolog (int), putative host cell surface-exposed lipoprotein, putative meta |
| 556578_c1_27 | 3273 | 6927 | 663 | 220 | 507 | 1.10E-48 | [ac:p42399] [gn:ycka] [or:*bacillus subtilis*] [de:probable amino-acid abc transporter permease protein] [sp:p42399] [db:swissprot] |
| 557812_f3_34 | 3274 | 6928 | 236 | 79 | 122 | 6.90E-08 | [ac:p37501] [gn:yybc] [or:*bacillus subtilis*] [de:hypothetical 17.6 kd protein in cotf-tetb intergenic region] [sp:p37501] [db:swissprot] |
| 562537_f1_9 | 3275 | 6929 | 1785 | 594 | 110 | 1.40E-07 | [ac:p42377] [or:*lactococcus lactis*] [sr:subsp.lactis:*streptococcus lactis*] [de:hypothetical 70.0 kd protein in dnak 3'region (orf4)] [sp:p42377] [db:swissprot] |

TABLE 2-continued

| Orf | NT Seq ID | AA Seq ID | NT Orf length | AA Orf length | Score | Probability | Description |
|---|---|---|---|---|---|---|---|
| 568787_c1_16 | 3276 | 6930 | 1608 | 536 | 2327 | 1.50E-241 | [ln:spu72720] [ac:u72720] [pn:heat shock protein 70] [gn:dnak] [or:streptococcus pneumoniae] [db:genpept-bct] [de:streptococcus pneumoniae heat shock protein 70 (dnak) gene, complete cds and dnaj (dnaj) gene, partial cds.] [nt:hsp70: partial peptide sequen |
| 578760_c3_149 | 3277 | 6931 | 1206 | 401 | 103 | 0.00022 | [ln:af011378] [ac:af011378] [pn:unknown] [or:bacteriophage sk1] [db:genpept-phg] [de:bacteriophage sk1 complete genome.] [nt:orf4] [le:2697] [re:3833] [di:direct] |
| 57_c2_64 | 3278 | 6932 | 954 | 317 | 137 | 3.00E-07 | [ln:styvb12aa] [ac:112006] [pn:regulatory protein] [gn:pocr] [or:salmonella typhimurium] [sr:salmonella typhimurium (strain lt2) dna] [db:genpept-bct] [de:salmonella typhimurium vitamin b12/cobalamin biosynthetic (cob) operon 5' end including: (cbia, cbib, |
| 583285_c3_66 | 3279 | 6933 | 885 | 294 | 427 | 3.30E-40 | [ac:069786] [pn:glycoprotein endopeptidase homolog ydic] [gn:ydic] [or:bacillus subtilis] [db:pir] |
| 585000_f2_19 | 3280 | 6934 | 558 | 185 | 88 | 0.29 | [ac:p87024] [gn:skn1] [or:candida albicans] [sr:,yeast] [de:beta-glucan synthesis-associated protein skn1] [sp:p87024] [db:swissprot] |
| 585200_c1_110 | 3281 | 6935 | 1842 | 613 | 1100 | 4.80E-114 | [ac:q11047] [gn:mtcy50.10] [or:mycobacterium tuberculosis] [de:hypothetical abc transporter atp-binding protein cy50.10] [sp:q11047] [db:swissprot] |
| 585939_c1_7 | 3282 | 6936 | 1071 | 356 | 384 | 1.20E-35 | [ac:p45637] [or:corynebacterium glutamicum] [de:hypothetical 33.0 kd protein in prob-proa intergenic region] [sp:p45637] [db:swissprot] |
| 585966_f1_5 | 3283 | 6937 | 285 | 94 | 353 | 2.30E-32 | [ac:p27148] [gn:secy] [or:lactococcus lactis] [sr:,subsp:lactis:streptococcus lactis] [de:preprotein translocase secy subunit] [sp:p27148] [db:swissprot] |
| 586063_f1_5 | 3284 | 6938 | 819 | 272 | 462 | 6.40E-44 | [ac:p54154] [gn:yppp] [or:bacillus subtilis] [de:reductase)] [sp:p54154] [db:swissprot] |
| 586716_f1_1 | 3285 | 6939 | 522 | 173 | 401 | 1.90E-37 | [ac:o07513] [gn:hit] [or:bacillus subtilis] [de:hit protein] [sp:o07513] [db:swissprot] |
| 586145o_f1_1 | 3286 | 6940 | 195 | 64 | 57 | 0.41 | [ln:wsaj3049] [ac:aj003049] [gn:orf102] [or:wolinella succinogenes] [db:genpept-bct] [de:wolinella succinogenes hydd, hyde, pand and ispa genes: orf102 and orf341.] [nt:hypothetical protein: similar to hp0035 from] [le:2610] [re:2918] [di:direct] |
| 5864155_c1_7 | 3287 | 6941 | 1692 | 563 | 703 | 1.90E-69 | [ac:b64622] [pn:osmoprotection protein] [or:helicobacter pylori] [db:pir] |
| 5865400_f1_6 | 3288 | 6942 | 468 | 155 | 68 | 0.066 | [ac:p54525] [gn:yqii] [or:bacillus subtilis] [de:hypothetical 6.7 kd protein in spo0a-mmga intergenic region] [sp:p54525] [db:swissprot] |
| 5867300_c1_134 | 3289 | 6943 | 1611 | 536 | 145 | 8.50E-07 | [ln:strmry] [ac:m58461] [pn:m protein trans-acting positive regulator] [gn:mry] [or:streptococcus pyogenes] [sr:streptococcus pyogenes (strain d471) dna] [db:genpept-bct] [de:s. pyogenes trans-acting positive regulator of m protein (mry) gene, complete cds. |
| 5870260_f1_10 | 3290 | 6944 | 258 | 85 | 78 | 0.0032 | [ac:p29472] [or:lactobacillus acidophilus] [de:hypothetical 14.4 kd protein in laf 3'region] [sp:p29472] [db:swissprot] |
| 5870937_f1_1 | 3291 | 6945 | 1479 | 492 | 1200 | 4.00E-122 | [ln:lsaj1330] [ac:aj001330] [pn:arginine/ornithine antiporter] [gn:arcd] [or:lactobacillus sake] [db:genpept-bct] [de:lactobacillus sake dna encoding the arginine-deiminase pathway genes.] [le:4720] [re:6147] [di:direct] |
| 5875000_c2_31 | 3292 | 6946 | 2190 | 729 | 1015 | 1.60E-102 | [ac:o08365] [gn:mtcy21c12.02] [or:mycobacterium tuberculosis] [ec:3.6.1.—] [de:putative cation-transporting atpase cy21c12.02,] [sp:o08365] [db:swissprot] |
| 5879557_f1_5 | 3293 | 6947 | 1020 | 339 | 196 | 2.20E-15 | [ln:af008220] [ac:af008220] [pn:transcription regulator] [gn:ytdq] [or:bacillus subtilis] [db:genpept-bct] [de:bacillus subtilis rmb-dnab genomic region.] [le:93357] [re:94091] [di:complement] |

TABLE 2-continued

| Orf | NT Seq ID | AA Seq ID | NT Orf length | AA Orf length | Score | Probability | Description |
|---|---|---|---|---|---|---|---|
| 5884383_c3_112 | 3294 | 6948 | 225 | 74 | 57 | 0.085 | [ln:cef56d5] [ac:z69662] [pn:tf56d5.2] [or:caenorhabditis elegans] [db:genpept-inv] [de:caenorhabditis elegans cosmid f56d5, complete sequence.] [nt:protein predicted using genefinder] [le:3592:3692:4097] [re:3637:4054:4189] [di:complementjoin] |
| 5891652_c3_27 | 3295 | 6949 | 528 | 175 | 409 | 3.20E-38 | [ln:af004835] [ac:af004835] [pn:putative abc-transporter tycd] [gn:tycd] [or:brevibacillus brevis] [db:genpept-bct] [de:brevibacillus brevis tyrocidine biosynthesis operon, tyrocidine synthetase 1 (tyca), tyrocidine synthetase 2 (tycb), tyrocidine synthetas |
| 5894818_c1_11 | 3296 | 6950 | 1047 | 348 | 73 | 0.077 | [ln:lbphigle] [ac:x98106] [gn:rorf58] [or:bacteriophage phigle] [db:genpept-phg] [de:lactobacillus bacteriophage phigle complete genomic dna.] [le:42253:1] [re:42259:170] [di:complementjoin] |
| 589578_f1_1 | 3297 | 6951 | 729 | 242 | 125 | 4.30E-05 | [ln:spac7d4] [ac:z99532] [pn:hypothetical protein] [gn:spac7d4.12c] [or:schizosaccharomyces pombe] [sr:fission yeast] [db:genpept-pln] [de:s. pombe chromosome i cosmid c7d4.] [nt:spac7d4.12c, unknown, len:759aa, similar eg.] [le:23241] [re:25520] [di:compl |
| 5900252_c2_72 | 3298 | 6952 | 621 | 206 | 78 | 0.95 | [ln:att18b16] [ac:a1021687] [pn:hypothetical protein] [gn:t18b16.10] [or:arabidopsis thaliana] [sr:thale cress] [db:genpept-pln] [de:arabidopsis thaliana dna chromosome 4, bac clone t18b16 (esaiiproject).] [le:956.1311:1728] [re:1188:1466:1792] [di:comp |
| 5900442_c3_151 | 3299 | 6953 | 417 | 138 | 62 | 0.22 | [ln:cpu53466] [ac:u53466] [or:cydia pomonella granulosis virus] [db:genpept-vrl] [de:cydia pomonella granulosis virus orf131 gene, partial cds, orf151, orf15r, orf161, orf171 genes, complete cds, orf17r gene, partial cds.] [nt:orf15r: similar to acmnpv orf2 |
| 5901532_c1_55 | 3300 | 6954 | 942 | 313 | 405 | 7.10E-38 | [ln:mtcy1667] [ac:z81331] [pn:unknown] [gn:mtcy1b7.07] [or:mycobacterium tuberculosis] [db:genpept-bct] [de:mycobacterium tuberculosis cosmid scy1667.] [nt:mtcy1b7.07, ugpa homologue, len: 303, similar to] [le:6854] [re:7765] [di:direct] |
| 5914818_c3_60 | 3301 | 6955 | 1188 | 395 | 716 | 7.80E-71 | [ac:69979] [pn:folate metabolism homolog yyrl] [gn:yyrl] [or:bacillus subtilis] [db:pir] |
| 5939790_c3_61 | 3302 | 6956 | 513 | 170 | 298 | 1.50E-26 | [ac:s74334] [pn:biotin carboxyl carrier protein:hypothetical protein slr0435: hypothetical protein slr0435] [gn:accb] [or:synechocystis sp.] [srpcc 6803; ,  pcc 6803] [srpcc 6803, ] [dbpir] |
| 5959693_c1_61 | 3303 | 6957 | 207 | 68 | 80 | 0.0019 | [ln:sac194] [ac:v01278:j01755:j01756:j01757:j01758:v01279:v01280] [or:staphylococcus aureus] [db:genpept-bct] [de:s. aureus plasmid pc194 orfs a,b,c,d,e, and f.] [nt:reading frame e] [le:857] [re: |
| 5978127_c3_28 | 3304 | 6958 | 216 | 71 | 73 | 0.024 | [ln:a25773] [ac:a25773] [pn:2s albumin protein] [or:raphanus sativus] [sr:radish] [db:genpept-pat] [de:r. sativus 2s albumin gene.] [le:16] [re:543] [di:direct] |
| 5985052_c2_18 | 3305 | 6959 | 231 | 76 | 66 | 0.19 | [ln:d887744] [ac:d887744] [pn:ar782] [or:arabidopsis thaliana] [sr:arabidopsis thaliana cdna to mrna] [db:genpept-pln] [de:arabidopsis thaliana mrna for ar782, partial cds.] [le:<1] [re:621] [di:direct] |
| 5988561_f3_39 | 3306 | 6960 | 195 | 64 | 100 | 1.50E-05 | [ln:humdync] [ac:107809] [pn:dynamin] [or:homo sapiens] [sr:homo sapiens (library: stratagene) brain (temporal cortex) cdna t] [db:genpept-pri1] [de:human dynamin mrna, alternative exon and 3' end of cds.] [nt:isoform] [le:<1] [re:396] [di:direct] |
| 6016091_c2_58 | 3307 | 6961 | 519 | 172 | 75 | 0.96 | [ac:q58218] [gn:mj0808] [or:methanococcus jannaschii] [de:hypothetical protein mj0808] [sp:q58218] [db:swissprot] |

TABLE 2-continued

| Orf | NT Seq ID | AA Seq ID | NT Orf length | AA Orf length | Score | Probability | Description |
|---|---|---|---|---|---|---|---|
| 602211_f2_23 | 3308 | 6962 | 213 | 70 | 58 | 0.68 | [ln:llksiv] [ac:129226] [or:insertion sequence kis-element] [sr:bacteriophage ll-k dna; insertion seuence kis-elemen] [db:genpept-phg] [de:insertion sequence kis-element (in bacteriophage ll-k) 34.8 kda protein gene, complete cds.] [nt:18.7 kda protein] |
| 604217_c2_41 | 3309 | 6963 | 243 | 80 | 67 | 1.10E-05 | [ln:cee02a10] [ac:z81053] [pn:c02a10.2] [or:caenorhabditis elegans] [db:genpept-inv] [de:caenorhabditis elegans cosmid e02a10, complete sequence.] [nt:protein predicted using genefinder] [le:11007:11551:11984] [re:11504:11813:12016] [di:complement join] |
| 6047881_f2_6 | 3310 | 6964 | 192 | 63 | 109 | 4.40E-06 | [ac:p15425] [gn:ninaa] [or:drosophila melanogaster] [sr:,fruit fly] [ec:5.2.1.8] [de:precursor, (ppiase) (rotamase)] [sp:p15425] [db:swissprot] |
| 6048427_f2_12 | 3311 | 6965 | 288 | 95 | 71 | 0.31 | [ln:dru57964] [ac:u57964] [pn:ribonucleotide reductase protein r1 class i] [or:danio rerio] [sr:zebrafish] [db:genpept-vrt] [ec:1.17.4.1.] [de:danio rerio ribonucleotide reductase protein r1 class i mrna, complete cds.] [le:125] [re:2509] [di:direct] |
| 6051338_c1_50 | 3312 | 6966 | 1236 | 411 | 2020 | 5.10E-209 | [ln:efu35366] [ac:u35366] [gn:tnp] [or:enterococcus faecalis] [db:genpept-bct] [de:enterococcus faecalis insertion sequence is 16 putative transposase (tnp) gene, complete cds.] [nt:putative transposase] [le:109] [re:1296] [di:direct] |
| 6053450_f2_25 | 3313 | 6967 | 384 | 127 | 62 | 0.99 | [ac:s72822] [pn:hypothetical protein bl620_c3_237] [or:mycobacterium leprae] [db:pir] |
| 6054077_c2_27 | 3314 | 6968 | 483 | 161 | 320 | 4.20E-28 | [ln:ab004867] [ac:ab004867] [pn:beta-galactosidase] [gn:lac] [or:lactobacillus acidophilus] [sr:lactobacillus acidophilus (strain jcm 1229, isolate:huma] [db:genpept-bct] [de:lactobacillus acidophilus gene for beta-galactosidase, complete cds.] [le:1] [re |
| 6054627_c1_49 | 3315 | 6969 | 360 | 119 | 331 | 4.90E-30 | [ln:af010281] [ac:af010281] [pn:groes] [gn:groes] [or:lactobacillus zeae] [db:genpept-bct] [de:lactobacillus zeae groes (groes) and groel (groel) genes, complete cds.] [nt:hsp10; molecular chaperone] [le:831] [re:1112] [di:direct] |
| 6057318_f3_21 | 3316 | 6970 | 1695 | 564 | 1320 | 7.70E-135 | [ac:p17894:p19671] [gn:recn] [or:bacillus subtilis] [de:dna repair protein recn (recombination protein n)] [sp:p17894:p19671] [db:swissprot] |
| 6057962_c1_53 | 3317 | 6971 | 318 | 105 | 60 | 0.81 | [ac:p49622:q27486] [gn:c54c6.1] [or:caenorhabditis elegans] [de:probable 60s ribosomal protein 137] [sp:p49622:q27486] [db:swissprot] |
| 6057962_c2_121 | 3318 | 6972 | 318 | 105 | 65 | 0.074 | [ac:p49622:q27486] [gn:c54c6.1] [or:caenorhabditis elegans] [de:probable 60s ribosomal protein 137] [sp:p49622:q27486] [db:swissprot] |
| 6058387_c2_53 | 3319 | 6973 | 987 | 328 | 650 | 7.70E-64 | [ac:h69620] [pn:malonyl coa-acyl carrier protein transacylase fabd] [gn:fabd] [or:bacillus subtilis] [db:pir] |
| 6058527_f2_5 | 3320 | 6974 | 291 | 96 | 76 | 0.074 | [ln:mhu50209] [ac:u50209] [pn:65 kda protein] [gn:p65] [or:mycoplasma hyopneumoniae] [sr:mycoplasma hyopneumoniae strain=232] [db:genpept-bct] [de:mycoplasma hyopneumoniae 65 kda protein (p65) gene, complete cds.] [le:1] [re:1803] [di:direct] |
| 6064813_c3_144 | 3321 | 6975 | 960 | 319 | 801 | 7.70E-80 | [ac:c69791] [pn:methanol dehydrogenase regulation homolog yeac] [gn:yeac] [or:bacillus subtilis] [db:pir] |
| 6065925_f2_16 | 3322 | 6976 | 303 | 100 | 155 | 5.00E-11 | [ln:bacist1] [ac:d10543:d90504] [pn:orf1] [gn:is-t1] [or:bacillus stearothermophilus] [sr:bacillus stearothermophilus (strain:nca 1503) dna] [db:genpept-bct] [de:b. stearothermophilus is-t1 gene,] [nt:author-given protein sequence is in conflict with] [le |
| 6069005_c2_49 | 3323 | 6977 | 729 | 242 | 253 | 9.00E-22 | [ac:p54168] [gn:ypg] [or:bacillus subtilis] [de:hypothetical 23.1 kd protein in bsaa-ilvd intergenic region] [sp:p54168] [db:swissprot] |
| 6070338_f1_1 | 3324 | 6978 | 1053 | 350 | 1028 | 6.80E-104 | [ac:d70020] [pn:abc transporter (atp-binding protein) homolog yusc] [gn:yusc] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 6071062_c1_41 | 3325 | 6979 | 708 | 235 | 532 | 2.50E-51 | [ac:q02170] [gn:yxsa] [or:*bacillus subtilis*] [de:dna repair protein radc homolog (orfb)] [sp:q02170] [dbs:swissprot] |
| 6073412_f3_67 | 3326 | 6980 | 297 | 98 | 85 | 0.079 | [ac:s64942:s64943:s69393] [pn:probable membrane protein y1r106c:hypothetical protein 12901] [or:*saccharomyces cerevisiae*] [db:pir] [mp:12r] |
| 6094450_f3_21 | 3327 | 6981 | 534 | 177 | 59 | 0.62 | [ln:cel:t25g12] [ac:u43283] [gn:t25g12.3] [or:*caenorhabditis elegans*] [sr:*caenorhabditis elegans* strain-bristol n2] [db:genpept-inv] [de:*caenorhabditis elegans* cosmid t25g12.] [le:21044:21120] [re:21064:21341] [di:direct] [oi:n] |
| 6101027_c3_21 | 3328 | 6982 | 285 | 94 | 70 | 0.035 | [ln:mt:pacg] [ac:x55026:m30937:m61734] [or:*mitochondrion podospora anserina*] [sr:*podospora anserina*] [db:genpept-pln] [de:*p. anserina* complete micochondrial genome.] [nt:orf32: no atg start codon: author-given protein] [le:97977] [re:98426] [di:complement] |
| 6110188_f2_6 | 3329 | 6983 | 672 | 223 | 575 | 6.80E-56 | [ac:h69668] [pn:oligopeptide abc transporter (permease) (initiation of sporulation, competence development) oppb] [gn:oppb] [or:*bacillus subtilis*] [db:pir] |
| 6117125_c2_11 | 3330 | 6984 | 192 | 63 | 62 | 0.032 | [ac:p09066] [gn:en-2] [or:*mus musculus*] [sr:*mouse*] [de:homeobox protein engrailed-2 (mo-en-2)] [sp:p09066] [dbs:swissprot] |
| 6117308_c1_79 | 3331 | 6985 | 342 | 113 | 156 | 1.70E-11 | [ln:acu89347] [ac:u89347] [pn:malonate decarboxylase delta subunit] [gn:mdcd] [or:*acinetobacter calcoaceticus*] [db:genpept-bct] [de:*acinetobacter calcoaceticus* malonate decarboxylase alpha subunit (mdca), malonate decarboxylase delta subunit (mded), malona |
| 6118762_c3_90 | 3332 | 6986 | 1419 | 472 | 268 | 8.40E-21 | [ln:clu77780] [ac:u77780] [pn:secretory protein kinase] [gn:kbh] [or:*chlorobium limicola*] [db:genpept-bct] [de:*chlorobium limicola* strain dsm 249 endogenous plasmid pc11, complete genomic sequence.] [nt:orf2.1: putative: 51.9 kda, iep 6.8, ntp binding] [le |
| 6119052_c2_37 | 3333 | 6987 | 666 | 221 | 674 | 2.20E-66 | [ac:h69997] [pn:conserved hypothetical protein ytmq] [gn:ytmq] [or:*bacillus subtilis*] [db:pir] |
| 6129750_f2_87 | 3334 | 6988 | 249 | 82 | 285 | 3.70E-25 | [ac:c69931] [pn:transcriptional regulator homolog yozg] [gn:yozg] [or:*bacillus subtilis*] [db:pir] |
| 6132812_c3_127 | 3335 | 6989 | 228 | 75 | 65 | 0.1 | [ac:p43533:p77520] [gn:flgn] [or:*escherichia coli*] [de:flagella synthesis protein flgn] [sp:p43533:p77520] [dbs:swissprot] |
| 6136012_f2_10 | 3336 | 6990 | 390 | 129 | 270 | 1.40E-23 | [ac:h69772] [pn:holo- acyl-carrier protein synthase homolog ydcb] [gn:ydcb] [or:*bacillus subtilis*] [db:pir] |
| 6136512_f2_18 | 3337 | 6991 | 1497 | 498 | 1026 | 1.10E-103 | [ac:p23212] [gn:msra] [or:*staphylococcus epidermidis*] [de:erythromycin resistance atp-binding protein msra] [sp:p23212] [dbs:swissprot] |
| 6136587_c2_44 | 3338 | 6992 | 1227 | 408 | 983 | 4.00E-99 | [ac:c69988] [pn:conserved hypothetical protein ytbj] [gn:ytbj] [or:*bacillus subtilis*] [db:pir] |
| 6141655_c1_39 | 3339 | 6993 | 894 | 297 | 609 | 1.70E-59 | [ac:q06753] [gn:yaco] [or:*bacillus subtilis*] [de:hypothetical rrna methylase in cyss 3'region] [sp:q06753] [dbs:swissprot] |
| 6142713_f3_18 | 3340 | 6994 | 486 | 161 | 392 | 1.70E-36 | [ln:af008220] [ac:af008220] [pn:ytfp] [gn:ytfp] [or:*bacillus subtilis* rrnb-dnab genomic region.] [nt:similarity to hypothetical protein f400 from c.] [le:102487] [re:103704] [di:complement] |
| 6147965_f3_27 | 3341 | 6995 | 1134 | 377 | 90 | 0.11 | [ln:pfamsalaa] [ac:m77713] [pn:major merozoite surface antigen] [gn:p190] [or:*plasmodium falciparum*] [sr:*plasmodium falciparum* asexual erythrocytic dna] [db:genpept-inv] [de:*p. falciparum* major merozoite surface antigen (p190) gene, 5' end, clone 806.] [le |
| 6149028_f2_11 | 3342 | 6996 | 273 | 90 | 79 | 0.012 | [ac:a44969] [pn:circumsporozoite protein precursor] [cl:circumsporozoite protein:thrombospondin type I repeat homology] [or:*plasmodium yoelli nigeriensis*] [db:pir] |

TABLE 2-continued

| Orf | NT Seq ID | AA Seq ID | NT Orf length | AA Orf length | Score | Probability | Description |
|---|---|---|---|---|---|---|---|
| 6150437_f1_2 | 3343 | 6997 | 387 | 128 | 269 | 1.80E-23 | [ln:lbphigle] [acx:98106] [pn:repressor] [gn:cpg] [or:bacteriophage phigle] [db:genpept-phg] [de:lactobacillus bacteriophage phigle complete genomic dna.] [le:746] [re:1144] [di:direct] |
| 6251511_f3_38 | 3344 | 6998 | 840 | 279 | 383 | 1.50E-35 | [acc:69661] [pn:transcriptional activator of multidrug-efflux transporter genes mta] [gn:mta] [or:bacillus subtilis] [db:pir] |
| 6253_c2_21 | 3345 | 6999 | 2196 | 731 | 1386 | 7.80E-142 | [ln:stacna] [acc:m81736] [pn:collagen adhesin] [gn:cna] [or:staphylococcus aureus] [sr:staphylococcus aureus dna] [db:genpept-bct] [de:staphylococcus aureus collagen adhesin (cna) gene, complete cds.] [le:151] [re:3702] [di:direct] |
| 6260927_c1_10 | 3346 | 7000 | 369 | 123 | 376 | 1.20E-34 | [acc:59925:q59926] [gn:fhs] [or:streptococcus mutans] [ec:6.3.4.3] [de:synthetase) (fhs) (fthfs)] [sp:q59925:q59926] [db:swissprot] |
| 6265677_f2_17 | 3347 | 7001 | 540 | 179 | 576 | 5.30E-56 | [ln:af029727] [acc:af029727] [pn:transposase] [or:enterococcus faecium] [db:genpept-bct] [de:enterococcus faecium insertion sequence is 1485, complete sequence.] [nt:putative transposase] [le:776:330] [re:330:1238] [di:direct|join] |
| 6271961_c1_16 | 3348 | 7002 | 636 | 211 | 179 | 5.00E-13 | [acc:52348] [pn:hypothetical protein 2] [or:lactobacillus leichmannii] [db:pir] |
| 6289058_c3_48 | 3349 | 7003 | 183 | 60 | 56 | 0.21 | [ln:tbz56279] [acc:z56279] [pn:integral membrane protein] [gn:cglg] [or:thermoanaerobacter brockii] [db:genpept-bct] [de:t. brockii cglf, cglg, xgls and cglt genes.] [le:1135] [re:1977] [di:direct] |
| 6299062_c1_99 | 3350 | 7004 | 243 | 80 | 69 | 0.028 | [acp17161:p11377] [or:klebsiella pneumoniae] [de:probable sigma (54) modulation protein (orf95)] [sp:p17161:p11377] [db:swissprot] |
| 6301575_c2_74 | 3351 | 7005 | 270 | 89 | 56 | 0.49 | [ln:rnu75406] [acc:u75406] [pn:lysosomal membrane glycoprotein] [gn:lamp-1] [or:rattus norvegicus] [sr:norway rat] [db:genpept-rod] [de:rattus norvegicus lysosomal membrane glycoprotein (lamp-1) mrna, partial cds.] [le:<1] [re:<1] |
| 6301712_c3_54 | 3352 | 7006 | 627 | 208 | 687 | 9.20E-68 | [acc:69878] [pn:guanylate kinase homolog ylod] [gn:ylod] [or:bacillus subtilis] [db:pir] |
| 6308454_c1_41 | 3353 | 7007 | 566 | 188 | 115 | 3.80E-07 | [ln:af020798] [acc:af020798] [pn:repressor] [or:streptococcus thermophilus bacteriophage tp-j34] [db:genpept] [de:streptococcus thermophilus bacteriophage lysogeny module, integrase homolog (int), putative host cell surface-exposed lipoprotein, putative meta |
| 632912_c3_50 | 3354 | 7008 | 222 | 73 | 69 | 0.2 | [acp:07639] [gn:arob] [or:escherichia coli] [ec:4.6.1.3] [de:3-dehydroquinate synthase,] [sp:p07639] [db:swissprot] |
| 6329692_f1_2 | 3355 | 7009 | 795 | 264 | 86 | 0.63 | [acq57828] [gn:mj0383] [or:methanococcus jannaschii] [de:hypothetical protein mj0383] [sp:q57828] [db:swissprot] |
| 6335843_c3_76 | 3356 | 7010 | 1437 | 478 | 1592 | 1.20E-163 | [ac:h69751] [pn:amino acid permease homolog ybxg] [gn:ybxg] [or:bacillus subtilis] [db:pir] |
| 6345337_f3_45 | 3357 | 7011 | 885 | 294 | 114 | 0.00027 | [acp:44990] [gn:sgbu:hi1026] [or:haemophilus influenzae] [ec:5.—.—.—] [de:putative hexulose-6-phosphate isomerase, (humpi)] [sp:p44990] [db:swissprot] |
| 635937_c3_64 | 3358 | 7012 | 849 | 282 | 464 | 3.90E-44 | [acp:29823] [gn:lacf] [or:agrobacterium radiobacter] [de:lactose transport system permease protein lacf] [sp:p29823] [db:swissprot] |
| 635967_c1_40 | 3359 | 7013 | 222 | 73 | 174 | 2.10E-13 | [ln:bmgfuckin] [acc:aj000005] [gn:orf1] [fn:homologous to yqgq from bacillus subtilis] [or:bacillus megaterium] [db:genpept-bct] [de:bacillus megaterium glk gene.] [le:67] [re:273] [di:direct] |
| 635_f2_13 | 3360 | 7014 | 813 | 270 | 318 | 1.20E-28 | [acc:32215] [pn:hypothetical protein 1] [or:bacillus megaterium] [db:pir] |
| 6364075_f2_23 | 3361 | 7015 | 297 | 98 | 70 | 0.13 | [acc:05236] [gn:29] [or:mycobacteriophage 15] [de:gene 29 protein (gp29)] [sp:q05236] [db:swissprot] |
| 6364075_f3_70 | 3362 | 7016 | 228 | 75 | 78 | 0.0032 | [ln:hasod1] [acc:z70665] [pn:iron superoxide dismutase] [db:genpept-inv] [ec:1.15.1.1] [de:h. acosta sod1 gene.] [nt:one of 2 distinct sod genes from the same genome] [le:<1] [re: |

TABLE 2-continued

| Orf | NT Seq ID | AA Seq ID | NT Orf length | AA Orf length | Score | Probability | Description |
|---|---|---|---|---|---|---|---|
| 6376099_c1_51 | 3363 | 7017 | 1090 | 363 | 857 | 8.90E-86 | [ac:p12045] [gn:purk] [or:bacillus subtilis] [ec:4.1.1.21] [de:(air carboxylase) (airc)] [sp:p12045] [db:swissprot] |
| 637_f3_52 | 3364 | 7018 | 240 | 79 | 74 | 0.05 | [ac:s29709] [pn:olfactory receptor orl4] [or:rattus norvegicus] [sr:, norway rat] [db:pir] |
| 6385063_c2_26 | 3365 | 7019 | 234 | 77 | 67 | 0.15 | [ac:pq0467] [pn:gamma a protein] [or:poa semilatent virus] |
| 6408_f3_37 | 3366 | 7020 | 228 | 75 | 57 | 0.077 | [ac:p36951] [gn:gip] [or:drosophila melanogaster] [sr:,fruit fly] [de:protein] [sp:p36951] [db:swissprot] |
| 6417137_c3_291 | 3367 | 7021 | 1038 | 345 | 89 | 0.0036 | [ln:lsu54556] [ac:u54556] [pn:microfilarial sheath protein shp3] [gn:shp3] [or:litomosoides sigmodontis] [db:genpept-inv] [de:litomosoides sigmodontis microfilarial sheath proteins shp3a (shp3a) and shp3 (shp-3) genes, complete cds.] [nt:structural protein: |
| 6422301_c3_21 | 3368 | 7022 | 570 | 189 | 148 | 1.20E-10 | [ln:mtcy01b2] [ac:z95554] [pn:unknown] [gn:mtcy01b2.16c] [or:mycobacterium tuberculosis] [db:genpept-bct] [de:mycobacterium tuberculosis cosmid scy01b2.] [nt:mtcy01b2.16c. len: 195. function: unknown membrane] [le:17189] [re:17776] [di:complement] |
| 6438177_f1_5 | 3369 | 7023 | 423 | 140 | 76 | 0.43 | [ln:celb0496] [ac:u58749] [gn:b0496.4] [or:caenorhabditis elegans] [sr:caenorhabditis elegans strain=bristol n2] [db:genpept-inv] [de:caenorhabditis elegans cosmid b0496.] [le:8054:8414:8574:8790] [re:8351:8524:8739:8823] [di:directjoin] |
| 6441081_c3_33 | 3370 | 7024 | 300 | 99 | 64 | 0.092 | [ac:jc2380] [pn:subtilisin inhibitor clsi-i] [or:canavalia lineata] [di:dir] |
| 6442183_f3_5 | 3371 | 7025 | 246 | 81 | 72 | 0.17 | [ln:vvu41412] [ac:u41412] [pn:fph-20] [or:vulpes vulpes] [sr:red fox] [db:genpept-mam] [de:vulpes vulpes sperm surface protein fph-20 mrna, complete cds.] [nt:homolog of human ph-20, pir accession number] [le:240] [re:1862] [di:direct] |
| 6453308_f3_116 | 3372 | 7026 | 714 | 237 | 378 | 5.10E-35 | [ac:p39805] [gn:lict:n15a] [or:bacillus subtilis] [de:transcription antiterminator lict] [sp:p39805] [db:swissprot] |
| 645635_c1_33 | 3373 | 7027 | 1797 | 598 | 1211 | 7.20E-126 | [ac:q11047] [gn:mtcy50.10] [or:mycobacterium tuberculosis] [de:hypothetical abc transporter atp-binding protein cy50.10] [sp:q11047] [db:swissprot] |
| 645808_f1_5 | 3374 | 7028 | 207 | 68 | 63 | 0.22 | [ln:brphmm14a] [ac:m95546] [pn:brugia malayi antigen] [or:brugia malayi] [sr:brugia malayi cdna to mrna] [db:genpept-inv] [de:brugia malayi (clone bmm-14) recombinant antigen mrna.] [le:<1] [re:461] [di:direct] |
| 6492163_f1_1 | 3375 | 7029 | 249 | 82 | 77 | 0.04 | [ln:d86222] [ac:d86222] [pn:glutamine synthetase] [or:pyrococcus sp.] [sr:pyrococcus sp. (strain:kod1) dna] [db:genpept-bct] [de:pyrococcus sp. gene for glutamine synthetase, complete cds.] [le:64] [re:1395] [di:direct] |
| 6520062_c3_62 | 3376 | 7030 | 498 | 165 | 288 | 1.80E-25 | [ac:p54184] [gn:cina] [or:streptococcus pneumoniae] [de:putative competence-damage protein] [sp:p54184] [db:swissprot] |
| 6523285_f3_10 | 3377 | 7031 | 1035 | 344 | 890 | 2.80E-89 | [ln:lmu78885] [ac:u78885] [pn:transport system permease homolog] [or:listeria monocytogenes] [db:genpept-bct] [de:listeria monocytogenes transport system permease homolog gene, complete cds.] [nt:similar to bacterial tranpsort system permease] [le:387] [re |
| 6523576_f3_29 | 3378 | 7032 | 1062 | 353 | 597 | 3.20E-58 | [ac:a69875] [pn:hypothetical protein ylbl] [gn:ylbl] [or:bacillus subtilis] [db:pir] |
| 6524143_f3_8 | 3379 | 7033 | 873 | 290 | 519 | 5.90E-50 | [ac:p42908] [gn:agay:kba] [or:eschericia coli] [ec:4.1.2.—] [de:tagatose-bisphosphate aldolase agav.] [sp:p42908] [db:swissprot] |
| 6527187_c1_22 | 3380 | 7034 | 1551 | 516 | 807 | 4.00E-83 | [ac:h69724] [pn:dna topoisomerase iii topb] [gn:topb] [or:bacillus subtilis] [db:pir] |
| 6533562_f3_16 | 3381 | 7035 | 1122 | 373 | 490 | 6.90E-47 | [ac:a69797] [pn:conserved hypothetical protein yesr] [gn:yesr] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 6540717_f3_11 | 3382 | 7036 | 2175 | 724 | 1862 | 2.80E-192 | [acp50640] [gn:nrde] [or:mycobacterium tuberculosis] [ec:1.17.4.1] [de:(ribonucleotide reductase) (r1 subunit) (fragment)] [sp:p50640] [db:swissprot] |
| 6542338_c1_34 | 3383 | 7037 | 753 | 250 | 214 | 3.90E-17 | [ln:cwu56103] [acu56103] [pn:acyl-acp thioesterase] [gn:fatb1] [or:cuphea wrightii] [db:genpept-pln] [de:cuphea wrightii acyl-acp thioesterase (fatb1) mrna, complete cds.] [le:20] [re:1216] [di:direct] |
| 6640676_c1_43 | 3384 | 7038 | 990 | 329 | 543 | 1.70E-52 | [acc69149] [pn:conserved hypothetical protein mth380] [gn:mth380] [or:methanobacterium thermoautotrophicum] [db:pir] |
| 6641552_f1_19 | 3385 | 7039 | 318 | 105 | 61 | 0.18 | [ln:dvuorfsx] [acc105338] [fn:unknown] [or:desulfovibrio desulfuricans] [sr:desulfovibrio desulfuricans (strain g100a) dna] [db:genpept-bct] [de:desulfovibrio desulfuricans (orf195, orf135, orf150 and orf162) genes, complete cds.] [nt: putative: 5' half of |
| 6642505_f3_33 | 3386 | 7040 | 924 | 307 | 755 | 5.70E-75 | [acs34187] [pn:tmb2 protein] [cl:malk protein homology] [or:streptomyces longisporoflavus] [db:pir] |
| 6645051_c3_71 | 3387 | 7041 | 915 | 304 | 364 | 1.60E-33 | [acp39592] [gn:ywbi:ipa-24d] [or:bacillus subtilis] [de:hypothetical transcriptional regulator in cpr-galk intergenic region] [sp:p39592] [db:swissprot] |
| 6646888_f1_6 | 3388 | 7042 | 612 | 203 | 125 | 8.40E-07 | [ln:mtcy01b2] [acc295554] [pn:unknown] [gn:mtcy01b2.16c.] [or:mycobacterium tuberculosis cosmid scy01b2.] [nt:mtcy01b2.16c. len: 195. function: unknown membrane] [le:17189] [re:17776] [di:complement] |
| 6652_f2_78 | 3389 | 7043 | 186 | 61 | 69 | 0.032 | [acp22450] [or:haloarcula marismortui] [sp:haloarcula marismortui] [de:50s ribosomal protein 114 (hmal14) (h127)] [sp:p22450] [db:swissprot] |
| 6656303_f3_99 | 3390 | 7044 | 393 | 130 | 64 | 0.12 | [ln:mc311] [acz33228] [pn:similar to 7-alpha-hydroxysteroid dh] [or:mycoplasma capricolum] [db:genpept-bct] [de:m. capricolum dna for contig mc311.] [nt:orf identified by homology to swissprot entry] [le:<1] [re:253] [di:direct] |
| 6657660_f3_84 | 3391 | 7045 | 1191 | 396 | 468 | 1.50E-44 | [ln:spu40453] [acu40453:m19350] [pn:integrase] [gn:int] [or:streptococcus pyogenes phage t12] [db:genpept-phg] [de:streptococcus pyogenes phage t12 repressor, excisionase (xis), integrase (int) and erythrogenic toxin a precursor (spea) genes, complete cds. |
| 6657837_f2_5 | 3392 | 7046 | 726 | 241 | 134 | 6.20E-07 | [ac:h69843] [pn:hypothetical protein yjbh] [gn:yjbh] [or:bacillus subtilis] [db:pir] |
| 6657957_c2_135 | 3393 | 7047 | 189 | 62 | 66 | 0.06 | [acs49604] [pn:hypothetical protein 126 (rps12 3' region)] [or:plastid astasia longa] [db:pir] |
| 6662760_c3_38 | 3394 | 7048 | 1122 | 373 | 737 | 4.60E-73 | [acg70007] [pn:conversed hypothetical protein yuef] [gn:yuef] [or:bacillus subtilis] [db:pir] |
| 6663410_f3_8 | 3395 | 7049 | 186 | 61 | 61 | 0.82 | [ln:syepsad] [acj04195] [pn:unknown protein] [or:synechocystis sp.] [sr:synechocystis sp (tissue library: pcc 6803) dna] [db:genpept-bct] [de:synechocystis sp. (pcc 6803) photosystem i subunit ii (psad) gene, complete cds.] [nt:orf: putative] [le:417] [re |
| 6664000_c3_20 | 3396 | 7050 | 1002 | 333 | 274 | 5.70E-36 | [acp75794] [gn:ybiy] [or:escherichia coli] [ec:1.97.1.4] [de:putative pyruvate formate-lyase 3 activating enzyme,] [sp:p75794] [db:swissprot] |
| 667062_f2_16 | 3397 | 7051 | 246 | 81 | 72 | 0.11 | [acp12174] [gn:matk:ycf14] [or:marchantia polymorpha] [sr:,liverwort] [de:probable intron maturase] [sp:p12174] [db:swissprot] |
| 6673452_c1_46 | 3398 | 7052 | 1440 | 479 | 2553 | 1.70E-265 | [acp14507] [gn:aaca-aphd] [or:staphylococcus aureus:enterococcus faecalis] [sr:streptococcus faecalis] [ec:2.3.1.—:2.7.1.—] [de:aminoglycoside phosphotransferase, (aph(2'')] [sp:p14507] [db:swissprot] |
| 6688237_c3_286 | 3399 | 7053 | 1794 | 597 | 481 | 4.30E-94 | [acp54523] [gn:yqic] [or:bacillus subtilis] [de:hypothetical 69.6 kd protein in fold-ahrc intergenic region] [sp:p54523] [db:swissprot] |

TABLE 2-continued

| Orf | NT Seq ID | AA Seq ID | NT Orf length | AA Orf length | Score | Probability | Description |
|---|---|---|---|---|---|---|---|
| 6688201_f3_59 | 3400 | 7054 | 261 | 86 | 70 | 0.022 | [ln:cee66216] [ac:u66216] [pn:ran/tc4] [fn:gtp-binding nuclear protein] [or: caenorhabditis elegans] [db:genpept-inv] [de:caenorhabditis elegans gtp-binding nuclear protein ran/tc4 mrna, partial cds.] [le:<1] [re: |
| 6695327_c2_19 | 3401 | 7055 | 1353 | 450 | 1973 | 4.90E-204 | [ac:p37061] [gn:nox] [or:enterococcus faecalis] [sr:streptococcus faecalis] [ec:1.6.—.—] [de:nadh oxidase, (noxase)] [sp:p37061] [dbs:swissprot] |
| 6696067_f2_5 | 3402 | 7056 | 1296 | 431 | 241 | 2.70E-20 | [ac:f69762] [pn:transporter homolog ycli] [gn:ycli] [or:bacillus subtilis] [db:pir] |
| 6719013_c3_63 | 3403 | 7057 | 1245 | 414 | 878 | 5.30E-88 | [ln:sau81973] [ac:u81973] [pn:cap5o] [gn:cap5o] [or:staphylococcus aureus] [db:genpept-bct] [de:staphylococcus aureus capsule gene cluster cap5a through cap5pgenes, complete cds.] [nt:putative n-acetylmannosamine dehydrogenase] [le:144460] [re:15722] [di:d |
| 672262_f2_56 | 3404 | 7058 | 192 | 63 | 58 | 0.34 | [ln:mhu02538] [ac:u02538] [pn:multidrug resistance protein homolog] [or: mycoplasma hyopneumoniae] [db:genpept-bct] [de:mycoplasma hyopneumoniae] atcc 25934 23s rrna gene, partial sequence.] [le:1545] [re: |
| 6723841_f1_1 | 3405 | 7059 | 1083 | 360 | 1080 | 2.10E-109 | [ac:p46920] [gn:opuaa] [or:bacillus subtilis] [de:glycine betaine transport atp-binding protein opuaa] [sp:p46920] [dbs:swissprot] |
| 6725003_f2_20 | 3406 | 7060 | 999 | 332 | 1176 | 1.40E-119 | [ac:p20429] [gn:rpoa] [or:bacillus subtilis] [de:dna-directed rna polymerase alpha subunit)] [sp:p20429] [dbs:swissprot] |
| 6726562_c2_66 | 3407 | 7061 | 306 | 102 | 412 | 1.30E-38 | [ac:b69722] [pn:trna-guanine transglycosylase tgt] [gn:tgt] [or:bacillus subtilis] [db:pir] |
| 6727213_c2_72 | 3408 | 7062 | 1479 | 492 | 1023 | 2.30E-103 | [ln:bsaralmnp] [ac:x89810] [pn:putative alpha-1-arabinofuranosidase] [gn:abfa] [or:bacillus subtilis] [db:genpept-bct] [de:b. subtilis dna for araabdlmnpq-abfa operon.] [le:5165] [re:6667] [di:direct] |
| 672880_f2_5 | 3409 | 7063 | 432 | 144 | 53 | 0.95 | [ln:hpu60176] [ac:u60176] [pn:cago] [gn:cago] [or:helicobacter pylori] [db: genpept-bct] [de:helicobacter pylori cag pathogenicity island, type i-specific and disease-associated virulence factor genes.] [le:7431] [re:7646] [di: complement] |
| 6730342_c3_80 | 3410 | 7064 | 1530 | 509 | 1671 | 4.90E-172 | [ln:bsaralmnp] [ac:x89810] [pn:putative alpha-1-arabinofuranosidase] [gn:abfa] [or:bacillus subtilis] [db:genpept-bct] [de:b. subtilis dna for araabdlmnpq-abfa operon.] [le:5165] [re:6667] [di:direct] |
| 673137_c2_162 | 3411 | 7065 | 2391 | 796 | 128 | 0.00019 | [ln:pbu42580] [ac:u42580:u17055:u32570] [gn:a291] [or:paramecium bursaria chlorella virus 1] [db:genpept-vrl] [de:paramecium bursaria chlorella virus 1, complete genome.] [nt:asn/thr/ser/val rich protein: similar to rickettsia] [le:18050] [re:20512] [di:c |
| 6741256_f1_6 | 3412 | 7066 | 351 | 116 | 88 | 0.0043 | [ln:spac29a4] [ac:z97210] [pn:protein kinase] [gn:spac29a4.16] [or: schizosaccharomyces pombe] [sr:fission yeast] [db:genpept-pln] [de:s. pombe chromosome i cosmid c29a4.] [nt:spac29a4.16, probable serine/threonine-protein] [le:30626] [re:32536] [di:direct] |
| 6745917_c1_19 | 3413 | 7067 | 198 | 65 | 62 | 0.56 | [ac:q06807] [gn:tie2/tie-2] [or:bos taurus] [sr:bovine] [ec:2.7.1.112] [de: kinase receptor tie-2)] [sp:q06807] [dbs:swissprot] |
| 6765951_f3_32 | 3414 | 7068 | 339 | 112 | 76 | 0.19 | [ln:llu02467] [ac:u02467] [pn:meiotin-1] [or:lilium longiflorum] [sr:trumpet lily] [db:genpept-pln] [de:lilium longiflorum enchantment meiotin-1 mrna, partial cds.] [nt:clone ends at xho i site used in cloning] [le:122] [re: |
| 6766255_c1_42 | 3415 | 7069 | 483 | 160 | 80 | 0.087 | [ac:p43978] [gn:hi0284] [or:haemophilus influenzae] [de:hypothetical protein hi0284] [sp:p43978] [dbs:swissprot] |
| 6766877_c1_46 | 3416 | 7070 | 1053 | 350 | 468 | 1.50E-44 | [ln:lpflmg13] [ac:aj000325] [pn:putative membrane protein] [gn:orfa] [or: lactococcus lactis] [db:genpept-bct] [de:lactococcus lactis pfl gene (strain mg 1363).] [le:270] [re:1187] [di:direct] |

TABLE 2-continued

| Orf | NT Seq ID | AA Seq ID | NT Orf length | AA Orf length | Score | Probability | Description |
|---|---|---|---|---|---|---|---|
| 6767133_f3_52 | 3417 | 7071 | 312 | 103 | 65 | 0.073 | [ln:mgu01762] [ac:u01762] [pn:unknown] [or:mycoplasma genitalium] [db:genpept-bct] [de:mycoplasma genitalium random genomic clone hsa2, partial cds.] [le:<1] [re: |
| 677141_f1_6 | 3418 | 7072 | 312 | 103 | 68 | 0.82 | [ln:mty15290] [ac:y15290] [gn:mtn24] [or:medicago truncatula] [sr:barrel medic] [db:genpept-pln] [de:medicago truncatula mrna for mtn24 gene.] [nt:putative start codon] [le:58] [re:762] [di:direct] |
| 6773287_c3_266 | 3419 | 7073 | 240 | 79 | 93 | 0.00027 | [ac:p75578] [gn:rplw] [or:mycoplasma pneumoniae] [de:50s ribosomal protein l23] [sp:p75578] [db:swissprot] |
| 6775255_c1_119 | 3420 | 7074 | 384 | 127 | 164 | 2.40E-12 | [ln:ph5orfhtr] [ac:135561] [pn:holin] [or:bacteriophage phi-105] [sr:bacteriophage phi-105 dna] [db:genpept-phg] [de:bacteripohage phi-105 orfs 1–3.] [nt:orf2: potential dual start motif: putative] [le:796] [re:1170] [di:direct] |
| 678437_c3_17 | 3421 | 7075 | 264 | 88 | 155 | 1.60E-10 | [ac:c69793] [pn:rna methyltransferase homolog yefa] [gn:yefa] [or:bacillus subtilis] [db:pir] |
| 6812502_c1_17 | 3422 | 7076 | 906 | 301 | 229 | 9.80E-22 | [ac:d64443] [pn:mutator protein mutt] [cl:mutt domain homology] [or:methanococcus jannaschii] [db:pir] [mp:rev1088621–1088112] |
| 6812700_c2_77 | 3423 | 7077 | 1497 | 498 | 236 | 4.10E-17 | [ln:sgcom78865] [ac:x98110] [pn:pheromone receptor] [gn:comd2] [or:streptococcus gordonii] [db:genpept-bct] [de:s. gordonii trna-arg, comc2, comd2 & come2 genes.] [nt:histidine kinase] [le:656] [re:2014] [di:direct] |
| 6817216_f2_26 | 3424 | 7078 | 921 | 306 | 259 | 2.10E-22 | [ac:p44540] [gn:hi0143] [or:haemophilus influenzae] [de:hypothetical protein hi0143] [sp:p44540] [db:swissprot] |
| 6819002_c1_37 | 3425 | 7079 | 1296 | 431 | 617 | 2.40E-60 | [ln:ab006957] [ac:ab006957] [pn:fatty acid alpha-hydroxylase] [or:sphingomonas paucimobilis] [sr:sphingomonas paucimobilis (strain:cy2395) dna] [db:genpept-bct] [de:sphingomonas paucimobilis gene for fatty acid alpha-hydroxylase, complete cds.] [le:1] [re: |
| 6832786_f2_12 | 3426 | 7080 | 273 | 90 | 64 | 0.013 | [ln:ccc06c3] [ac:z36719] [pn:c06c3.9] [or:caenorhabditis elegans] [db:genpept-inv] [de:caenorhabditis elegans cosmid c06c3, complete sequence.] [le:14377:15561:15773:15905] [re:14430:15726:15842:16082] [di:direct|join] |
| 6834537_c3_53 | 3427 | 7081 | 444 | 147 | 76 | 0.6 | [ln:fry15171] [ac:y15171] [pn:surfeit protein 1] [or:fugu rubripes] [db:genpept-vrt] [de:fugu rubripes surf3 and surf6 genes and partial surf1 gene.] [le:<4134:4266:4455] [re:4197:4347:4617] [di:complement|join] |
| 6835917_c2_43 | 3428 | 7082 | 1308 | 435 | 963 | 5.20E-97 | [ac:p31672] [or:lactobacillus delbrueckii] [sr:subspbulgaricus] [de:mfs protein homolog (fragment)] [sp:p31672] [db:swissprot] |
| 6836077_f1_2 | 3429 | 7083 | 363 | 120 | 282 | 7.60E-25 | [ln:liscadtnp] [ac:128104] [pn:accessory protein] [gn:cadc] [fn:cd2+ sequestration and delivery] [or:transposon tn5422] [sr:listeria monocytogenes (individual_isolate lm74) dna: transposo] [db:genpept-bct] [de:listeria monocytogenes atpase (cada) gene: ac |
| 6837500_f3_35 | 3430 | 7084 | 468 | 155 | 304 | 3.60E-27 | [ac:p54459] [gn:yqen] [or:bacillus subtilis] [de:hypothetical 40.5 kd protein in comec-rpst intergenic region] [sp:p54459] [db:swissprot] |
| 6837782_f2_11 | 3431 | 7085 | 438 | 145 | 247 | 3.90E-21 | [ac:p52080] [or:staphylococcus aureus] [de:hypothetical 16.6 kd protein in atl 5'region (orf3)] [sp:p52080] [db:swissprot] |
| 6837800_c3_91 | 3432 | 7086 | 801 | 266 | 77 | 0.99 | [ln:cel12f5] [ac:af039718] [gn:t12f5.2] [or:caenorhabditis elegans] [sr:caenorhabditis elegans strain=bristol n2] [db:genpept-inv] [de:caenorhabditis elegans cosmid t12f5.] [le:18229:18598:18784:18941] [re:18328:18737:18882:19159] [di:direct|join] |
| 6839077_c1_96 | 3433 | 7087 | 1026 | 341 | 967 | 2.00E-97 | [ac:p77503] [gn:ycjs] [or:escherichia coli] [de:hypothetical 38.7 kd protein in pspe-ompg intergenic region] [sp:p77503] [db:swissprot] |
| 6839203_f1_2 | 3434 | 7088 | 441 | 146 | 643 | 4.20E-63 | [ac:a56085] [pn:regulatory protein copy] [gn:copy] [or:enterococcus hirae] [db:pir] |

TABLE 2-continued

| Orf | NT Seq ID | AA Seq ID | NT Orf length | AA Orf length | Score | Probability | Description |
|---|---|---|---|---|---|---|---|
| 6850187_c2_51 | 3435 | 7089 | 561 | 186 | 782 | 7.90E-78 | [ac:p26681] [gn:atpf] [or:enterococcus faecalis] [sr:streptococcus faecalis] [ec:3.6.1.34] [de:atp synthase b chain.] [sp:p26681] [db:swissprot] |
| 6850702_c3_24 | 3436 | 7090 | 747 | 248 | 680 | 5.10E-67 | [ac:e70044] [pn:conserved hypothetical protein yvob] [gn:yvob] [or:bacillus subtilis] [db:pir] |
| 6851688_f3_5 | 3437 | 7091 | 435 | 144 | 429 | 2.00E-40 | [ac:a69829] [pn:abc transporter (atp-binding protein) homolog yhei] [or:bacillus subtilis] [db:pir] |
| 6855386_c1_43 | 3438 | 7092 | 306 | 101 | 174 | 2.10E-13 | [ac:p49517] [gn:acp:acp] [or:odontella sinensis] [de:acyl carrier protein] [sp:p49517] [db:swissprot] |
| 6914137_f2_7 | 3439 | 7093 | 1089 | 362 | 1207 | 7.30E-123 | [ac:b69669] [pn:oligopeptide abc transporter (atp-binding protein) (initiation of sporulation, competence development) oppd] [gn:oppd] [or:bacillus subtilis] [db:pir] |
| 6917337_c1_40 | 3440 | 7094 | 186 | 61 | 65 | 0.073 | [ac:p20217] [or:sulfolobus virus-like particle ssv1] [de:hypothetical 5.9 kd protein (orfe-51] [sp:p20217] [db:swissprot] |
| 6917337_c2_35 | 3441 | 7095 | 195 | 64 | 70 | 0.022 | [ac:p20217] [or:sulfolobus virus-like particle ssv1] [de:hypothetical 5.9 kd protein (orfe-51] [sp:p20217] [db:swissprot] |
| 6922302_f1_10 | 3442 | 7096 | 444 | 147 | 130 | 9.80E-09 | [ln:bhp9011in] [ac:x85213] [or:bacteriophage tp901-1] [db:genpept-phg] [de:bacteriophage tp901-1 orf1, 2 & 3.] [nt:orf2] [le:78] [re:515] [di:direct] |
| 6922302_f3_76 | 3443 | 7097 | 453 | 150 | 127 | 2.00E-08 | [ln:bhp9011in] [ac:x85213] [or:bacteriophage tp901-1] [db:genpept-phg] [de:bacteriophage tp901-1 orf1, 2 & 3.] [nt:orf2] [le:78] [re:515] [di:direct] |
| 6923462_c3_46 | 3444 | 7098 | 1344 | 447 | 1149 | 1.00E-116 | [ln:ab007844] [ac:ab007844] [gn:uvra] [db:genpept-bct] [de:enterococcus faecalis plasmid:pad1 dna] [db:genpept-bct] [de:enterococcus faecalis plasmid pad1 gene.] [nt:structural gene for ultraviolet resistance] [le:1284] [re:2612] [di:direct] |
| 6929687_f2_8 | 3445 | 7099 | 648 | 215 | 141 | 6.70E-10 | [ln:bamalanya1] [ac:z22520] [pn:membrane protein] [or:bacillus acidopullulyticus] [db:genpept-bct] [de:b. acidopullulyticus encoding maltogenic amylase.] [nt:putative cds; orf3 highly hydrophobic aa sequence;] [le:3540] [re:4091] [di:complement] |
| 6929688_f1_2 | 3446 | 7100 | 456 | 151 | 86 | 0.00047 | [ac:p54502] [gn:yqgv] [or:bacillus subtilis] [de:hypothetical 9.4 kd protein in soda-comga intergenic region] [sp:p54502] [db:swissprot] |
| 6929702_f2_12 | 3447 | 7101 | 561 | 186 | 224 | 1.10E-18 | [ac:b69792] [pn:hypothetical protein yebf] [gn:yebf] [or:bacillus subtilis] [db:pir] |
| 6929702_f2_19 | 3448 | 7102 | 357 | 118 | 61 | 0.19 | [ln:xlalbhp2] [ac:z26826] [pn:albumin] [or:xenopus laevis] [sr:african clawed frog] [db:genpept-vrt] [de:x. laevis gene for albumin including hp1 enhancer.] [le:1556:2239] [re:1634:2305] [di:direct;join] |
| 6929757_c3_58 | 3449 | 7103 | 615 | 204 | 740 | 2.20E-73 | [ac:p96053] [gn:recr:recm] [or:streptococcus thermophilus] [de:recombination protein recr] [sp:p96053] [db:swissprot] |
| 6929792_c2_20 | 3450 | 7104 | 999 | 332 | 1269 | 2.00E-129 | [ac:a69674] [pn:pyruvate dehydrogenase (e1 beta subunit) pdhb] [gn:pdhb] [or:bacillus subtilis] [db:pir] |
| 6929813_c1_82 | 3451 | 7105 | 576 | 191 | 328 | 1.00E-29 | [ac:kpu95087] [acu95087] [pn:mdcb] [gn:mdcb] [fn:involved in biosynthesis of the prosthetic] [or:klebsiella pneumoniae] [db:genpept-bct] [de:klebsiella pneumoniae malonate decarboxylase gene cluster (mdca, mdcb, mdcc, mdcd, mdce, mdcf, mdcg, mdch, mdcr) g |
| 6931251_f2_18 | 3452 | 7106 | 282 | 93 | 75 | 0.016 | [ac:p25348] [gn:mrp132:yer3w:yer041] [or:saccharomyces cerevisiae] [sr:baker's yeast] [de:mitochrondrial 60s ribosomal protein 132 precursor (ym132)] [sp:p25348] [db:swissprot] |
| 6933567_c2_238 | 3453 | 7107 | 366 | 121 | 79 | 0.072 | [ln:cele16c8] [acu80452] [gn:c16c8.5] [or:caenorhabditis elegans] [db:genpept-inv] [de:caenorhabditis elegans strain-bristol n2] [db:genpept-inv] [de:caenorhabditis elegans cosmid c16c8.] [nt:weak similarity to arabidopsis thaliana] [le:20436:20540:20924] [re:20489:2087 |

TABLE 2-continued

| Orf | NT Seq ID | AA Seq ID | NT Orf length | AA Orf length | Score | Probability | Description |
|---|---|---|---|---|---|---|---|
| 7031262_f2_7 | 3454 | 7108 | 348 | 115 | 54 | 0.71 | [ln:ratdoc2p2] [ac:af045658] [pn:mitogen-responsive phosphoprotein] [gn:doc2] [or:rattus norvegicus] [sr:norway rat] [db:genpept] [de:rattus norvegicus mitogen-responsive phosphoprotein (doc2) mrna, segment 2, partial cds.] [le:<1] [re: |
| 7034505_f1_10 | 3455 | 7109 | 279 | 92 | 64 | 0.02 | [ln:cek10g4] [ac:z92806] [pn:k10g4.6] [or:caenorhabditis elegans] [db:genpept-inv] [de:caenorhabditis elegans cosmid k10g4, complete sequence.] [le:11920:12336] [re:12280:12991] [di:direct|join] |
| 7035933_f3_10 | 3456 | 7110 | 513 | 170 | 312 | 5.10E-28 | [ac:p25614] [gn:ycr13c] [or:saccharomyces cerevisiae] [sr:baker's yeast] [de:very hypothetical 22.8 kd protein in pgk1 region] [sp:p25614] [db:swissprot] |
| 7039702_f1_4 | 3457 | 7111 | 321 | 106 | 206 | 3.30E-16 | [ac:f70019] [pn:mfs protein homolog homolog yurw] [gn:yurw] [or:bacillus subtilis] [db:pir] |
| 7042212_c2_38 | 3458 | 7112 | 345 | 114 | 75 | 0.22 | [ln:mphnlrdhom] [ac:122217] [or:mycoplasma-like organism] [db:genpept-bct] [de:mycoplasma like organism apple proliferation, strain atnitroreductase like protein gene, complete cds.] [nt:this orf is homologous to nitroreductase from] [le:452] [re:1048] [d |
| 7053388_c2_31 | 3459 | 7113 | 1011 | 336 | 532 | 2.50E-51 | [ac:a53309] [pn:regulatory protein prgw:pheromone responsive gene w protein] [gn:prgw] [or:enterococcus faecalis] [db:pir] |
| 7063140_c1_101 | 3460 | 7114 | 429 | 142 | 61 | 0.3 | [ln:atts6036] [ac:f19997] [pn:csa-19 homologue] [or: arabidopsis thaliana] [sr:thale cress] [db:genpept-est5] [de:a. thaliana transcribed sequence; clone tap0316; 5' end; similar tocsa-19; homo sapiens.] [le:44] [re: |
| 7064077_f3_17 | 3461 | 7115 | 198 | 65 | 90 | 0.00017 | [ac:p54940] [gn:yxca:hs74a] [or:bacillus subtilis] [de:hypothetical 13.0 kd protein in idh-deor intergenic region precursor] [sp:p54940] [db:swissprot] |
| 7070428_c1_45 | 3462 | 7116 | 453 | 150 | 568 | 3.80E-55 | [ac:s26352] [pn:hypothetical protein] [or:staphylococcus aureus] [db:pir] |
| 7070428_c2_55 | 3463 | 7117 | 324 | 107 | 98 | 0.00019 | [ln:sau81973] [ac:u81973] [pn:cap5k] [gn:cap5k] [or:staphylococcus aureus] [db:genpept-bct] [de:staphylococcus aureus capsule gene cluster cap5a through cap5p genes, complete cds.] [le:10540] [re:11745] [di:direct] |
| 7070428_f3_9 | 3464 | 7118 | 381 | 126 | 520 | 4.60E-50 | [ac:p14507] [gn:aaca-aphd] [or:staphylococcus aureus:enterococcus faecalis] [sr:streptococcus faecalis] [ec:2.3.1.—:2.7.1.—] [de:aminoglycoside phosphotransferase, (aph(2"))] [sp:p14507] [db:swissprot] |
| 7071068_c3_35 | 3465 | 7119 | 1332 | 443 | 181 | 4.80E-11 | [ln:bacgntza] [ac:d78193] [gn:yych] [or:bacillus subtilis] [sr:bacillus subtilis (strain:168) dna] [db:genpept-bct] [de:bacillus subtilis 36kb sequence between gntz and trny genes encoding 34 ofs.] [le:32039] [re:33415] [di:complement] |
| 7079160_f3_3 | 3466 | 7120 | 867 | 288 | 1093 | 8.80E-111 | [ac:p35514] [gn:dnaj] [or:lactococcus lactis] [sr:,subsp:lactis:streptococcus lactis] [de:dnaj protein] [sp:p35514] [db:swissprot] |
| 7080186_f2_9 | 3467 | 7121 | 279 | 92 | 182 | 3.70E-13 | [ac:p37484] [gn:yybl] [or:bacillus subtilis] [de:hypothetical 74.3 kd protein in rpli-cotf intergenic region] [sp:p37484] [db:swissprot] |
| 7081261_f3_11 | 3468 | 7122 | 582 | 193 | 132 | 3.50E-07 | [ac:d69452] [pn:conserved hypothetical protein af1621] [or:archaeoglobus fulgidus] [db:pir] |
| 7081661_c1_27 | 3469 | 7123 | 1887 | 628 | 1360 | 4.50E-139 | [ac:f70089] [pn:two-component sensor histidine kinase [yyc homolog yycg] [gn:yycg] [or:bacillus subtilis] [db:pir] |
| 7081936_c2_36 | 3470 | 7124 | 861 | 286 | 463 | 5.00E-44 | [ac:a69997] [pn:hypothetical protein yvtmp] [gn:yvtmp] [or:bacillus subtilis] [db:pir] |
| 7085912_f2_66 | 3471 | 7125 | 681 | 226 | 572 | 1.40E-55 | [ac:p37678] [gn:sgbh] [or:escherichia coli] [ec:4.1.2.—] [de:3-hexulose 6-phosphate formaldehyde lyase)] [sp:p37678] [db:swissprot] |
| 7085962_f2_4 | 3472 | 7126 | 402 | 133 | 56 | 0.69 | [ln:hsu39106] [ac:u39106] [pn:t cell receptor alpha chain] [or:homo sapiens] [sr:human] [db:genpept-pri2] [de:human t cell receptor alpha chain mrna, partial cds.] [le:<1] [re: |

TABLE 2-continued

| Orf | NT Seq ID | AA Seq ID | NT Orf length | AA Orf length | Score | Probability | Description |
|---|---|---|---|---|---|---|---|
| 7086593_c1_55 | 3473 | 7127 | 1581 | 526 | 89 | 0.084 | [ac:s74039] [pn:hypothetical protein c0103] [or:*sulfolobus solfataricus*] [db:pir] |
| 7087562_f2_29 | 3474 | 7128 | 915 | 304 | 149 | 3.00E-07 | [ln:celf16f9] [acu:679956] [gn:f16f9.2] [or:*caenorhabditis elegans*] [sr:*caenorhabditis elegans* strain=bristol n2] [db:genpept-inv] [de:*caenorhabditis elegans* cosmid f16f9.] [nt:coded for by c. elegans cdna yk 126f9.5; coded for] [le:12057:12743:13277] [re:1 |
| 7087687_f3_75 | 3475 | 7129 | 522 | 173 | 65 | 0.97 | [ln:pcu31054] [acu31054] [gn:arom] [or:*pneumocystis carinii* f. sp. oryctolagi] [sr:*pneumocystis carinii*] [db:genpept-pln] [de:*pneumocystis carinii* f. sp. oryctolagi* (arom) gene, epsp synthase domain, partial cds.] [nt:encodes epsp synthase domain] [le:<1] |
| 7114188_c3_19 | 3476 | 7130 | 225 | 74 | 215 | 9.60E-18 | [ln:efu25093] [acu25093] [pn:pyrimidine biosynthesis protein c] [gn:pyrc] [or:*enterococcus faecalis*] [db:genpept-bct] [de:*enterococcus faecalis* plasmid pkv48 pyrimidine biosynthesis proteinc (pyrc) gene, partial cds.] [le:<1] [re: |
| 7120453_c3_54 | 3477 | 7131 | 321 | 106 | 90 | 0.00082 | [ln:stcatmyo] [ac:z66527] [pn:cardiac tropomyosin] [or:*salmo trutta*] [sr:brown trout] [db:genpept-vrt] [des. *trutta* mrna for cardiac tropomyosin.] [sp:q91489] [le:1] [re: |
| 7120692_c3_10 | 3478 | 7132 | 183 | 60 | 68 | 0.22 | [ln:efplscplg] [ac:x96976] [pn:transposase] [db:genpept-bct] [de:*e. faecalis* plasmid dna sep1 gene, 4068bp.] [le:2496] [re:3455] [di:complement] [or:*enterococcus faecalis*] |
| 7160338_f3_4 | 3479 | 7133 | 381 | 126 | 76 | 0.018 | [ac:p44301] [gn:hi1737] [or:*haemophilus influenzae*] [de:hypothetical protein hi1737] [sp:p44301] [db:swissprot] |
| 7187_f2_28 | 3480 | 7134 | 192 | 63 | 52 | 0.36 | [ac:p46341] [gn:yqgi] [or:*bacillus subtilis*] [de:intergenic region (orf74)] [sp:p46341] [db:swissprot] |
| 7226411_f1_2 | 3481 | 7135 | 1908 | 635 | 161 | 2.30E-08 | [ac:a64696:b64573] [pn:hypothetical protein hp0426/hp1409] [or:*helicobacter pylori*] [db:pir] |
| 7227188_c3_7 | 3482 | 7136 | 294 | 97 | 172 | 3.50E-13 | [ac:b69811] [pn:conserved hypothetical protein yfll] [gn:yfll] [or:*bacillus subtilis*] [db:pir] |
| 7229093_c3_23 | 3483 | 7137 | 1308 | 435 | 524 | 1.70E-50 | [ac:p10449] [gn:spac12b10.16c] [or:*schizosaccharomyces pombe*] [sr:fission yeast] [de:hypothetical 57.2 kd protein c12b10.16c in chromosome i] [sp:q10449] [db:swissprot] |
| 7236512_c2_81 | 3484 | 7138 | 915 | 304 | 122 | 1.20E-05 | [ln:bbu45425] [acu.45425] [gn:rep+] [or:*borrelia burgdorferi*] [sr:lyme disease spirochete strain=297] [db:genpept-bct] [de:*borrelia burgdorferi* 2.9-5 locus, orf-a-d, rep+, rep-, and lipoprotein (lp) genes, complete cds.] [nt:repeat motif-containing gene] [ |
| 7240812_f3_57 | 3485 | 7139 | 357 | 118 | 379 | 4.00E-35 | [ln:smu88582] [ac:u88582] [pn:ylxm] [gn:ylxm] [fn:unknown] [or:*streptococcus mutans*] [db:genpept-bct] [de:*streptococcus mutans* sat operon: putative glycinebetaine-binding protein prox (prox) gene, partial cds, ylxm (ylxm) gene, complete cds and signal recog |
| 7242052_c2_40 | 3486 | 7140 | 876 | 291 | 214 | 1.20E-17 | [ac:h70080] [pn:conserved hypothetical protein yxkf] [or:*bacillus subtilis*] [db:pir] |
| 7242205_c1_10 | 3487 | 7141 | 288 | 95 | 347 | 9.90E-32 | [ac:f69700] [pn:ribosomal protein s15 (bs18) rpso] [gn:rpso] [or:*bacillus subtilis*] [db:pir] |
| 7243751_f1_3 | 3488 | 7142 | 750 | 249 | 485 | 8.60E-73 | [ac:p22094] [or:*lactococcus lactis*:*lactococcus lactis*] [sr:subspcremoris:*streptococcus cremoris*:subsplactis:*streptococcus lactis*] [de:hypothetical 30.9 kd protein in pepx 5' region (orfl)] [sp:p22094] [db:swissprot] |
| 7243775_c3_13 | 3489 | 7143 | 261 | 86 | 185 | 1.40E-14 | [ac:p20804:p73284] [gn:acpp:acp.ss12084] [or:*synechocystis sp*] [sr:pcc 6803,] [de:acyl carrier protein (acp)] [sp:p20804:p73284] [db:swissprot] |

TABLE 2-continued

| Orf | NT Seq ID | AA Seq ID | NT Orf length | AA Orf length | Score | Probability | Description |
|---|---|---|---|---|---|---|---|
| 7244437_c2_80 | 3490 | 7144 | 1155 | 384 | 560 | 2.70E-54 | [ln:eftu09422] [acc:u09422] [or:enterococcus faecalis] [db:genpept-bct] [de:enterococcus faecalis ds16 transposon tn916, (tct(m)), (xis-tn), (int-tn) genes, orfs 1–24, complete cds, complete sequence,] [nt:orf14] [le:9816] [re:10817] [di:direct] |
| 7267192_c2_110 | 3491 | 7145 | 354 | 117 | 147 | 1.50E-10 | [acc:41868] [pn:trac1] [or:enterococcus faecalis] [db:pir] |
| 7289000_c1_58 | 3492 | 7146 | 3573 | 1190 | 151 | 1.00E-06 | [ln:celzk84] [acc:u23181] [gn:zk84.1] [or:caenorhabditis elegans] [sr:caenorhabditis elegans strain=bristol n2] [db:genpept-inv] [de:caenorhabditis elegans cosmid zk84.] [nt:final exon in repeat region; similar to long tandem] [le:24170:24288:24411:24654] |
| 7303457_f3_18 | 3493 | 7147 | 903 | 300 | 467 | 1.90E-44 | [acc:d69841] [pn:hypothetical protein yits] [gn:yits] [or:bacillus subtilis] [db:pir] |
| 7304700_c3_269 | 3494 | 7148 | 1020 | 339 | 448 | 2.00E-42 | [ac:h69229] [pn:phosphoglycerate dehydrogenase] [gn:mth970] [or:methanobacterium thermoautotrophicum] [db:pir] |
| 7304712_c1_30 | 3495 | 7149 | 1287 | 428 | 104 | 0.039 | [ln:pfcompira] [accx95275] [or:plasmodium falciparum] [sr:malaria parasite] [db:genpept-inv] [de:p. falciparum complete gene map of plastid-like dna (ir-a).] [nt:frameshift] [le:11844:13418] [re:13418:14725] [di:directjoin] |
| 7320300_f3_51 | 3496 | 7150 | 513 | 170 | 242 | 1.30E-20 | [acc:q57066] [gn:hi1720] [or:haemophilus influenzae] [de:hypothetical protein hi1720] [sp:q57066] [db:swissprot] |
| 7320300_f3_7 | 3497 | 7151 | 306 | 101 | 151 | 5.80E-11 | [acc:q48585] [or:lactobacillus johnsonii] [de:insertion element is 1223 hypothetical 20.7 kd protein (orfa)] [sp:q48585] [db:swissprot] |
| 7320300_f3_94 | 3498 | 7152 | 555 | 184 | 260 | 1.60E-22 | [acc:q57066] [gn:hi1720] [or:haemophilus influenzae] [de:hypothetical protein hi1720] [sp:q57066] [db:swissprot] |
| 781253_c1_24 | 3499 | 7153 | 861 | 286 | 561 | 2.10E-54 | [acc:p39805] [gn:licт:n15a] [or:bacillus subtilis] [de:transcription antiterminator lict] [sp:p39805] [db:swissprot] |
| 781125_c3_87 | 3500 | 7154 | 942 | 313 | 475 | 2.70E-45 | [acc:f69795] [pn:conserved hypothetical protein yerq] [gn:yerq] [or:bacillus subtilis] [db:pir] |
| 781280_c1_45 | 3501 | 7155 | 207 | 68 | 68 | 0.4 | [ln:efas48c] [acc:y12234] [pn:as-48b protein] [gn:as-48b] [fn:as-48 maturation and biosynthesis] [or:enterococcus faecalis] [db:genpept-bct] [de:e. faecalis plasmid dna containing gene cluster involved inproduction and immunity to peptide antibiotic as-48.] |
| 7812_c2_84 | 3502 | 7156 | 1551 | 516 | 183 | 3.60E-10 | [ln:enhmhcax] [acc:103534] [pn:myosin heavy chain] [gn:mhca] [or:entamoeba histolytica] [db:genpept-inv] [de:entamoeba histolytica myosin heavy chain (mhca) gene, complete cds.] [le:368] [re:6787] [di:direct] |
| 78135_f1_11 | 3503 | 7157 | 186 | 61 | 58 | 0.35 | [ln:humigmv0s] [acc:121744] [gn:vh6dj] [or:homo sapiens] [sr:homo sapiens] (individual_isolate patient pau) female spleen cdna t] [db:genpept-pri1] [de:human (patient pau) rearranged igm heavy chain variable region, diversity region, and joining region (vh6d |
| 7838_c1_37 | 3504 | 7158 | 186 | 61 | 71 | 0.1 | [acc:p31316] [gn:gsh2:gsh-2] [or:mus musculus] [sr:mouse] [de:homeobox protein gsh-2] [sp:p31316] [db:swissprot] |
| 78751_c3_71 | 3505 | 7159 | 243 | 80 | 65 | 0.073 | [ln:btu11633] [acc:u11633] [pn:anti-idiotype ig lambda chain v region] [gn:igl] [or:bos taurus] [sr:cow] [db:genpept-mam] [de:bos taurus b11 cell-line anti-idiotype ig lambda chain v region (igl) mrna, partial cds.] [le:<8] [re: |
| 787842_f3_142 | 3506 | 7160 | 195 | 64 | 76 | 0.0089 | [acc:celf19c7] [acc:u42439] [gn:f19c7.5] [or:caenorhabditis elegans] [sr:caenorhabditis elegans strain=bristol n2] [db:genpept-inv] [de:caenorhabditis elegans cosmid f19c7.] [le:1388:1442:1597:1776] [re:1397:1537:1728:1848] [di:directjoin] |
| 788182_c1_30 | 3507 | 7161 | 1560 | 519 | 544 | 1.30E-52 | [ac:b69780] [pn:transcriptional regulator (gntr family)/homolog ydfd] [gn:ydfd] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 7888124__c3__92 | 3508 | 7162 | 915 | 304 | 190 | 7.80E-13 | [ln:d86380] [ac:d86380] [pn:alkaline d-peptidase] [gn:adp] [or:*bacillus cereus*] [sr:*bacillus cerces* (isolate:soil) dna] [db:genpept-bct] [de:*bacillus cereus* dna for alkaline d-peptidase, complete cds.] [le:1] [re:1167] [di:direct] |
| 788952__c3__52 | 3509 | 7163 | 1296 | 431 | 1244 | 8.70E-127 | [ac:p43905] [gn:aroa] [or:*lactococcus lactis*] [sr:,subsplactis:*streptococcus lactis*] [ec:2.5.1.19] [de:enolpyruvylshikimate-3-phosphate synthase) (epsp synthase)] [sp:p43905] [db:swissprot] |
| 79375__c2__68 | 3510 | 7164 | 204 | 67 | 73 | 0.011 | [ac:q38804] [gn:mtlc] [or:*arabidopsis thaliana*] [sr:,mouse-ear cress] [de: metallothionein-like protein lc (mt-lc)] [sp:q38804] [db:swissprot] |
| 7963__c3__32 | 3511 | 7165 | 1236 | 411 | 484 | 3.00E-46 | [ln:mtv016] [ac:a1021841] [pn:putative aminohydrolase] [gn:mtv016.05c] [or: *mycobacterium tuberculosis*] [db:genpept] [de:*mycobacterium tuberculosis* sequence v016.] [nt:mtv016.05c, len: 394, probable aminohydrolase] [le:3982] [re:5166] [di:complement] |
| 79655__f2__24 | 3512 | 7166 | 330 | 109 | 65 | 0.35 | [ac:a61399] [pn:early protein e7] [cl:bovine papillomavirus type 4 c6 protein] [or:bovine papillomavirus type 3] [db:pir] |
| 79657__c2__14 | 3513 | 7167 | 297 | 98 | 196 | 9.90E-16 | [ac:a69795] [pn:conserved hypothetical protein yerl] [gn:yerl] [or:*bacillus subtilis*] [db:pir] |
| 798812__f2__35 | 3514 | 7168 | 654 | 217 | 439 | 1.80E-41 | [ac:p44321] [gn:tag:hi0654] [or:*haemophilus influenzae*] [ec:3.2.2.20] [de:glycosylase) (tag)] [sp:p44321] [db:swissprot] |
| 80032__f1__2 | 3515 | 7169 | 870 | 289 | 455 | 3.50E-43 | [ac:s76767] [pn:hypothetical protein] [or:synechocystis sp.] [sr:pcc 6803, , pcc 6803] [sr:pcc 6803, ] [db:pir] |
| 803125__f2__6 | 3516 | 7170 | 360 | 119 | 75 | 0.085 | [ac:q25054] [or:*holotrichia diomphalia*] [de:holotricin 2 precursor] [sp:q25054] [db:swissprot] |
| 803393__f1__4 | 3517 | 7171 | 348 | 115 | 59 | 0.76 | [ac:h64660] [pn:hypothetical protein hp1128] [or:*helicobacter pylori*] [db:pir] |
| 803750__c2__52 | 3518 | 7172 | 1281 | 426 | 100 | 0.016 | [ln:cef56d5] [ac:z69662] [pn:f56d5.6] [or:*caenorhabditis elegans*] [db: genpept-inv] [de:*caenorhabditis elegans* cosmid f56d5, complete sequence.] [nt:protein predicted using genefinder] [le:13412:13594:15430:15734] [re:13537:13644:15687:15824] [di:directjoi |
| 804132__f2__39 | 3519 | 7173 | 213 | 70 | 55 | 0.58 | [ac:p49271] [or:*aptostichus schlingeri*] [sr:,trap-door spider] [de:aptotoxin vii (paralytic peptide vii) (pp vii)] [sp:p49271] [db:swissprot] |
| 804132__f3__11 | 3520 | 7174 | 213 | 70 | 55 | 0.58 | [ac:p49271] [or:*aptostichus schlingeri*] [sr:,trap-door spider] [de:aptotoxin vii (paralytic peptide vii) (pp vii)] [sp:p49271] [db:swissprot] |
| 806562__c3__56 | 3521 | 7175 | 186 | 61 | 46 | 0.047 | [ac:s20482] [pn:hypothetical protein] [or:*oryza sativa*] [sr:, rice] [db:pir] |
| 807812__c1__47 | 3522 | 7176 | 183 | 60 | 60 | 0.23 | [ln:yspcsx1f] [ac:d83417] [gn:csx1+] [or:*schizosaccharomyces pombe*] [sr:*schizosaccharomyces pombe* dna] [db:genpept-pln] [de: *schizosaccharomyces pombe* csx1+ gene, partial cds.] [nt:orf, start codon ans stop codon are not identified] [le<1] [re: |
| 82163__c1__57 | 3523 | 7177 | 252 | 83 | 68 | 0.11 | [ac:pc4341] [pn:cytoplasmic dyncin heavy chain 8] [or:*paramecium tetraurelia*] [db:pir] |
| 813760__c1__44 | 3524 | 7178 | 1488 | 495 | 1295 | 3.40E-132 | [ln:llu47655] [ac:u47655] [pn:lactose transport protein] [gn:lacs] [or:*leuconostoc lactis*] [sr:*leuconostoc lactis* strain=6009] [db:genpept-bct] [de:*leuconostoc lactis* plasmid pnz63 lactose transport protein (lacs) gene, partial cds.] [le:631] [re:2550] [di |
| 814182__f3__73 | 3525 | 7179 | 297 | 98 | 75 | 0.08 | [ac:p17955] [gn:nup62] [or:*rattus norvegicus*] [sr:,rat] [de:nuclear pore glycoprotein p62 (nucleoporin p62)] [sp:p17955] [db:swissprot] |
| 814425__c2__125 | 3526 | 7180 | 204 | 67 | 54 | 0.67 | [ac:b61399] [pn:early protein e7] [cl:bovine papillomavirus type 4 e6 protein] [or: bovine papillomavirus type 4] [db:pir] |

TABLE 2-continued

| Orf | NT Seq ID | AA Seq ID | NT Orf length | AA Orf length | Score | Probability | Description |
|---|---|---|---|---|---|---|---|
| 81576_f3_7 | 3527 | 7181 | 231 | 76 | 61 | 0.21 | [ln:chkiglan] [ac:m30469] [or:gallus gallus] [sr:chicken spleen lymphocyte transformed by [reticuloendoheliosi] [db:genpept-vrt] [de:chicken ig rearranged lambda-chain gene v-j region, clonerecc-ut6w22.] [nt:ig lambda-chain-v-j region] [le:<1] [re: |
| 817812_c1_17 | 3528 | 7182 | 213 | 70 | 61 | 0.57 | [ac:q10333] [gn:spac19g10.03c] [or:schizosaccharomyces pombe] [sr:,fission yeast] [de:hypothetical 24.7 kd protein c19g10.03 c in chromosome i] [sp:q10333] [db:swissprot] |
| 819300_c2_18 | 3529 | 7183 | 279 | 92 | 70 | 0.022 | [ac:f65138;t0477] [pn:hypothetical 10.7k protein in glpd-glgp intergenic region] [gn:yzg1] [or:escherichia coli] [db:pir] [mp:75 min] |
| 820262_c2_53 | 3530 | 7184 | 354 | 117 | 157 | 1.30E-11 | [ac:p39044] [gn:x] [or:bacillus sphaericus] [de:30s ribosomal protein s14 homolog] [sp:p39044] [db:swissprot] |
| 820461_f2_6 | 3531 | 7185 | 195 | 64 | 52 | 0.83 | [ac:q57255:p96342] [gn:hi1329] [or:haemophilus influenzae] [de:hypothetical protein hi1329] [sp:q57255:p96342] [db:swissprot] |
| 820812_c2_33 | 3532 | 7186 | 486 | 161 | 81 | 0.52 | [ac:p80803] [gn:nefa] [or:homo sapiens] [sr:,human] [de:dna-binding protein nefa precursor] [sp:p80303] [db:swissprot] |
| 822200_f2_13 | 3533 | 7187 | 399 | 132 | 94 | 0.0038 | [ac:p18584] [gn:sk59] [or:chlamydia trachomatis] [de:59 kd immunogenic protein] [sp:p18584] [db:swissprot] |
| 823750_c3_27 | 3534 | 7188 | 663 | 220 | 72 | 0.049 | [ln:pldnapsba] [ac:y13398] [pn:d1 protein] [gn:psba] [or:porphyra linearis] [db:genpept-pln] [de:porphyra linearis psba gene, partial.] [le:<1] [re: |
| 824008_f2_24 | 3535 | 7189 | 2274 | 757 | 204 | 7.80E-13 | [ac:d69907] [pn:hypothetical protein yojo] [gn:yojo] [or:bacillus subtilis] [db:pir] |
| 834425_c2_52 | 3536 | 7190 | 252 | 83 | 63 | 0.12 | [ac:p40844] [or:rana esculenta] [sr:,edible frog] [de:esculentin-1b precursor] [sp:p40844] [db:swissprot] |
| 835031_f1_12 | 3537 | 7191 | 201 | 66 | 58 | 0.34 | [ln:ab0009454] [ac:ab0009454] [pn:uroplakin 2] [or:homo sapiens] [sr:,homo sapiens bladder cdna to mrna] [db:genpept-pri2] [de:homo sapiens mrna for uroplakin 2, partial cds.] [le:<1] [re: |
| 838156_f3_23 | 3538 | 7192 | 192 | 63 | 51 | 0.17 | [ac:pn0541] [pn:reca protein] [gn:reca] [cl:reca protein] [or:acetobacter aceti] [db:pir] |
| 8443_f1_4 | 3539 | 7193 | 1290 | 429 | 671 | 4.60E-66 | [ac:c69813] [pn:rna helicase homolog yfml] [gn:yfml] [or:bacillus subtilis] [db:pir] |
| 8467_c2_30 | 3540 | 7194 | 204 | 67 | 74 | 0.012 | [ac:p39169:p76624:p77022:p77023] [gn:ygau] [or:escherichia coli] [de:unknown protein from 2d-page (spot lm6)] [sp:p39169:p76624:p77022:p77023] [db:swissprot] |
| 85061_f3_47 | 3541 | 7195 | 234 | 77 | 60 | 0.092 | [ac:p34100] [gn:pk1] [or:dictyostelium discoideum] [sr:,slime mold] [ec:2.7.1.—] [de:developmentally regulated protein kinase 1, (fragment)] [sp:p34100] [db:swissprot] |
| 85130_f3_95 | 3542 | 7196 | 327 | 108 | 54 | 0.69 | [ac:g64536] [pn:hypothetical protein hp0135] [or:helicobacter pylori] [db:pir] |
| 860002_c2_160 | 3543 | 7197 | 552 | 183 | 109 | 0.00011 | [ln:pfu41847] [ac:u41847] [pn:resa-h3 antigen] [gn:resa-h3] [or:plasmodium falciparum] [sr:malaria parasite strain=ibr (west africa)] [db:genpept-inv] [de:plasmodium falciparum resa-h3 antigen gene, partial cds.] [le:<1] [re: |
| 863400_f2_30 | 3544 | 7198 | 435 | 145 | 61 | 0.31 | [ac:s24712] [pn:ig alpha chain] [or:homo sapiens] [sr:,man] [db:pir] |
| 864818_c2_16 | 3545 | 7199 | 375 | 124 | 385 | 9.30E-36 | [ac:d69879] [pn:alkaline-shock protein homolog ylou] [gn:ylou] [or:bacillus subtilis] [db:pir] |
| 866702_c1_5 | 3546 | 7200 | 288 | 95 | 165 | 7.90E-12 | [ln:bsarare] [ac:x98354] [pn:dna-binding protein] [gn:arar] [or:bacillus subtilis] [db:genpept-bct] [de:b. subtilis arar and arae genes.] [nt:putative] [le:874] [re:1962] [di:direct] |
| 867338_f2_74 | 3547 | 7201 | 1653 | 550 | 1864 | 1.70E-192 | [ac:q48796] [gn:mlca] [or:leuconostoc oenos] [ec:1.—.—.—] [de:malolactic enzyme,] [sp:q48796] [db:swissprot] |

TABLE 2-continued

| Orf | NT Seq ID | AA Seq ID | NT Orf length | AA Orf length | Score | Probability | Description |
|---|---|---|---|---|---|---|---|
| 867813_c2_8 | 3548 | 7202 | 369 | 122 | 192 | 2.60E-15 | [ac:p37547] [gn:yabf] [or:*bacillus subtilis*] [de:hypothetical 20.7 kd protein in mcts-ksga intergenic region] [sp:p37547] [dbs:swissprot] |
| 881877_f2_13 | 3549 | 7203 | 285 | 94 | 71 | 0.017 | [ln:af015193] [ac:af015193] [pn:nadh dehydrogenase subunit 3] [or: mitochondrion *onchocerca volvulus*] [sr:*onchocerca volvulus*] [db:genpept-inv] [de:*onchocerca volvulus* mitochondrion, complete genome,] [le:11498] [re:11836] [di:direct] |
| 881903_c2_5 | 3550 | 7204 | 270 | 89 | 73 | 0.081 | [ln:celt01b11] [ac:u80931] [gn:t01b11.1] [or:*caenorhabditis elegans*] [sr: *caenorhabditis elegans* strain-bristol n2] [db:genpept-inv] [de:*caenorhabditis elegans* cosmid t01b11.] [le:5613:5895:6191:6491] [re:5838:6094:6282:6604] [di:direct|join] |
| 885965_c1_12 | 3551 | 7205 | 186 | 61 | 73 | 0.081 | [ac:q58049] [gn:mj0632] [or:*methanococcus jannaschii*] [de:hypothetical atp-binding protein mj0632] [sp:q58049] [dbs:swissprot] |
| 891251_c3_78 | 3552 | 7206 | 273 | 90 | 65 | 0.86 | [ac:q27783] [or:*trypanosoma brucei brucei*] [ec:1.5.1.3:2.1.1.45] [de:(ec 2.1.1.45) (dhfr-ts)] [sp:q27783] [dbs:swissprot] |
| 892283_c1_50 | 3553 | 7207 | 219 | 72 | 72 | 0.15 | [ac:s65238] [pn:probable membrane protein yp1219w:hypothetical protein p1745] [gn:npc18] [or:*saccharomyces cerevisiae*] [db:pir] [mp:161] |
| 892327_c3_95 | 3554 | 7208 | 444 | 147 | 78 | 0.48 | [ln:ratlin3a] [ac:m13100] [pn:unknown protein] [or:*rattus norvegicus*] [sr:*rattus norvegicus* (clone: lambda 4a1-3,) liver dan] [db:genpept-rod] [de:rat long interspersed repetitive dna sequence line3 (11rn).] [nt:orfa; putative] [le:1229] [re:2035] [di:co |
| 892530_f2_12 | 3555 | 7209 | 228 | 75 | 72 | 0.026 | [ln:btu66897] [ac:u66897] [pn:alpha-glucosidase] [gn:susb] [or:*bacteroides thetaiotaomicron*] [db:genpept-bct] [de:*bacteroides thetaiotaomicron* neopullulanase (susa) and alpha-glucosidase (susb) genes, complete cds.] [le:2447] [re:4663] [di:direct] |
| 895316_f1_8 | 3556 | 7210 | 378 | 125 | 51 | 0.98 | [ac:p39500] [gn:yi3g:ccd.4] [or:bacteriophage t4] [de:hypothetical 7.9 kd protein in cd-pset intergenic region] [sp:p39500] [dbs:swissprot] |
| 898452_c1_55 | 3557 | 7211 | 2223 | 740 | 2530 | 4.60E-263 | [ac:p12042] [gn:pur1] [or:*bacillus subtilis*] [ec:6.3.5.3] [de:synthase ii] [sp:p12042] [dbs:swissprot] |
| 898900_f1_4 | 3558 | 7212 | 1461 | 486 | 77 | 0.13 | [ac:p07082] [gn:y04b:55.2] [or:bacteriophage t4] [de:hypothetical 12.7 kd protein in gp55-nrdg intergenic region] [sp:p07082] [dbs:swissprot] |
| 899088_c3_53 | 3559 | 7213 | 834 | 277 | 468 | 1.50E-44 | [ln:ab002668] [ac:ab002668] [or:*haemophilus actinomycetemcomitans*] [sr:*actinobacillus actinomycetemcomitans* (strain:y4) dna] [db:genpept-bct] [de:*actinobacillus actinomycetemcomitans* dna for glycosyltransferase, lytic transglycosylase, ddtp-4-rhamnose redu |
| 900327_c1_52 | 3560 | 7214 | 672 | 223 | 539 | 4.50E-52 | [ac:p54154] [gn:yppp] [or:*bacillus subtilis*] [de:reductase)] [sp:p54154] [dbs:swissprot] |
| 9018758_c2_31 | 3561 | 7215 | 693 | 230 | 535 | 1.20E-51 | [ac:p53579] [gn:slr0918] [or:*synechocystis sp*] [sr:pcc 6803,] [ec:3.4.11.18] [de:m] [sp:p53579] [dbs:swissprot] |
| 912_c2_15 | 3562 | 7216 | 945 | 314 | 114 | 0.00091 | [ac:q09316] [gn:t2f5b.5] [or:*caenorhabditis elegans*] [de:hypothetical 61.3 kd protein f2b5.5 in chromosome iii] [sp:q09316] [dbs:swissprot] |
| 915962_c1_122 | 3563 | 7217 | 1179 | 392 | 239 | 5.70E-18 | [ac:p49859] [gn:3] [or:bacteriophage hk97] [de:portal protein (gp3)] [sp:p49859] [dbs:swissprot] |
| 93268_f2_2 | 3564 | 7218 | 219 | 72 | 62 | 0.15 | [ln:s74916] [ac:s74916] [pn:mm4 muscarinic acetylcholine receptor] [gn:machr] [or:mus sp. brain] [db:genpept-rod] [de:machr=mm4 muscarinic acetylcholine receptor [mice, brain, mrna partial, 362 nt.] [nt:this sequence comes from FIG. 2b; mm4 m |
| 94092_c2_21 | 3565 | 7219 | 813 | 270 | 667 | 1.20E-65 | [ac:p69477] [pn:abc transporter, atp-binding protein homolog] [or:*archaeoglobus fulgidus*] [db:pir] |

TABLE 2-continued

| Orf | NT Seq ID | AA Seq ID | NT Orf length | AA Orf length | Score | Probability | Description |
|---|---|---|---|---|---|---|---|
| 9455_f1_1 | 3566 | 7220 | 792 | 263 | 174 | 6.80E-12 | [acc:a56716] [pn:biphenyl hydrolase-related protein,] [gn:bphrp] [or:homo sapiens] [sr:, man] [ec:3.4.21.—] [db:pir] |
| 954512_c2_33 | 3567 | 7221 | 1173 | 390 | 1699 | 5.30E-175 | [acc:p52329] [gn:rpod] [or:enterococcus faecalis] [sr:streptococcus faecalis] [de:rna polymerase sigma factor rpod sigma-42] [sp:p52329] [db:swissprot] |
| 957811_c2_10 | 3568 | 7222 | 315 | 104 | 159 | 8.30E-12 | [acc:b69770] [pn:conserved hypothetical protein ydas] [gn:ydas] [or:bacillus subtilis] [db:pir] |
| 95906_f2_4 | 3569 | 7223 | 423 | 140 | 120 | 1.10E-07 | [acc:p51716] [or:bacteriophage hp1] [de:hypothetical 14.9 kd protein in rep-hol intergenic region (orf14)] [sp:p51716] [db:swissprot] |
| 961467_c2_14 | 3570 | 7224 | 1005 | 334 | 944 | 5.40E-95 | [acc:b69727] [pn:elongation factor ts tsf] [gn:tsf] [or:bacillus subtilis] [db:pir] |
| 961592_c2_25 | 3571 | 7225 | 552 | 183 | 472 | 5.60E-45 | [acc:s62019] [pn:hypothetical protein ydr540c:hypothetical protein d3703.8] [or:saccharomyces cerevisiae] [db:pir] [mp:4r] |
| 962961_c3_13 | 3572 | 7226 | 876 | 292 | 98 | 0.048 | [acc:s75308] [pn:hypothetical protein] [or:synechocystis sp.] [sr:pcc 6803, , pcc 6803,] [db:pir] |
| 963942_c2_19 | 3573 | 7227 | 360 | 119 | 145 | 3.30E-10 | [acc:s70045] [pn:hypothetical protein yvqf] [gn:yvqf] [or:bacillus subtilis] [db:pir] |
| 964203_f3_8 | 3574 | 7228 | 339 | 112 | 529 | 5.10E-51 | [ln:entaorf] [acc:x94181] [gn:orf2] [or:enterococcus faecium] [db:genpept-bct] [de:e. faecium enta and orf2 genes.] [le:.307] [re:618] [di:direct] |
| 964687_f1_3 | 3575 | 7229 | 594 | 197 | 60 | 0.59 | [ln:hiv1u14546] [acc:u14546] [pn:envelope glycoprotein] [gn:env] [or:human immunodeficiency virus type 1] [db:genpept-vrl] [de:human immunodeficiency virus type 1 clone mp49a envelope glycoprotein (env) gene, partial cds.] [le:<1] [re: |
| 970287_c3_83 | 3576 | 7230 | 501 | 166 | 159 | 8.30E-12 | [acc:p37187:p76413] [gn:gata] [or:escherichia coli] [ec:2.7.1.69] [de:(ec 2.7.1.69)] [sp:p37187;p76413] [db:swissprot] |
| 972300_f2_17 | 3577 | 7231 | 615 | 204 | 492 | 4.30E-47 | [acc:p29132] [gn:fabi:envm] [or:escherichia coli] [ec:1.3.1.9] [de:dependent enoyl-acp reductase] [sp:p29132] [db:swissprot] |
| 973441_f1_1 | 3578 | 7232 | 1338 | 445 | 841 | 4.40E-84 | [acc:p08750] [gn:daca] [or:bacillus subtilis] [ec:3.4.16.4] [de:peptidase] (dd-carboxypeptidase) (cpase) (pbp5)] [sp:p08750] [db:swissprot] |
| 975277_f3_78 | 3579 | 7233 | 1065 | 354 | 147 | 3.50E-07 | [acc:p37966] [gn:lpla] [or:bacillus subtilis] [de:lipoprotein lpla precursor] [sp:p37966] [db:swissprot] |
| 976550_c3_31 | 3580 | 7234 | 876 | 291 | 489 | 8.90E-47 | [acc:p28635] [gn:yaec] [or:escherichia coli] [de:precursor] [sp:p28635] [db:swissprot] |
| 976568_c3_39 | 3581 | 7235 | 1632 | 543 | 2115 | 4.40E-219 | [acc:e69861] [pn:abc transporter (atp-binding protein) homolog ykpa] [gn:ykpa] [or:bacillus subtilis] [db:pir] |
| 976577_c1_84 | 3582 | 7236 | 828 | 275 | 516 | 1.20E-49 | [ln:ae001165] [acc:ae001165:ac00783] [pn:spermidine/putrescine abc transporter, permease, bb0640] [or:borrelia burgdorferi] [sr:lyme disease spirochete] [db:genpept-bct] [de:borrelia burgdorferi (section 51 of 70) of the complete genome.] [nt:similar |
| 9766583_f1_1 | 3583 | 7237 | 225 | 74 | 66 | 0.057 | [ln:bvcrk2] [acc:z71704] [pn:cdc2-related protein kinase] [or:beta vulgaris] [sr:beet] [db:genpept pln] [de:b. vulgaris mrna for cdc2-related protein kinase.] [le:<1] [re: |
| 9766588_c2_62 | 3584 | 7238 | 525 | 174 | 339 | 7.00E-31 | [acc:d69633] [pn:glutamine abc transporter (glutamine-binding protein) glnh] [gn:glnh] [or:bacillus subtilis] [db:pir] |
| 977217_c3_93 | 3585 | 7239 | 1521 | 506 | 941 | 1.10E-94 | [acc:b69989] [pn:lipoprotein homolog ytcq] [gn:ytcq] [or:bacillus subtilis] [db:pir] |
| 9772626_f3_128 | 3586 | 7240 | 192 | 63 | 57 | 0.41 | [acc:a44971] [pn:hypothetical protein 1] [or:plasmodium brasilianum] [db:pir] |
| 978132_c3_72 | 3587 | 7241 | 1599 | 533 | 433 | 7.60E-41 | [acc:s56976] [pn:transfer complex protein trsk] [gn:trsk] [or:staphylococcus aureus] [db:pir] |

TABLE 2-continued

| Orf | NT Seq ID | AA Seq ID | NT Orf length | AA Orf length | Score | Probability | Description |
|---|---|---|---|---|---|---|---|
| 9781965_f1_1 | 3588 | 7242 | 273 | 90 | 87 | 0.00035 | [ln:mgu02241] [ac:u02241] [pn:unknown] [fn:unknown] [or:mycoplasma genitalium] [dbgenpept-bct] [de:mycoplasma genitalium random genomic clone xe5, partial cds.] [le:1] [re:314] [di:direct] |
| 978377_c2_112 | 3589 | 7243 | 294 | 97 | 101 | 1.20E-05 | [ac:b69926] [pn:hypothetical protein yosh] [gn:yosh] [or:bacillus subtilis] [db:pir] |
| 978438_f2_17 | 3590 | 7244 | 339 | 112 | 195 | 1.30E-15 | [ln:apu72238] [ac:u72238] [or:anabaena pcc7120] [db:genpept-bct] [de: anabaena pcc7120 orfr1, orfr2, orfr3, orfr5, and orfr5 genes, complete sequences.] [nt:orf4] [le:3895] [re:4137] [di:direct] |
| 978885_c3_30 | 3591 | 7245 | 570 | 189 | 81 | 0.07 | [ac:q59659] [gn:sdhc] [or:paracoccus denitrificans] [de:succinate dehydrogenase cytochrome b-556 subunit] [sp:q59659] [db:swissprot] |
| 9792552_c3_156 | 3592 | 7246 | 219 | 72 | 54 | 0.17 | [ln:cel28a11] [ac:u80027] [gn:t28a11.15] [or:caenorhabditis elegans] [sr:caenorhabditis elegans strain=bristol n2] [db:genpept-inv] [de:caenorhabditis elegans cosmid t28a11.] [nt:coded for by c. elegans cdna ceesh22c; weak] [le:13247:13404:13861] [re:13 |
| 9792562_c2_14 | 3593 | 7247 | 231 | 76 | 70 | 0.21 | [ln:cew05h5] [ac:z81139] [pn:w05h5.3] [or:caenorhabditis elegans] [dbgenpept-inv] [de:caenorhabditis elegans cosmid w05h5, complete sequence.] [nt:similar to phosphate permease] [le:4177:4716:4858:5055] [re:4620:4812: 5000:5338] [di:direct]join] |
| 979657_c2_131 | 3594 | 7248 | 1539 | 512 | 479 | 1.00E-45 | [ac:q03523] [gn:mure] [or:bacillus subtilis] [ec:6.3.2.13] [de(ec 6.3.2.13) (upd-n-acetylmuramyl-tripeptide synthetase)] [sp:q03523] [db:swissprot] |
| 9797032_c2_14 | 3595 | 7249 | 483 | 160 | 204 | 2.40E-16 | [ln:efu09422] [ac:u09422] [or:enterococcus faecalis] [db:genpept-bct] [de:enterococcus faecalis ds16 transposon tn916, (tet(m)), (xis-tn), (int-tn) genes, orfs 1–24, complete cds, complete sequence.] [nt:orf14] [le:9816] [re:10817] [di:direct] |
| 979713_c2_21 | 3596 | 7250 | 1785 | 594 | 643 | 4.20E-63 | [ac:q11018] [gn:mtcy02b10.12] [or:mycobacterium tuberculosis] [de:hypothetical abc transporter atp-binding protein cy02b10.12] [sp:q11018] [db:swissprot] |
| 9800433_f3_13 | 3597 | 7251 | 303 | 100 | 68 | 0.57 | [ln:ae001115] [ac:ae001115] [or:borrelia burgdorferi] [pn:b. burgdorferi predicted coding region bb0001] [gn:bb0001] [de:borrelia burgdorferi] [sr:lyme disease spirochete] [db:genpept-bct] [de:borrelia burgdorferi (section 1 of 70) of the complete genome.] [nt:hypothetica |
| 9800706_c1_46 | 3598 | 7252 | 1995 | 664 | 349 | 3.60E-40 | [ac:s52348] [pn:hypothetical protein 2] [or:lactobacillus leichmannii] [db:pir] |
| 9804090_f1_11 | 3599 | 7253 | 477 | 158 | 81 | 0.26 | [ln:ae001129] [ac:ae001129:ac000783] [pn:b. burgdorferi predicted coding region bb0193] [gn:bb0193] [or:borrelia burgdorferi] [sr:lyme disease spirochete] [db:genpept-bct] [de:borrelia burgdorferi (section 15 of 70) of the complete genome.] [nt:hypothetic |
| 9804628_f3_53 | 3600 | 7254 | 639 | 212 | 159 | 8.70E-12 | [ac:p27851] [gn:ubie] [or:escherichia coli] [ec:2.1.1.—] [de:(ec 2.1.1.—)] [sp:p27851] [db:swissprot] |
| 9805463_f2_3 | 3601 | 7255 | 405 | 134 | 480 | 8.00E-46 | [ac:p07842] [gn:rpsi] [or:bacillus stearothermophilus] [de:30s ribosomal protein s9 (bs10)] [sp:p07842] [db:swissprot] |
| 9806258_c3_6 | 3602 | 7256 | 189 | 62 | 46 | 0.091 | [ac:s61077] [gn:bilf2] [or:human herpesvirus 4] [sr:epstein-barr virus] [db: genpept-vrl] [de:bilf2=putative glycoprotein {promoter} [epstein-barr virus cbv, genomic, 576 nt.] [le:1] [re:331] [di:complement] |
| 9806592_c2_132 | 3603 | 7257 | 201 | 67 | 92 | 0.0001 | [ln:bphiadh] [ac:z97974] [pn:hypothetical protein] [gn:orfc] [or:bacteriophage phiadh] [db:genpept-una] [de:bacteriophage phiadh lys, hol, intg, rad, and tec genes.] [le:2132] [re:2317] [di:direct] |
| 9814013_f2_9 | 3604 | 7258 | 1851 | 616 | 1570 | 2.50E-161 | [ac:f69901] [pn:atp-dependent dna helicase homolog yoci] [gn:yoci] [or:bacillus subtilis] [db:pir] |

TABLE 2-continued

| Orf | NT Seq ID | AA Seq ID | NT Orf length | AA Orf length | Score | Probability | Description |
|---|---|---|---|---|---|---|---|
| 9814016_c3_10 | 3605 | 7259 | 264 | 87 | 88 | 0.0037 | [ln:hummuc2a] [ac:m74027] [pn:mucin] [gn:muc2] [or:homo sapiens] [sr: homo sapiens (tissue library: lambda-gem-11 (stratagene) bloo] [db:genpept-pri1] [de:human mucin-2 gene, partial cds.] [le:1] [re:1720] [di:direct] |
| 9816535_f2_61 | 3606 | 7260 | 504 | 167 | 200 | 3.70E-16 | [ac:p32058] [gn:cmtb] [or:escherichia coli] [ec:2.7.1.69] [de:enzyme ii, a component).] [sp:p32058] [dbs:swissprot] |
| 9819378_c1_57 | 3607 | 7261 | 600 | 199 | 186 | 2.60E-14 | [ac:q57819] [gn:mj0374] [or:methanococcus jannaschii] [de:hypothetical protein mj0374] [sp:q57819] [dbs:swissprot] |
| 9820327_c1_109 | 3608 | 7262 | 498 | 165 | 718 | 4.80E-71 | [ln:lmu40997] [ac:u40997] [pn:dihydrofolate reductase] [or:listeria monocytogenes] [db:genpept-bct] [de:listeria monocytogenes replication protein (rep), dihydrofolate reductase, and mobilization/recombination protein genes, complete cds.] [nt:dhfr 11 prote |
| 9843750_c2_36 | 3609 | 7263 | 234 | 78 | 61 | 0.31 | [ac:b60337] [pn:hypothetical protein pplb] [or:legionella pneumophila] [db:pir] |
| 9844082_f1_4 | 3610 | 7264 | 483 | 160 | 88 | 0.15 | [ac:p38739] [gn:yhl028w] [or:saccharomyces cerevisiae] [sr:,baker's yeast] [de:hypothetical 63.8 kd protein in gut1-rim1 intergenic region precursor] [sp:p38739] [dbs:swissprot] |
| 9844377_c1_23 | 3611 | 7265 | 1500 | 499 | 2038 | 6.40E-211 | [ac:f69729] [pn:excinuclease abc (subunit a) uvra] [gn:uvra] [or:bacillus subtilis] [db:pir] |
| 984536_c2_154 | 3612 | 7266 | 1209 | 402 | 1160 | 7.00E-118 | [ln:efu09422] [ac:u09422] [or:enterococcus faecalis] [db:genpept-bct] [de:enterococcus faecalis ds16 transposon tn916, (tet(m)), (xis-tn), (int-tn) genes, orfs 1–24, complete cds, complete sequence.] [nt:orf20] [le:2861] [re:3850] [di:direct] |
| 9847200_c1_28 | 3613 | 7267 | 1374 | 457 | 1382 | 2.10E-141 | [ac:s41386] [pn:glutathione reductase (nadph),] [cl:dihydrolipoamide dehydrogenase:dihydrolipoamide dehydrogenase homology] [or:streptococcus thermophilus] [ec:1.6.4.2] [db:pir] |
| 984800_f3_55 | 3614 | 7268 | 1398 | 465 | 441 | 1.10E-41 | [ac:s76138] [pn:hypothetical protein] [or:synechocystis sp.] [sr:pcc 6803, , pcc 6803, [sr:pcc 6803, ] [db:pir] |
| 9848442_c3_18 | 3615 | 7269 | 420 | 139 | 59 | 0.97 | [ac:p00109] [gn:petj] [or:alaria esculenta] [sr:atlantic wakame:badderlocks] [de:cytochrome c6 (soluble cytochrome f) (cytochrome c553)] [sp:p00109] [dbs:swissprot] |
| 9848442_c3_35 | 3616 | 7270 | 420 | 139 | 59 | 0.97 | [ac:p00109] [gn:petj] [or:alaria esculenta] [sr:atlantic wakame:badderlocks] [de:cytochrome c6 (soluble cytochrome f) (cytochrome c553)] [sp:p00109] [dbs:swissprot] |
| 9851582_f1_7 | 3617 | 7271 | 402 | 133 | 102 | 9.00E-06 | [ac:p54940] [gn:yxea:hs74a] [or:bacillus subtilis] [de:hypothetical 13.0 kd protein in idh-deor intergenic region precursor] [sp:p54940] [dbs:swissprot] |
| 9853200_f2_13 | 3618 | 7272 | 1029 | 342 | 120 | 0.00059 | [ac:q49413:q49365] [gn:hmwl:mg312] [or:mycoplasma genitalium] [de:protein 1] |
| 9856_c3_10 | 3619 | 7273 | 306 | 101 | 72 | 0.14 | [ac:i39384] [pn:finger protein htf34] [or:homo sapiens] [sr:, man] [db:pir] |
| 986562_c2_63 | 3620 | 7274 | 939 | 312 | 824 | 2.80E-82 | [ac:f69880] [pn:conserved hypothetical protein ylqf] [gn:ylqf] [or:bacillus subtilis] [db:pir] |
| 9865642_f3_18 | 3621 | 7275 | 186 | 61 | 255 | 5.50E-22 | [ac:q23391] [gn:lacc] [or:lactococcus lactis] [sr:,subsplactis:streptococcus lactis] [ec:2.7.1.—] [de:tagatose-6-phosphate kinase, (phosphotagatokinase)] [sp:q23391] [dbs:swissprot] |
| 9869451_c3_191 | 3622 | 7276 | 225 | 74 | 58 | 0.34 | [ln:hhu63465] [ac:u63465] [pn:dna polymerase] [or:human herpesvirus 6b] [db: genpept-vrl] [de:human herpesvirus 6b dna polymerase gene, partial cds.] [le:<1] [re: |
| 9875217_c1_41 | 3623 | 7277 | 1935 | 644 | 65 | 0.72 | [ac:i45825] [pn:mhc class ii dqa protein] [or:arctocephalus forsteri] [sr:, new zealand fur seal] [db:pir] |

TABLE 2-continued

| Orf | NT Seq ID | AA Seq ID | NT Orf length | AA Orf length | Score | Probability | Description |
|---|---|---|---|---|---|---|---|
| 9875327_f3_8 | 3624 | 7278 | 246 | 81 | 330 | 6.30E-30 | [ln:llu74322] [ac:u74322] [pn:6-phosphogluconate dehydrogenase] [or:lactococcus lactis] [dbgenpept-bct] [ec:1.1.1.44] [de:lactococcus lactis 6-phosphogluconate dehydrogenase gene, complete cds, and potassium transporter homolog gene, partial cds.] [le:898 |
| 987562_c2_53 | 3625 | 7279 | 195 | 64 | 47 | 0.13 | [ln:efas48c] [acy12234] [pn:hypothetical protein] [or:enterococcus faecalis] [dbgenpept-bct] [de:e,faecalis plasmid dna containing gene cluster involved inproduction and immunity to peptide antibiotic as-48.] [nt:orf6] [re:4556] [re:5065] [di:direct] |
| 9882952_f2_19 | 3626 | 7280 | 1053 | 350 | 482 | 4.90E-46 | [ln:tpu56999] [ac:u56999] [pn:pfos/r] [gn:pfos/r] [or:treponema pallidum] [dbgenpept-bct] [de:treponema pallidum methyl-accepting chemotaxis protein (mcp-1) gene, complete cds, and potential regulatory molecule (pfos/r) gene, partial cds.] [nt:potential re |
| 9885183_f2_6 | 3627 | 7281 | 324 | 107 | 82 | 0.0014 | [ac:p14935] [or:methanobacterium thermoautotrophicum] [de:hypothetical 16.7 kd protein] [sp:p14935] [db:swissprot] |
| 988967_c2_52 | 3628 | 7282 | 1452 | 483 | 257 | 1.40E-21 | [ac:p31465] [gn:yicf] [or:escherichia coli] [de:hypothetical 20.4 kd protein in tnab-bglb intergenic region] [sp:p31465] [db:swissprot] |
| 9891250_f3_34 | 3629 | 7283 | 399 | 132 | 72 | 0.16 | [ac:p29606] [or:streptomyces cacaoi] [de:subtilisin inhibitor-like protein-1 (sil-1)] [sp:p29606] [db:swissprot] |
| 9892952_c2_52 | 3630 | 7284 | 903 | 300 | 1460 | 1.10E-149 | [ac:p43452] [gn:atpg] [or:enterococcus faecalis] [sr:;streptococcus faecalis] [ec:3.6.1.34] [de:atp synthase gamma chain,] [sp:p43452] [db:swissprot] |
| 989812_c1_79 | 3631 | 7285 | 420 | 139 | 58 | 0.53 | [ac:d64596] [pn:hypothetical protein hp0612] [or:heliocobacter pylori] [db:pir] |
| 991327_f2_8 | 3632 | 7286 | 516 | 171 | 159 | 8.30E-12 | [ac:p70079] [pn:hypothetical protein yxjil] [gn:yxjil] [or:bacillus subtilis] [db:pir] |
| 991577_c3_15 | 3633 | 7287 | 945 | 314 | 1069 | 3.10E-108 | [ac:q07734:p50981] [gn:oppf] [or:lactococcus lactis:lactococcus lactis sr;subsplactis:streptococcus lactis:subsperemoris:streptococcus cremoris] [de:oligopeptide transport atp-binding protein oppf] [sp:q07734:p50981] [db:swissprot] |
| 991702_f1_2 | 3634 | 7288 | 855 | 284 | 900 | 2.50E-90 | [ac:p96097] [gn:fold] [or:streptococcus thermophilus] [ec:1.5.1.5:3.5.4.9] [de:methenyltetrahydrofolate cyclohydrolase,] [sp:p96050] [db:swissprot] |
| 992182_c1_44 | 3635 | 7289 | 183 | 60 | 48 | 0.34 | [ac:a53810] [pn:cathepsin 1, precursor] [cl:papain] [or:sarcophaga peregrina] [ec:3.4.22.15] [db:pir] |
| 9922035_c1_34 | 3636 | 7290 | 540 | 179 | 388 | 4.50E-36 | [ac:h69997] [pn:conserved hypothetical protein ytoa] [gn:ytoa] [or:bacillus subtilis] [db:pir] |
| 9922155_c2_51 | 3637 | 7291 | 642 | 213 | 543 | 1.70E-52 | [ac:p35880] [or:lactobacillus helveticus] [de:transposase for insertion sequence element is1201] [sp:p35880] [db:swissprot] |
| 9923590_c3_25 | 3638 | 7292 | 438 | 145 | 130 | 9.80E-09 | [ac:c70059] [pn:hypothetical protein ywib] [gn:ywib] [or:bacillus subtilis] [db:pir] |
| 992937_c2_79 | 3639 | 7293 | 1971 | 656 | 202 | 3.50E-18 | [ac:f36891] [pn:transfer complex protein trse] [or:staphylococcus aureus] [db:pir] |
| 9931575_f2_35 | 3640 | 7294 | 1443 | 480 | 210 | 3.70E-14 | [ac:a48664] [pn:toxin synthesis trans-activator atxa] [or:bacillus anthracis] [db:pir] |
| 994013_f3_26 | 3641 | 7295 | 1245 | 414 | 1976 | 2.40E-204 | [ln:ehy 13922] [acy13922:y15222] [gn:ftsz] [or:enterococcus hirae] [db:genpept-bct] [de:enterococcus hirae mrat, pbp3s, mray, murd, murg, ftsq and ftsa genes, mraw, yllc and ftsz partial genes.] [le:10311] [re: |
| 9945936_f1_8 | 3642 | 7296 | 213 | 70 | 55 | 0.58 | [ln:bsz75208] [ac:z75208] [dbgenpept-bct] [de:b. subtilis genomic sequence 89009bp.] [nt:unknown function; putative] [le:66179] [re:66445] [di:direct] |
| 9947760_f3_29 | 3643 | 7297 | 567 | 188 | 186 | 1.10E-14 | [ac:p52080] [or:staphylococcus aureus] [de:hypothetical 16.6 kd protein in atl 5' region (orf3)] [sp:p52080] [db:swissprot] |

TABLE 2-continued

| Orf | NT Seq ID | AA Seq ID | NT Orf length | AA Orf length | Score | Probability | Description |
|---|---|---|---|---|---|---|---|
| 9948302_f3_12 | 3644 | 7298 | 1023 | 340 | 577 | 4.20E-56 | [ln:mty13d12] [ac:z08343] [pn:unknown] [gn:mtcy13d12.11] [or:*mycobacterium tuberculosis*] [db:genpept-bct] [de:*mycobacterium tuberculosis* cosmid scy13d12.] [nt:mtcy13d12.11, len: 328, similar to eg g565054 genes] [le:9349] [re:10335] [di:direct] |
| 9949218_f3_12 | 3645 | 7299 | 1599 | 532 | 635 | 3.00E-62 | [ln:celk11g12] [ac:u23525] [gn:k11g12.4] [or:*caenorhabditis elegans*] [sr: *caenorhabditis elegans* strain=bristol n2] [db:genpept-inv] [de:*caenorhabditis elegans* cosmid k11g12.] [nt:similar to *m. musculus* transport system membrane] [le:17077:17447:17654] [re |
| 995328_c2_5 | 3646 | 7300 | 423 | 141 | 152 | 4.60E-11 | [ac:g69980] [pn:hypothetical protein yrvd] [gn:yrvd] [or:*bacillus subtilis*] [db:pir] |
| 995437_c2_251 | 3647 | 7301 | 813 | 270 | 702 | 6.40E-108 | [ln:ehu42211] [ac:u42211] [pn:psr] [fn:involved in the regulation of penicillin] [or:*enterococcus hirae*] [sr:*enterococcus hirae* strain=atcc 9790] [db:genpept-bct] [de:*enterococcus hirae* psr gene, complete cds.] [le:746] [re:1627] [di:direct] |
| 995450_c2_117 | 3648 | 7302 | 678 | 225 | 105 | 0.011 | [ln:cbp1cntc1] [ac:x66433] [pn:138kda protein associated with bont] [gn:chn-138] [or:*clostridium botulinum*] [db:genpept-bct] [de:*c. botulinum* phage lc gene for botulinum neurotoxin c1 and neurotoxin-associated hemagglutinin.] [le:1819] [re:5401] [di:direct] |
| 9957090_f3_8 | 3649 | 7303 | 666 | 221 | 453 | 5.80E-43 | [ac:s53879] [pn:hypothetical protein 1] [or:*lactococcus lactis* subsp. lactis biovar diacetylactis] [db:pir] |
| 9959767_c1_44 | 3650 | 7304 | 1650 | 549 | 950 | 1.20E-95 | [ac:b69760] [pn:conserved hypothetical protein ycic] [gn:ycic] [or:*bacillus subtilis*] [db:pir] |
| 9962507_c2_57 | 3651 | 7305 | 297 | 98 | 76 | 0.078 | [ac:p31650] [gn:gabt3:gat-3] [or:*mus musculus*] [sr:,mouse] [de:sodium- and chloride-dependent gaba transporter 3 (gat4)] [sp:p31650] [db:swissprot] |
| 9962751_c3_68 | 3652 | 7306 | 510 | 169 | 132 | 6.00E-09 | [ac:i40820] [pn:hypothetical protein 1] [or:*clostridium acetobutylicum*] [db:pir] |
| 9969076_c1_66 | 3653 | 7307 | 207 | 68 | 62 | 0.15 | [ac:p11101] [gn:tnp2] [or:*rattus norvegicus*] [sr:,rat] [de:nuclear transition protein 2 (tp-2)] [sp:p11101] [db:swissprot] |
| 9974030_c1_27 | 3654 | 7308 | 1212 | 403 | 789 | 9.30E-86 | [ac:a69802] [pn:a/g-specific adenine glycosylase homolog yfhq] [gn:yfhq] [or: *bacillus subtilis*] [db:pir] |

SEQUENCE LISTING (7310 sequences)

SEQ ID NO: 1 - DNA (genomic), 294 bp, Enterococcus faecium; double-stranded, circular
  misc_feature (B) LOCATION 1...294
  hypothetical: NO
  anti-sense: NO
gcaatttgttcccggaatactggaatcacactaccgcgagaaccaaggacattcccaaatctgacagctgagaatttcgtacatccttcttcattcaacccagtcacgatcatttcagcgattcgttttgttgaacccatgacgtttggcggattgttggctttatctgtcgagaccatgacgaagtttttaactcttgctgctttggctgcttctgctacattttttgtaccgaaaatattgtttttgactgcttcttttgggttatattccatcaatggtacatgcttatga

SEQ ID NO: 2 - DNA (genomic), 183 bp, Enterococcus faecium; double-stranded, circular
  misc_feature (B) LOCATION 1...183
  hypothetical: NO
  anti-sense: NO
aagagatgttcagccttgagcaataagaagcgattttgtaaaatagcttcccctattttacaaaattgtgccttattgccgatagtctatctcttgaacaccgtttaccaagagattatgaacctgccaattatcgccgagtcacaaggaataatttcagaaaaagctcgtcacgttttatga

SEQ ID NO: 3 - DNA (genomic), 771 bp, Enterococcus faecium; double-stranded, circular
  misc_feature (B) LOCATION 1...771
  hypothetical: NO
  anti-sense: NO
ggagtgtgttcctcaatgcgtaaacctattatcgcaggtaactggaaaatgaacaaaactgcatcagaagcaaaagaatttgctgaagcagtaaaaaacaaaatcccttcaaatgacaaagttgattcagtcatcggatctcctgcattattcttacaagaattaatgacatcagctgaaggtacagaactaaaaatctcagcacaaaactgctactgggaaaactcaggtgcgttcactggtgaaacttcaccagcagctcttgctgatctaggtgttcattatgtgatcatcggacattcagaacgtcgtgaatatttccatgaaacagacgaagacatcaataaaaaagcgaaagctatctttgcaaatggtatgacaccaatcctatgctgtggcgaatctttagaaacctatgaagcaggcaaaactgctgaatggatcgaaggacaaattacagctggtttagctgatctttcagctgaacaagtgtcaaacatggttattgcttatgaaccaatctgggcaatcggtactggtaaatcagctgacgcacaaatcgctgacgaaatttgtggagttgtacgtcaaacagttgaaaaactttatggaaaagaagtatcagaagcagttcgtatccaatacggcggttctgtaaaaccagaaaatattgctgaatacatggcaaaagaaaatgttgacggtgctttagtcggtggcgcaagcttgcaagcagattcattcttgtcattgttagacgctgtaaaataa

SEQ ID NO: 4 - DNA (genomic), 198 bp, Enterococcus faecium; double-stranded, circular
  misc_feature (B) LOCATION 1...198
  hypothetical: NO
  anti-sense: NO
attaatcgttcatcaattcgcactgctttaatcatttttcttcctcctaaaaaaaatcttcctcttcatttactacatgtacctcatcaagaatggtcatctttaattcctgttggcatttatttaccagttcctgaatatcctcctttgttaattccttggttgccaatactatttcgagcagaattggcagattaa

SEQ ID NO: 5 - DNA (genomic), 285 bp, Enterococcus faecium; double-stranded, circular
  misc_feature (B) LOCATION 1...285
  hypothetical: NO
  anti-sense: NO
gaaagacgttcatggatagataaactatcttcccatacatcttgcccaaaaatcgttgccgttccgccgtctttttttataatccctaaaagtgtccgaatcgtcgtggattttccagaaccatttggtccgataaatccaacgacttcacctgaatgtacggtgaaagagacatcttttaaagcttcgaaacgaccaaagctctttttcaaatgtgtgactttgacgatttctgccataaaaaccccactcctttttctaaaaatatatactaaacaagattaa

SEQ ID NO: 6 - DNA (genomic), 192 bp, Enterococcus faecium; double-stranded, circular
  misc_feature (B) LOCATION 1...192
  hypothetical: NO
  anti-sense: NO
tgggccagttcaggattatgtgtgaccatgatcactaatttttctttcgataactcttggatcaattccatgatctggatacttgtttctgtatctaacgctccggttggttcatcgcacaaaaggatatctgggtcattggctagtgctcgagcgatggccactcgctgcatttgtccaccagataactga

SEQ ID NO: 7 - DNA (genomic), 1335 bp, Enterococcus faecium; double-stranded, circular
  misc_feature (B) LOCATION 1...1335
  hypothetical: NO
  anti-sense: NO
tacaatggttcaggattaaataatatagaacgaggtgttcacatgtcatctgtagtagtagtaggtacgcaatggggcgatgaagggaaaggaaaaatcacagactttctcagtgaaaatgctgaagtgattgcacggtaccaaggtggcgacaatgcagggcacacaattaagtttaacggtgtgacttataaactgcatttgattccttctgggattttttataaagacaagatcagtgtgatcggaaacggcgttgtagtcaatcctaaatcattggttaaagaattagcttatttacatgaaaaaggtgtagaaacaagtaatttgcgtatttctgaccgcgcgcacgtaatcttgccttatcatatcaaattggaccaattacaagaagatgctaagggcgaaaataagattggtacaacgattaaaggaatcggacctgcctatatggataaagcagctcgtgtaggtatccgtattgcagacttattagataaagaaatttttgaagaacgtcttcgtttgaatctagatgacaaaaaccgtcaatttgtaaaaatgtttgattcagaaccacttgattttgacgatatttttgaagaatattatgaatacggacaacaaatcaaacaatacgtcacagatacttccgttatcttgaatgatgctttggatgcaggcaaacgcgtgttgtttgaaggcgcacaaggtgtaatgctggatatcgaccagggaacttatccttttgttacttcttctaacccagtagccggtggggtaacaatcggaagcggtgtagggccttcaaaaatcaataaagttgtcggcgtctgcaaagcctatacgtcacgtgtcggtgatggaccatttccaactgaattatttgatgaaacaggagaacaaatccgcgaagtaggacgagaatacggtacgacaactggtcgtccgcgtcgtgtaggctggtttgattctgtagttatgcgccattctaaacgagtttcaggtattaccaacctatctttaaactcgatcgatgtattaagtggattggaaacagtaaaaatttgtacggcttatgaattagatggcgaactaatctaccactatccagcaagcttgaaagagttgaaccgctgcaaaccaatctatgaagaattgccaggctggtcagaagacattacaggatgcaaaacacttgcagaactgccagaaaacgcacgtaactatgtacgtcgtatctcagagcttgttggtgtacgtatctcaacattttctgtcggacctgatagaacacaaacaaacatcttagaaagcgtctgggcgcaaatctaa

SEQ ID NO: 8 - DNA (genomic), 330 bp, Enterococcus faecium; double-stranded, circular
  misc_feature (B) LOCATION 1...330
  hypothetical: NO
  anti-sense: NO
tccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtaa

SEQ ID NO: 9 - DNA (genomic), 330 bp, Enterococcus faecium; double-stranded, circular
  misc_feature (B) LOCATION 1...330
  hypothetical: NO
  anti-sense: NO
tccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtag

SEQ ID NO: 10 - DNA (genomic), 195 bp, Enterococcus faecium; double-stranded, circular
  misc_feature (B) LOCATION 1...195
  hypothetical: NO
  anti-sense: NO
acagtattctcctgccaacacctcggtcacaaggcaatattcataaaacatgaaaagctgttttttaacattattccttgtaactcagagctaaacgggagactcacaacctctttatgctctcaacattttatctgtttttattcttctattgtacttgatttgcgtacaactaactgccagtgcagattatga

SEQ ID NO: 11 - DNA (genomic), 981 bp, Enterococcus faecium; double-stranded, circular
  misc_feature (B) LOCATION 1...981
  hypothetical: NO
  anti-sense: NO
aaatcattctcaattagaaaggtggattggatgcgctacggacgactagtagcattattagttattttaagtagtatttcattgttcatcggagtatcgaatgtacaattgtcagaactgctccagttagatgggcaaagcttacaaatcttgctagtgactcgtttgccacgaacgatttgtttgatccttgtgggagcgaccagtagtatttgtgggttgatcatgcaacatttgacccaaaataaatttgtttcaccaacgactgcgggcacgatggatagtgcgcgtttaggtattttagtggctatgattttcctacctggtgcatccttgattgtccgatccttgacagcattttgctttgcttttgcaggaacattgctttttttatcccttacgcgattgttcctccagaaaaatcaattgatgcttccgttgattggagtcatgttagggaatatcattggttcagttgctactttttttgcttatcaattccagttggtacaaaatatgacttcatggcttcaagggaattttgcgactgtgatacgaggaaattatgagttattgtatgctgttgttccattgttgctcttggtttggctatttgcttaccgatttacgatcattggtctgggcgaatcgtttgcagtaaatctgggaatagattaccagaagatgcagtttttaggcattggcttagtatcattggctagtgcagtcatgttgatcatggtaggaagcattccttttatcggagtgatcattccgaatcttgtctctagaatatatggagatcaagtgcacaaaacaattggcgtaactgctttagcaggtagtttgttcttagtattttgcgatcttgtcgctcgcgtgttgatttttccttatgaaataccagtcagtgtgatcgttggaatcatcggtggggctatcttcctttatcttctgataaggggacgacgatatgcttaa

SEQ ID NO: 12 - DNA (genomic), 855 bp, Enterococcus faecium; double-stranded, circular
  misc_feature (B) LOCATION 1...855
  hypothetical: NO
  anti-sense: NO
ataagcctctcgcaaaacggcgggcggctttttttattgcaaagagaacgcttaagaagaagttatgaaagaaactatggtaaaactgaggcgaaagaggtgagacgagtgagacaattaccaaaacccctttatgcaaaacatggaaagcgagcggttttgctgcttcacgcttactcaggaagtccaaacgatgttcgaatgctcgcacgatttttggaaaaagcagattatacagtttatgcgccgctttttaaaggacacggaacaatggagccatatgatattttgcaagaaaaagcagaaagctggtgggcagacactaaaaaagccatccattttttacagtctgagcagttttctgatattgccgtattaggattatcaatgggcggcatctttgctgtacgagcactagaagaagaatcagtgattggcggcggttttttctgttcgcctttgtctcctgtaaaaacaaacgtgcctgaaaactttgaaaaatacgtacgtcaagtgctgaagacagcaggtaaatcagagaaagaaatcaatgaaaaagcagttgcttaccgctcgttagctgaacaacaattaatggatatacaagatcaggcagcaatcgtagaaagtaggttgtcagatatccaacagccgatatttttagctcaagctgggaaagatgaaatgatcgaccctaatggcgtatttgaaactgcacgcaagttgagccgtcagcgagtgacacttcgatggtatcctgaaagtggtcatgtgattacagttggtacagcaagacgcgaattagaaaaagacgtcttggaatttttagaaaaattaccttggaatgaggaataa

SEQ ID NO: 13 - DNA (genomic), 630 bp, Enterococcus faecium; double-stranded, circular
  misc_feature (B) LOCATION 1...630
  hypothetical: NO
  anti-sense: NO
tattttatctcgattgaaaaacgccggagtgattgcggtggttcgccgaaaaagcaaagaagaactttgaatgcttgccacgcaatcatcaaaggtggtctaactggtattgagttgacttttacagtccctcaagcagatcaagtaatcaaagaacttttgtcattctacaaagaccaaccagaaatagtgattggcgcaggcacagtattagacgctgtcacagctcgcttggctatcttagctggcgcagagtatattgttagcccttcctttgatcaagaaacggcagagatgtgcaatctgtatcaaattccttacttaccaggatgtatgactattaccgagatcaaaacagcgctgaaaagcggggtagatatcgtcaaactatttcctggaagcgcttatggaccaagtatcatttctgccttcaaggcgccgatgcctcaagtcaatatcatgccaactggcggtgtgagtctggacaatatgaaagagtggttcgatgctggtgtcgtaacagtcggagtaggtgggaaccttttagcacccgcagctacaggagattttgacaaagtaacggaagtcgcgcaacagtatgcagcaaaaatgaaagaaatcaagaggtag

SEQ ID NO: 14 - DNA (genomic), 258 bp, Enterococcus faecium; double-stranded, circular
  misc_feature (B) LOCATION 1...258
  hypothetical: NO
  anti-sense: NO
aatcatatctcaagaacgaccgttatttgcatttcattcataaatggtgtattttgtatcataatcgtcaaaaaagaggtcgtgacgatgtcacgacctcttgataaacgatgttccagaagtaacttcttcggaaataagccgaaatttcacaaaaatttgagaaataattttcgtaaatctcttcttattcttgatgcagaacagctttttctctctaatactcagatcaaaacactgatttcacaacctctttaa

SEQ ID NO: 15 - DNA (genomic), 261 bp, Enterococcus faecium; double-stranded, circular
  misc_feature (B) LOCATION 1...261
  hypothetical: NO
  anti-sense: NO
atcaaaatctccgctccgtcagtcgttgtgatccctacagcatgtccagttggaaaaatagtcgtgatctctccgtctgcaggtgcaactagttctcctacttctggatcaatagcgataccttttcccatcacgccagaagaaaaaacttggtctggtacttcactcaatggcagtactttacccgttaaaggactttttaaggtatgccgtgctgaagtaatcggttctcctgcattcgcatgtttgttttctaattga

SEQ ID NO: 16 - DNA (genomic), 1053 bp, Enterococcus faecium; double-stranded, circular
  misc_feature (B) LOCATION 1...1053
  hypothetical: NO
  anti-sense: NO
acattttcctctaggaaaaaattaactagcaccacgggtaatgaattaatcaaatttaaattagaaccaggcgattttatcatgagtggcgctggaacaattgggagaatttcaagagtaccaaagcaaataaaaccgggtgtattcaatcaggctttgattagacttagaataaataaagaaatcacagattcagaatattttattcaatttattcgtgcagattttatgcaaagaaaactcacaggagctaatccaggttcagcaattacaaatctcgtaccaatgtcagaagtgaaaaaatggatagtacaatttccaatattagaagaacaaaagaaaattgggaacttcttcaaacaactggacgacactatcgctcttcaacaacgtaagctagatttattaaaggaaacgaaaaaaggattcttacaaaaaatgttccctaaaaacggagcaaaagtgccagaaattcggtttcctggatttacggaagattgggaacagcgtaagttcaaagagtttagtaagaagactggaaaaaagaacacgaaagatttagacttccctgcctattcggtaagtaataaagcaggtttaatttctcaaacagaacagtttgatggtagtaggttggatgatttagaaaaaacaaattataaattcgttgaaccaaatgaattcgcctataatccagcaagagtaaacgtaggatcaattgcatttaacaatcttggtatgacggtcattgttagctctctttatgtagttgtgaaaatgagcgaggacttagataatgagttcatacttcagtttatcaagtcaccaacatttatcaaagaggtcaagcgcaacactgaaggaagcgtacgagaatacttattctatgagaatttcgctaatatcaagtttccttttactaggaataaagaggaacaacaaaaaatcggcgctttcttcaaacaactcgacgacacgatcgctcttcatcaacgtaagttagatttgctgaaggaaacgaaaaaaggcttcttacaaaagatgtttgtttag

SEQ ID NO: 17 - DNA (genomic), 849 bp, Enterococcus faecium; double-stranded, circular
  misc_feature (B) LOCATION 1...849
  hypothetical: NO
  anti-sense: NO
acattttcctctaggaaaaaattaactagcaccacgggttatatcattattttttatacccgtttttctggtgaaacacctgatgtcttagctttgaatacgagttttttcattctatatctgtgtgttggcctgatcatcttggtttattattggaaaatctctaataagaaattagctgatcagttattagagcaacaagtcaggatgcaacaggattatatcaaagatctagaaaaaaactatcaagacttgagagaattcaaacatgattaccaaaatctgcttttttctcttcacagctatatttcagaaggcgacttagaaggattacggtcttattatgatcaaacgatattacctacacgccagatgatgaacctttttccggccaatctaagtatgttggataatatgaaagttcctgagatccgtagtttactgtcattaaaactcatgatggcacaggaaaaagggttgatcgtccagcttcattttcctgagccaatcgaactggatacgaaacatacggtaaaccttgtacgtatgcttggtattatcttggacaatgcgattgaaggagctagtgctgcaaagaagaaaaaaatcgaattgaccatactcaagaagaatcattccgtgatgattcgtgtgatcaatacaacaacaaatacattaccgttaaaccagttgaaacaaaaagggttctcaacaaaaacaaatccaaaaaacgaaggccttggcttgtttatcttggatgaattgacaaagaccaatccttatcttttccttgaaacatcaattgaaaaccagcgtttttctcaaacgatttatatacaaataaaataa

SEQ ID NO: 18 - DNA (genomic), 1410 bp, Enterococcus faecium; double-stranded, circular
  misc_feature (B) LOCATION 1...1410
  hypothetical: NO
  anti-sense: NO
aatcgttcctctctctgtttcttttctctttgtcatacttttatttttcttatgtgttctatttgttataataaaagagaaatgggggaattgttgatgacgattgaagaagcaatagaatggatccatagtcgattaccatttggttcacgtcctggccttgaccgagtcgaagctttattagaagtggtagggcatccagagagaaaagtaaaaacgatccatatcgctggaacaaacggaaaaggttctactgtagcttatttgagaagcctattagaagaggctgggctgacagtaggtacatttacttcaccttatatcgaaacgttcaatgaacggatcgcaatcaatggcaaaagcattccagacaatgatttgatccagcttgtaaaaaaatatcagccactgatcaaacaacttgatcaatttgaagcagtagctggtattactgaattcgagacattaacagcaatggcatttgattattttttgatgaagaaagtggacgtagcgattatcgaagttggcttaggcggcttattggattctaccaatgtagctgtaccaatgctgacgggaataacaacgattggacttgatcataccgaaatacttggagatacaattgaagaaatcgctgcacaaaaagctggaatcatcaaacaaggcgttccagtagtaacaggaaatattgccccagaagcttttactgtcatccaacaaacagctaaagcaaaaaatgcaccgctttatgtatacggggaaaattataaaataaactatctgcatcctgatgagatgtggggagaagtatttgaattttttaatgaaataggaaagatccctcaattaaccactccgcttttagggcaacatcaagctgaaaatgcaggagtagccatcgaattgtattttgtttactgtcaattggaaaagctgcctttccgagaaaaagatgttttgaagggattgaagaaatctcgatggccaggaagaatggagcgtttgagtaacgagccattagttgttttagatggtgcccataatacgcatgcaatgaaccggcttgttgagaatttgaaaaaagaattcaaaggatatcaaatcaacattttgttttccgccttacgaactaaaaatgttagagaaatgctagaacgattgcagcaagtaccaaatgtccatatttatttgacgacctttgaacatccaaaagccatcgaattaagtgaagtatcagatttagcaagtgagagagtatcaatcgtttcattgtggcaattcggattagcagatatattggaaaagatgacaaatgaagacgtattagttgtgaccggttcactttatttcatttcagaagttcgccatttattaatacaattaggaggagatcatgaagtataa

SEQ ID NO: 19 - DNA (genomic), 1200 bp, Enterococcus faecium; double-stranded, circular
  misc_feature (B) LOCATION 1...1200
  hypothetical: NO
  anti-sense: NO
actgcctcctccaaccgcccccacggcttgctacactatggagggaaaactattatggcaacattcaagcaatatgaaactaaaaaaggtaaattttggctctatgaagcctatcttggaatgaacaaaatgactggcaaacctgataaggttcgtagacgaggttacaaaacaaaaaaagaagcccagcttgccttgtcacgcttgcaagtggactacgataaaaacggtattaaaaaagcgaacaacgaaacgtttaaagaagtttatgacttgtggctagaaacatataaaaccactgtccgagaagccaccttcatgaaaactgaaatcaagtttagaaagtggattcttccaaaatatggaaatcttcgtgtgaatgaagtcacggtaaaaaaagcccaacaaattgtaaatagctgggctgaaactactgaccaatacaaggtacttcattcaacttctaagcgtatttttagctacgctatcaatcttgggattattgagactaatccactagacaacgtattaatgcctaaaagaaccaccactaagcataaagaaaaggtcaaagtttacagtaaagaacaactgatcaccttgtttgattacctaaacagcaaacctgaaacttatcgaaacgactttgataaaacgttactacgctttctcttttatagcggggttaggatcagtgaagcccttgcattgaattggtcagacattgattttcaagaaaatacggtcaccatcaataaaacactaagccaatccaaaaatggctataaaatcagtgatcctaaaactgattgtagtgctggggttcttccactagatgaaagaacaatttctatattaaaaaaatggcagattaatcagcggaaatatatgctgacacttggtgtaactgatccgactatgattttttgtggtatctataaagaactaatcacacaccacgctatttatgcaagattgattactatttgtgaaaaagctatggttccatttctcggtgtgcatgtagcaagacacactcatgcttcaatgctcttggacgctggagctactatggtagaagttcaaactagattacggcatacaaaaattagtcagacgatcgattgttacggtcacttggcaaaagaaacgaaagaaaagactgttgaaaaattagtacaacacttaaatattgactag

SEQ ID NO: 20 - DNA (genomic), 672 bp, Enterococcus faecium; double-stranded, circular
  misc_feature (B) LOCATION 1...672
  hypothetical: NO
  anti-sense: NO
catgtatcctcacacttggtcaaaagaaagattcctttaggagaaagaagtcagcatagcagtcttatggcagctgctatcggtacaggactgctttggtttggctggttcggttttaattccggtggtgcacttcgagcagatgaacaagcagtcaatgcatttggttcaacattcatcgctcttgcatttgcgatgattacttggctgatcattgcaaaagtaaaaggaaatggctttgattttgtcgacgtactaacaggatccgttgctggattggcagccattacgccttgtgccggttatgtagaagcaaaaagtgccatgctgattgggatcattgcgggtatcgtctgtcatgctgctgttgattttcgtaaaaagaaacaatgggatgatgcacttgatgtgtggggtgttcatggcatgggcggattcacaggtacgattctgatagggatctttgcatctaacagccatttactaacgaatccaagcagctggtacttcttagggattcaagtgattggtgtcatcattactgccgtgtatgcctatgtgctgacaacagtgattttaaaatcggcgatgcactttacaacgatcactactacaaaagaagaacaagaagaaggattggactttttcttctttggcaacaaactcaattga

SEQ ID NO: 21 - DNA (genomic), 696 bp, Enterococcus faecium; double-stranded, circular
  misc_feature (B) LOCATION 1...696
  hypothetical: NO
  anti-sense: NO
ggtttcccctcaacacacgttctcacacatttattaggagggaaaacaatgaacctcattttaatggggctgccaggcgcaggtaaaggaacacaagctgaaaaaatcattgatgcttatggtattccgcacatctcaacaggagatatgttccgcgcagcgatgcaaaacgaaacagctcttggcctggaagcaaagtcttatatggataaaggtgcattagttcctgatgaagtaacaaatggaatcgtgaaagagcgactagctgaaccagatacagagaaaggcttcttattagatggctttccacgtacgctagatcaagcaaaagctctggacgcaatgctaaaagatttgaataaaaaaattgatgctgtcatcgatatccatgttggtgaagaaatcttggtcgaacgtctagccggccgatttatctgcagcaattgtggagcaacttaccataaaattttcaaccctacaaaagttgaagacacatgtgatcgttgcggtgggcatgaattctatcaaagagaagatgataaacctgagacggttaaaaatcgtctggctatcaacatcaaaaatagtgaaccaatcttggcttattataaagaacaaggtttgctaaacactattgatggtgctcgtgaaatcgatgctgtatttgcagatgtacaaaaaatcattgaaaaatag

SEQ ID NO: 22 - DNA (genomic), 273 bp, Enterococcus faecium; double-stranded, circular
  misc_feature (B) LOCATION 1...273
  hypothetical: NO
  anti-sense: NO
aataaagcctccgtgtctctcatagaaactgtcaagccgaaatcaatagcagctccttgccatcctctccaagcatatggaccaactggcatcgtccctcgcgaaggtttcagcccaatcaatccgcaaaacgaagcgggtattctaatagaaccaccgccatcactagcaccagctaaaggaacgattcctgatgaaactgcagcagcagctcctccacttgatccgcccggtgtacattcaaggttccaagggtttcttgctgggccatag

SEQ ID NO: 23 - DNA (genomic), 1986 bp, Enterococcus faecium; double-stranded, circular
  misc_feature (B) LOCATION 1...1986
  hypothetical: NO
  anti-sense: NO
gagagagcctcccgacactttgagcttgtctcgaaataccaaccggctggtgatcagcctgaagcgattaaccaattagtggatggcgtagtcggcgggaaaaaagcacaaatcttattaggtgcgactggaacagggaaaacatatacgatttccaatcttattgagaaagtgaataaaccaacactgattattgcccataacaaaacattggctggtcagctgtacggggaattcaaggaatttttccctaacaatgctgttgaatattttgtttcttattatgattattatcagcctgaagcttatgtgccttcaagcgatacgtatatcgaaaaagattcaagtgtaaatgatgagatcgacaaattacgacattcggctactagttcattattagaaagaaatgatgtgatcgtcattgcatccgtttcatgtatttttggattaggctcgccttttgagtaccaaaaacaagtagtttcgattcgacagggagcagaactagatcgcaatcagttgattcgtgacttagtcagtatccaattcgaaagaaatgatatagattttcagcgcggtcgttttcgagtgcgcggtgatgtcgtggagatttttccggcttcaagagatgaacgtgccttacgtgtggagttttttggagatgaggtcgaacgtatccgagaagtcaatgcactgacaggtgaagttttaggagaaacggaacacgtagcaatcttcccggcgactcactttgtgacgaatgatgaacatatggagcatgccgtagcgaatatcaaagcggaattagaacagcgtttaactgtcttgcgaaatgaaaacaaacttctggaagctcaacgtttagaacagcgaaccaattacgatattgaaatgatgttagaaatgggctacacgtcgggaattgaaaattattctcggcatatggacggacgtaaagaaggtgaaccgccttatacgctattggatttctttcctgaagattttttgatcgtggcggacgaatcgcacgtaaccatgcctcaaatcagaggaatgtataatggtgaccgagcgagaaaacagatgctagtagattacggtttccgtttgccatctgctttagacaatcggccacttcggttagaagagtttgaaaaacatgtcaatcagatcatttatgtctctgcgacgccaggaccatatgaacatgaacaaacagataccgttatccaacaaatcatccgtccgacagggctgcttgacccagtgatcgaagttcgtccaatcatgggacaaatcgatgatctagtaggcgaaataaatgaacgagtcgaaaaagaccagcgggtgtttgtaacgacattgacgaaaaaaatggcagaagaactcacagattatttcaaagaattagggatcaaagtcaaatatttgcatagtgatatcaaaacgctggaacgaacagaaatcattcgagatcttcgattaggtgaatttgatgtgttagttggaatcaatttgcttcgtgaaggattagacgtacctgaagtttcccttgttgctatcttggatgcggataaagaaggctttttacgtagtgaacgttccttagtccaaacgattggacgagctgctcggaatgaagaaggtaaagtaatcatgtacgcagacaaagtaacagattctatgcgtctagcgatggatgaaacgtcaagacgtcgtacgattcagcagaagtacaatgaagaacatgggatcgttccaaaaacgatcattaaagaaatccgagatttgatttctattacgaaagaatcggaagatgatacaaaagaagcggtacaagtctcgtacgaagaaatgacgaaggaagaaaaagacacgttattgatgaaattagaaaaagaaatgaaagatgcggcaaaagctttggattttgaaacagccgcgaatgtgcgagatatgattttagaattaaaagcttcaaagtag

SEQ ID NO: 24 - DNA (genomic), 1569 bp, Enterococcus faecium; double-stranded, circular
  misc_feature (B) LOCATION 1...1569
  hypothetical: NO
  anti-sense: NO
aaaggagcctctttcatgcaaactcaagaagcgattaaaacgtttctcttgaagaaaaaaagcaatacaaaattagatatttttcttttcctatctgaacatcgtttctttattactacacaatatttagcagatcatttccatatgtctgaatcaaattttttactatacatcaaagaattagaacaagactttgagcgtctcaatctaacagaactgcatattgataagcaaaaaccttttttaaagttgaattttgaaggaattgatccggcttactgctattatcgtctatttggaagatactgcaacgaatcagtcagttatcagatcttgacttctttgttcagctgtcagacaaattcgattatcagtttaagtcagcaaacaaactatagtgcctcttatttgtatacgaaaatgaaaaagattaatgcatttttagcattgtacggtttgtctatctccttttctaataatggcagaaagtctttttctggaaaagaggtacaaattcaatatgcagcattagatatttattggaacatcttttcaagtactgctacagaattttatgatgaagatccgcaagtagtggcttttatgatgaatactttttttaaaaaagaagtacttgaccgactaaatagcggtatgatagataaattatattttctattaaaaatatgtaaagagaattttcctgcaacttctgtgaaagacgtacaaaaagaattcacagagtatgaatatattgacttttttattgatccctctgtagatattttgcgacctaatctgccaatttgtcgcgaacaacgcatcttagtgaatattttagctcgactttctatcacgaaaatcgaatcggaagaaacaagcttggagcaatacaaacttttaaaaaaagcaaacgttcctcatgttctttattcaagagaaatggtggagtccttttgtactgtatttgatttgtttatacctgaaaaagaaaagattctttactcattggcattcgcacgaaataaactttataatggatttcttaacttcaatcaaccaaatacgccccttcctactttcatgctttatcaagaacatagcgtgttgaaagaagtccaaaccgccattgaacaattttatatggatttcagagaacaaaatcaacacttgttaccagttattttagaaaaggaaaatgtgcaatggatggttgaagacctagtacatttgtatgatcgctacaaaaaacagccgcgaattgtgattggtgtgaactatacgcgtgatttttatatcagtaaagatctgatcgttaagatagaacaaattttttcaaatgaatcgatcaaaatacaaaatgattttatggagaactgcaacatcgttatcagcgactgccctttgaaacaattgccttctcatatcaaaaaaatctatattttaaaaggaatcatcacaccagaagactggaaaaaagtgattatgaggatctcagaatatatctttgaattaaaagaagaagcactcatggatcaatcgaaaaaagaaaatcaagttacttcctag

SEQ ID NO: 25 - DNA (genomic), 1488 bp, Enterococcus faecium; double-stranded, circular
  misc_feature (B) LOCATION 1...1488
  hypothetical: NO
  anti-sense: NO
ggcccggcctcgcatcanaatcttacaactgaaatccaactattgaatgaaaaggtcaattatttaaccaacaaattatttggacgctctaaagagactctctttgaggaaacgaatgggcaattgaatctttttagtgatgaagaaatttctgtaagtgttccagaagcagctgccaccattattccagtaaaaggacatcaacgagttgtaggaacgaaagcagacaaaatcaaacacttacctataacagagaaagaacatctccttcctttggaagaacaattttgtgaacattgcggttcacagatgaaagatatcggacggacaaaagtacgagaagaaattcgtttccatcaggctatgttggattgtctcacccattatcaacatacctattgttgtaaaagctgcgaaaaagaaggactttcttcttttaaaaaagcgatcgttcctaaacctttgatttctaatagcttaggttccaatagtttagtggcggaaacgatccggatgaaatttggtcagaaagttcctgcctatcggcaagagaactattggaaacaaacacatgggttggatatttcgagagataatatcaccaattggcatattaaagcagtgcaaaacgcgttagaccctttaggagaacgattaagagtctatcttaatcaagaagagattctacacggggatgaaacaagttatcgtgtgattgaaagtgccaaaacagatacctattactggcagttttgtacaggaaaagacagtcagcatcccatcgtttattatcaccacgacgaaagtcgtgctggagatgttccgaaaacttttctcaaggagtttacagggtatttacactgtgacggctatagcgggtataatgccgtggaaagtgtacgacttgtctattgtttcgcgcatgttcggcggaaatttttcgaagcaattccaaaaggaaagaaaaacacggatattcccgcagctcaagcagtcaaacaattggataaatggtttgtcctagaaaagaaatggaaagacttttctcctgagaagcgattaagctgtcggcaacaagaactgcgtccattatttattgctttttatgagtggatggcaacgatagatcctgttgcaaaatccaagttggatgcagccgttcaatatgcgtgtaaactacgaagtggttttgaacctatttttgaagatggtcgtttagaactcacaaataatcgtgcggagcgaaatatcaaagagctggtgataggacggaaaaattggttgcattccacaagtcttgaaggagcacgaacttcaggaatcattctgagtgtatataaaacagcagaacttaacggattgaatcctgtaaagtatctagagtttctatttgataagataccaaatcttcccgtactttcagcagaaactttagatcaactgttgccttggaacaaggatgtacaacaacatttttctcgtaactaa

SEQ ID NO: 26 - DNA (genomic), 198 bp, Enterococcus faecium; double-stranded, circular
  misc_feature (B) LOCATION 1...198
  hypothetical: NO
  anti-sense: NO
ccagaatactcaggattgaatcctgatcctagttctagcaaagctgagatttttccttcgatttccatcgtgccggatgttggtgtcagtactcccgtaatgattttcaacattgtagattttcccgatccgttttctcccacgaaaccgatcatctcacctttttttatttctacattcacgtttttcaacgcataa

SEQ ID NO: 27 - DNA (genomic), 270 bp, Enterococcus faecium; double-stranded, circular
  misc_feature (B) LOCATION 1...270
  hypothetical: NO
  anti-sense: NO
cgcagtcactcantagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 28 - DNA (genomic), 708 bp, Enterococcus faecium; double-stranded, circular
  misc_feature (B) LOCATION 1...708
  hypothetical: NO
  anti-sense: NO
gtgcttaactcaaaggcctacattccccaaagccgggagcggatattccttatcggacattctcgagacgcatgtaccgaacaagtatttcctatcattggaccgtcttcaacatctgatcaaaacatcagaaatttggtaaatatcaatccttccaatcgaggaatgggtggacaagtctatggttcagatggcgtagcgccaaccttaacaggtgatgaaggaatcaaaatcgcactgccagcaagggatggaatctctgtagcaggactattaccgggaaagtttgaacaaggtaatcgagtttatgaagttactggaaccgcccccaccttgtcaacgaaacaaggtggtacaaaaatcatgattcgaaaaaatgaaacagaatatcaagaggtgaagccagaagacagtgtgaatctggcttttcctaattccacaagtcgccgaggtcgtctgggaaaacagagtgttcataccttactaacaggagaccaacaagcgatcgtcacggatcagtatcaaattcggaagctaacacctagagagtgttggcgacttcagggctttcccgattgggcttttgatcgagattctcaagtcaattcagatagtcagttgtataagcaagccggaaactctgtaacagttccggtcatttttgatattgccagaagattaaaagagttggatgtacatggtttatga

SEQ ID NO: 29 - DNA (genomic), 1071 bp, Enterococcus faecium; double-stranded, circular
  misc_feature (B) LOCATION 1...1071
  hypothetical: NO
  anti-sense: NO
cagaattgctcgtctcttattgttaaaagaaaggaaacccatatgaaaaaaacatcactgctgtttgcagcaagttcgcttagcctaggtctgctaggtctaagcggctgcggaaataattctagtgtggcaactgtcgcagatgcagatgtaaatgagatagttaccttgcgctttgcttatgcaagcaacagccagccagtaattgatgcaatgaatgaatttgggcgtttagtaaaagaaaaaacagatggttccgtacagatccagtatttcccagatggacaactgggtggagaacgtgaactgatcgaattgacacagtcaggagcagtagatttcacaaaagtaagtgcttcagcgttggaaagtttctctaaagattattcgattttttcagttccttatctattcaatgatgaagaacatttctttaaggtgatggataatgaagaaataatggagccaatctaccaatggaccaaaaatttaggatttaccggattgacctattatgattctggtcagcgcagcttttatatggtagacggtccgatccatacgccggaagatttggagggaaagaagatccgtgtgatgcaaagcgaaaccgctatcaaaatggtagagcttttaggcggttcgcccgtacctatgggaagtgatgaagtgtacacgtctcttcaatccaatttgatcaacggatcagaaaacaatgaatttgtcttgtatacagctggacatggtggtgtggctaaatactattcctatgatgagcatacacgtgtgccagatatcatcatcatgaatgatgccatcaaagaacagctaactgatgagcaggaaaaagccattgaagaagcagcgaaagaatcaacggtttttgaaattgaagcttttgcaaaagcaattgaagaagaaaaagctttagcacaagaagaacatggagtccaattcaatgatgtagataatacaccgtttcgagaggcagttgccccacttcatgatatattcaaaaacgatcctacctacaaagacctttatcaaaagatccaagagcaaggagcgtag

SEQ ID NO: 30 - DNA (genomic), 1068 bp, Enterococcus faecium; double-stranded, circular
  misc_feature (B) LOCATION 1...1068
  hypothetical: NO
  anti-sense: NO
aagttctgctctaggctttatactcgtagtctttggctctttgatagcagcagtagttttaggttaccatttataccggaaagattatacaaattaaagaatctatttaaaacaggtatcaaacaaagaaatttgttttggcaatacaatttaaaaactaggaggaatacagcaatgacagaaccaaaattaatcgacccgcgaaacttgtaccatacggagaaatttcctaaacaagatcaggatacaccagctttacagcagaatatgattcctgttcctgattgtggagaagaatcctatgaaggcaataatcaactagaaaaccgccgtgtactaatcactggtggagattcagggatcggtcgtgcagcagcgattgcatttgctagagaaggggcagatatcgctcttcaattcttcccaggagaagaaaaagatgcagaggaagtagcaaaatacgtgaaagatgcaggacgtaagattgtcttactaccttttgatcttcgtgacgaacaagcacctaaagaaatcatagataaagccgtgagtgaacttggcgggctagatacgatggtactaaacgcaggacagcaaatttcttgtcagtctattgctgagttaccacttgagcaagtcaaagacacatttatgataaacatcatcgctatgtttgctttagtgaaagaagctgttccgcatatcccagcaggaggagcaatcgtaacaacaacttctgttcaagcattcaatccaagcgaacatttattagattacgcagcaacaaaagcttcaatcgctaactttacgatcggtttagcaaaacagcttgcacctaaaggaatccgtgtaaatggtgtagcacctggtccaatctggacacaattacaactagacgaaggacaaccttctgattcgatccctgaatttggtcagcaaagtttactagaacgtgcaggtcagccaggagaattagcaccagtttatgttttcttagcatcgaataaagcaagttatgttacagcccaaatttacggagtaactggtggagaagcgatcaacttataa

SEQ ID NO: 31 - DNA (genomic), 219 bp, Enterococcus faecium; double-stranded, circular
  misc_feature (B) LOCATION 1...219
  hypothetical: NO
  anti-sense: NO
gcatatcgctcttgttcgagagggttaattccggggcgcgtcnacagctctagagatccgcctacctgtcacgagttgcgcagtttgtctggaagactctatgagaagcaaatgagcgataagtgtgctcaacatcttctcgggcataagtcggacaccatggcatcacagtatcgtgatgacagaggcagggagtgggacaaaattgaaatcaaataa

SEQ ID NO: 32 - DNA (genomic), 273 bp, Enterococcus faecium; double-stranded, circular
  misc_feature (B) LOCATION 1...273
  hypothetical: NO
  anti-sense: NO
gatatgcgattagataaatttttaaaaatttcccgaatcatcaaaagacgatcagtagcaaaagaagtagctgataaaggaagaattcaaatcaacggtaaattggcgaaatcttccagtgatgtcaaagtaggcgatattttgaaagtccagtttggcaacaaaacgttggaagtgaaaattacggaattacatgaatcaaccaaaaaagaagatgcacaaaaaatgtacgaaattatttctgaaaatcgcacagaaacactagagaaatag

SEQ ID NO: 33 - DNA (genomic), 1056 bp, Enterococcus faecium; double-stranded, circular
  misc_feature (B) LOCATION 1...1056
  hypothetical: NO
  anti-sense: NO
tcaagacgctcgtcttggactggttcggaaacttcccagaataaaaaactaagtatctctaaagaaaggagattggaaataatgcgaaaagtaattattgattgcgatccagggatcgacgacactttagctttatcattagctgtcaaatcccctgatatcgaagtagttgctattaccgtagtttgtgggaatgtccctgcagatataggtacgcagaatgtgctgaaatgcctggaacgctgtgatcgtttagacattcctgtttatcaaggaatggaaaaacctttgaagcaacctttcatcagtgcacaagacactcatggtatggatggtttaggggaaacaaatttcccgatgatcttgagaaaacaggcagaacctctccatgccgttgattttttggctgattatttcaaagaaaagacaaatacatcagtcattgctttgggtcctttgaccaatatcgcttttgctttgaaagtcaacccaaatattgggaaacatatggatcgttttgtctcgatgggtggaacttacaaaagccatggtaactgttcgccagttgctgaatacaattactggtgtgatcctgaagcagcttcttatgtattcgagaatctcaaacaaacgatagaaatggttgggttagatgtgacaagagaaatcgtcttgacaccgactatcctcgaatactgctgtcaaatgaatcctgaagagggagagtatctaaaagcgatcactcgtttttattttgacttccactggaaacaagaaagaattttaggatgtgtcatcaatgatccgttagctgttgcttattttatcgagggggccatctgtgaaggtttcaaaagcttcactgctgtggaaactcaaggaataagtcgtggacaaacattggttgatcgttatgaattttggcagaaacctgctaacagtaaaattatgacaaaagtagatactcgtctttttttccgaaagtttttaaccgttcttttaaatgcacaagaagaaacgattatgaaagatttggaaaggttaaagatgggctaa

SEQ ID NO: 34 - DNA (genomic), 543 bp, Enterococcus faecium; double-stranded, circular
  misc_feature (B) LOCATION 1...543
  hypothetical: NO
  anti-sense: NO
atatatagctcagcttctggtaaagattcttttattgcttttaggcgatcttctcggcgtgcagctataactagtttagcccctttttctgctaatagcttcgttgttgcttcaccgattccgcttgaagcgcccatgatgacaatcactttttctgataaatcattcattctattctcctcctgttttgaaaaatctcttgcttatactcactatctcttatttcatcttactgttcaaataatccgttcgacaggtttgacgattttggcagggattcctgcaacgatggtattgtctgggacatctttcgtaacagttgcattcgctgcaacaatggcattctcgccaatcgttacgcctggcagaatagttgctcctgctccgatccaagcatttttcttgatgtggattggctttactgacaagcctcttcgttcttttggatcggttagatggttcaccgtgatgaggttgacacgaggaccaatcaatactgaatcttctaaacagatgccacctaagtcaacgaacatcacttga

SEQ ID NO: 35 - DNA (genomic), 282 bp, Enterococcus faecium; double-stranded, circular
  misc_feature (B) LOCATION 1...282
  hypothetical: NO
  anti-sense: NO
ttgggaagctctttgatgagtaactatacagtcgcaatcaaaaactctgcgaaagtggatttaagaaaaatcaagcaaacgaatttaaagaaacaatttgaagaagtgattcagacattgaaggaagatccatatatgcccacgcagtcttttgaaaagctgagacctacacatgaaggcagatactcacgcaggctgaatagacagcatcgagtggtttacaaagttgatgaggaaaataaagttgtagaaatttattctgcctggacacattatgagtga

SEQ ID NO: 36 - DNA (genomic), 237 bp, Enterococcus faecium; double-stranded, circular
  misc_feature (B) LOCATION 1...237
  hypothetical: NO
  anti-sense: NO
acggtaggctcacgacctcttggtaaatggtgttcaagagacagcctatcggcaataagaagcaattttgtcatcgctcaaggccgaacgtctctttcacaccctctgttgtttcataaaatagttttattcgctgtaaaggtcgcgaactggtgtcatgatgatacggttcaagtcattgatgattgtactgaagccttgctctttttgcatcaagtcattgattacttcttctga

SEQ ID NO: 37 - DNA (genomic), 222 bp, Enterococcus faecium; double-stranded, circular
  misc_feature (B) LOCATION 1...222
  hypothetical: NO
  anti-sense: NO
atgcgtagattggtcgatcaaacaactgataatctgattttccaagttccattgtttcgcctctttccgttatcttttgtattctacctgaattttgcgatatggacaaatagaggttgtgaaaaagctgttctgcatcaagtcataagaacagccaaacaaaaaactgcgatgagcatcaccgcagttttattgaacttaaggttgattgatcacatctaa

SEQ ID NO: 38 - DNA (genomic), 1278 bp, Enterococcus faecium; double-stranded, circular
  misc_feature (B) LOCATION 1...1278
  hypothetical: NO
  anti-sense: NO
gagataagattgaagaagcaactggtggtgaaaaagtcattcaaaccgtttggggagtgggctataaaattgacgcaagatagtaaacgagcaactgaaaaacgccgtcggatcaatttgacttcaaaagaaatcagcgaattgttagcggaaggaatcatcacgattatccttttgcttctattaaatgtttctattctggttgttatcagttcggtgatcaacagttcaccttctttgacgaatgcgatttgggattcaaagaatatttttgcagaacgattgaacactgatttgttctggaacggccggaattttattattccctttttctttctattagatattggtgttttgtattggcgcttgattcgaagatatcgccaaatgcaattgcggcatatcatcagcgaacttcactacatcgcaaacggaaattatgatcatcgtatcccttttgaactgagtggtgacttaagccgagtggtaacaagtatcaatggattggtggatagtaccgtagcagcgattgaagacgaacgtaaaatcgaaaaatcaaaagatgaattgatcacgaatgtcagtcatgatatccgtaccccactcacgtccatcattggatacctaggactgatagaagatggccagtatcactcagaagaagatcttttaaagtatacgcatactgcttatatcaaagcaaagcagatgaaatctttagtggacgacttatttgaatacactaaggtacgccagcctgctgtcccggtgaatttttctgcctttgacatgatccagttgatcgaacagttagcagctgattttgagttggaagcttctaaaaaaaatatccaaatacttgttcaatcaaaagtagactcccttatcatggatggcgataccgaaaaacttgtacgtgtcttcaataatcttttgacgaatgcgttgaaatacggaaaaggagcaacgaagatcgtaatcgaagtagaacgtatcggttcagaagttgttgcaacagtcaaaaataacggagcaatgatcccacaacaggcaatcgataatctattcgaccgtttttatcgtgtagaagaatctcgttcacaagcaactggaggaactggacttggtttagcaatcgctcaaagcattgtggctttgcacggcggatacatttatgcaaaatcagataagcaatggacttctttcatcatgcaccttccaatcaagaaaaatgaaaaattacctattgatacacaggaagttattgacgaaagctga

SEQ ID NO: 39 - DNA (genomic), 2268 bp, Enterococcus faecium; double-stranded, circular
  misc_feature (B) LOCATION 1...2268
  hypothetical: NO
  anti-sense: NO
ttaacaagattgataaaagaaaggatgttgttaatgtcatccaaagctgaattattaaacgggatgaacccccgtcagaaagaagctgttcttcacactgacggaccattactgctaatggcaggtgcaggaagtggaaagacgagagtgctgacacaccgcattgcctatttgattgaggaaaaagaagtcaatccttggaacatcctagcgattacttttaccaataaggctgcaaaagaaatgaaagaacgtgtcaatgcgattctcgcatctggaggcgaagatgtctgggtatcgacttttcactcgatgtgtgtgcgtattttaagaagagatgttgattttatcgggtataaccggaactttacaatcatcgattcttctgaacagctgaccttgatgaaacggatactaaaagaactgaacattgatccgaaaaaatatgatcctcgaagtatattaggaacaatctctcaagcaaaaaacagcctgcagacccctcaggattttgcaaaaatgcaaggcagttattacgaagagattgcggcaaaatgttatgctgcttaccaaaaagagcttcaatataatcaatgtatggactttgacgacctgatcatgaatacgattcgattatttgaagaacatcctgattcactcacgtattatcaaaacaaattccattatattcatgtagatgagtaccaagatacaaatcacgcacagtatacgctagtcaatttattggcaggtagatttaggaacctgtgcgtcgtgggagatgcagatcaaagtatttacggctggcgcggtgcagatatgcagaacatcttggattttgaaaaagattatccagatgctgcagtaattttgctagaacaaaactatcgctccacgaaaaacatccttagcgcagcaaaccaagtcattgaaaacaatagcaatcgaaaaccaaaaaacttgtggacagaaaacaaagaaggaaacaagatcacttactaccgtgcagataatgaacgagacgaaacccgttttatcgtagaccggatgcaagaagagattcgaagcaatcatcggaattacggcgactttgccatcttgtaccggacgaacgcacaatctcgtgtaatggaagaaactctgttgaaagcaaatattccttataaaatggttggagggcacaagttctacgatcgtaaagaaatcaaagatattttagcgtatttgaatgtgctggtaaatcctcaagattcaatcagttttgagcgtatcgttaattcgcccaaacgaggcatcggaccaggatctatcgaaaaactacgcagttttgcttctcttcatgaatggccactgcttgaagcagcgcaaaatgtggatctggcaaatatcggtggaaaagcaggacagcaattaggtgcatttggagagatgatccaagaagtcactcagatgatcccatacttgacagtgacagaattgacgaaagaggttttggatcgtagcggatatctagaagacttaaaaatccaaaatacattagaagcacaagcacgcatcgaaaacttggaggaatttttaacggtcacacaagaattcgacaaacaattcgaacagcaaaatgaagaagacgctgatgcaccagaagaaaaactaacggtctttttaaatgatctggcacttgtttccgacattgacaatttagaagaagatgcttcccaagtgacattgatgactttgcatgcagccaaaggattagaatttccagttgtattcctgattggtctagaagagggggtttttcctttatctcgagcattgatggaagaaagcgaactggaggaagaacgccgtctcgcatatgtggggatcacgcgagcagaagaagcgttgtatttaacaaatgctttctccagaacattatatggacggacgcaatataaccgaccttctcgttttgtagaagaaatcgatcaggagttactggaaatcgaaggcatgcgtcctacgcctaaaaaaacgcctgtattcgctaaaaaaacagcatatagctataaacagccagagacagcggttgttccctctaaaagtgctactggaggggaaaataacagctggaaacctggagataaagtcaaacacaaaaaatggggtctaggaacagtcgtccgagtaagcgggacgtcgaaggatctagaactagatgtggctttcccaagtcaaggagtaaaacgtcttttggctgcctttgcgccaattgaaaaagcttag

SEQ ID NO: 40 - DNA (genomic), 372 bp, Enterococcus faecium; double-stranded, circular
  misc_feature (B) LOCATION 1...372
  hypothetical: NO
  anti-sense: NO
aaaaaaagattgggagggattaggatgtgtggtcgttatttttttgatctagagtcagagctccttcagaattattatcgagaagcccagacgaaacaaccgaagcaggcagcagaattagcagctggagaagtttttccgtcaaatcttgttgtgacgttaagaaaagaggaagaaaacatcctcactccggaaatcatgaagtggggatttaccggatttaaaaaaggacaattgatgattaatgcccgtgcagagacagtagaagaaaaaaagacctttcatcaaccatttttgcaaaatcgttgtgttttcccaatgagtggaatgaagaaaaagacaaatttatgttttcaaataaggaaaaaatag

SEQ ID NO: 41 - DNA (genomic), 258 bp, Enterococcus faecium; double-stranded, circular
  misc_feature (B) LOCATION 1...258
  hypothetical: NO
  anti-sense: NO
gagaaaagattctatagcgaaagctataaagctttttttgacaagaaaaaccctcatcaagcaaagaaatgtcctcaatttgatgacagcctgcttgatgggggttttagcaattatttaactgattttcttatatccttgctggctttcttgtgtagcatgataagtttctacgtcaagaatggcctgtttaaatttttctcgggtgatttcataaggcacatgtttaatatcatttgttgccatggctttatctaa

SEQ ID NO: 42 - DNA (genomic), 681 bp, Enterococcus faecium; double-stranded, circular
  misc_feature (B) LOCATION 1...681
  hypothetical: NO
  anti-sense: NO
atggaaagatttgacgtcgaaaggatgatccaaatgaaaatttttgttgtaggtgcaaacggacaaattggccgacacctgataaaagatttagctccaagttcccatgaaatttttgcaggggtgagagatgttgcttcccaaacattagtaaaaaaagagaatgtttcgtatgtctcttttgatttaacttggtccgtggaaaaaatgaccgaagcattcaaaggcatcgatgtattgatttttgctgccggctctcaaggaaagaatcttctgcaagtagacttggatggcgcaatcaaaacagtgatcgcagctgaaaatgcgcatgtctctcgctatctgatggtcagtgctgtttatgcagatgaaccagcaaaatggcctgagtccatgacagattattatattactaaacattatgcagatgaatggctgaaacgaactaacttagattttgtcattcttcaaccagtcacattgactaacgatgaagaagttacttccattcaattaactaagcctaatgagaaggcatcaaaaacgatcactcgctctacagttgctgctgtacttgccgctctagtggaagaaacggatatttctcgtacgactctagtactttctgaaggtagcaaagagttgaatacagcattccaagaatgggcaaaggaggaatag

SEQ ID NO: 43 - DNA (genomic), 720 bp, Enterococcus faecium; double-stranded, circular
  misc_feature (B) LOCATION 1...720
  hypothetical: NO
  anti-sense: NO
atccgtttatccctttttgatcttgctatttatggtttcttgctgctgttcatcttgttcgtgtttgttttaggacaccagaagaaggaatggaagttgccaagctggctaaatctgtttacttttctaaatggaatgctagggaatttcctttttttatttagcagtttttatgttggcatactgtacggattagaaaaactttcgatttttatgtatttgccttatgcagcaggcttgattgcagcaaaaatagtcggaccatggattttgaaacgtttaacatggtctccattggctatgcaattgcttggactgagttcttctttattggtcctcttgattccaaatggttttgcgataggtgtctttctgcttagtttctggcacgtagtaacaggcagctggctaaataaggaatattatcaaactgatacagctattccaatggatcgccggatcgttgtcaagtatactactcaaaataaagggagtgtgatccaccagtttttattgatgacgcttttgtttgttttagcaaaagaaatgggagagccaatccatctattattgatcacgctgaaccatgaatcagtgccgatagaaagtgtacaactgcttatcttggcaaaatggatcaatgttggtcttttactgagcggattagtaactgtttatcatttatggaagaaggcgaaaaagaatgaggctattcattga

SEQ ID NO: 44 - DNA (genomic), 300 bp, Enterococcus faecium; double-stranded, circular
  misc_feature (B) LOCATION 1...300
  hypothetical: NO
  anti-sense: NO
ggggtattatctaattataaaaatagaggagaatgtgttatggagattgataataaaaatatcctgaaccgtttgaaacgtacagagggacaaattcgtggtatccaaaaaatgatcgaagacgaaaaagaatgtatggatgtcatcactcaattaagcgctgttcgttctagtattgatcgcgtaatgggcatgatcgttgcagataatctgaaaaattgctttgagaaacctgatagtaatccagaagaacaagcggctaaactagaacaagcgatcaagatgattattaaaaagtaa

SEQ ID NO: 45 - DNA (genomic), 525 bp, Enterococcus faecium; double-stranded, circular
  misc_feature (B) LOCATION 1...525
  hypothetical: NO
  anti-sense: NO
agaggaagattttttttaggaggaagaaaaatgattaaagcagtgcgaattgatgaacgattaattcatggacaagtagcgatgacttggacaaagagtctaaatttaaccgggttagtagtagcaagcgatgaggcggctaccaacgatattcaaaagatgacattgaagatggctgcaccatcgaatgtcaaagtcattattaaaacagttgatgacgcgattcatttgttaaaagatccgcgggcgaaggacatgcgcttgatggttttagtccctaatgtcaaagatgcggtaaaagttgcgaaagctttcccaacggaaatcgaattaatgaacgtggggaatgctgggaaaatgacaccgccatcggaagataagaaaaccttatcaaaggaagtgatgttaacgacgtcagaaattcaagacttaaaagaattagttgaactttatccagataccgtttttcagcctacaccggcgatggaaaaacgttcagctatctctattttgagtgatttttag

SEQ ID NO: 46 - DNA (genomic), 360 bp, Enterococcus faecium; double-stranded, circular
  misc_feature (B) LOCATION 1...360
  hypothetical: NO
  anti-sense: NO
tctaaattatcttctgcggtttcaaagttttggatgacatcgtctttttcatcttccacttgttcagcagctttctttgctaattctttggcagtttgctgttcggcaaattttgtcaaatcatcaacagtgatcaaatcgtcgtcttcatcgtccatgtcacgaagttcgatctctgtatcttcgatatccaatacacgcatgtccagacctagtgattgctattctttcaccaatacgcggaatgattccggtacacctggttttggaattggttcacccttgacgattgcttcgtatgttttcacacgtccgactacgtcatctgatttgtatgtcaagatttcttgtaaagtataa

SEQ ID NO: 47 - DNA (genomic), 201 bp, Enterococcus faecium; double-stranded, circular
  misc_feature (B) LOCATION 1...201
  hypothetical: NO
  anti-sense: NO
tcgttgttatcgttgacatcagacgtccttgtatatgcgttggaacttctcgctgaagccagaccatataaaaagcaaaagaaaacattaatccttaaaaacggacttatgaaaaataatacatgccgtttgggatttacaattagctaccaaataagaggttatgacaaaagacttttcacaatcccttcttccgaataa

SEQ ID NO: 48 - DNA (genomic), 654 bp, Enterococcus faecium; double-stranded, circular
  misc_feature (B) LOCATION 1...654
  hypothetical: NO
  anti-sense: NO
gagacgttatctcttactttgcgacatatgtatttgaaaaaggcgcagatatcccagcattacttggggcttatatgcttggaaggttcaaaagcaggggcaacagcagccagcgtttgggcagcacaccatgtcttacctttgaatgtcacaggatatggtaaattaatgggtgcatcaatcgaaggtgcacatcgtttctacaacttcttgaatgacttgtcatttaaagtaggagacaaagaaatcgaagttcatccattaacttatccagatttcaatatggtagactatgtattcaaagaaaaaggcaacgatgacttagttgcaatgaataaattgaaccatgacgtatatgattattcttcatacgtgaaaggaagcatttacggtaatgagttcttaacttcacatactgactttgctatcccagactatggcaacagcccattacaatttgtgaaccaactaggattctcagatgaagaatggaaccgtgccggaaaagtaactgtattgcgtgccagcgtaatgacaccatacatgaacaaagaagaacactttgaagaatatgctgaaaaaatcaaagcagctcttcaagaaaaattggaaaaaatctacgcagaccaattattggcaagcgaagcaaaataa

SEQ ID NO: 49 - DNA (genomic), 372 bp, Enterococcus faecium; double-stranded, circular
  misc_feature (B) LOCATION 1...372
  hypothetical: NO
  anti-sense: NO
ccacttctatcacaacctctttttgactatgcattcacatcgatcactttagaatcatcattgatgacatcgcgatctaaatctttgatgcgtgcacttgtcacgataccagctaccatgctaccgctgacgtttactgctgtacgtgccatatcgattaatggttcaacagagataactaacccaacgattgctgctggcaagttcattgcccctaaaacgatcagtgaagcaaatgttgcgcccccaccgactccagntacaccaaaagaactgattgttacaattgccacaagcatcaaaataaattccaaactaaagacattcactccagctgctggtgcgacgatcgttgccaacatagctggataa

SEQ ID NO: 50 - DNA (genomic), 240 bp, Enterococcus faecium; double-stranded, circular
  misc_feature (B) LOCATION 1...240
  hypothetical: NO
  anti-sense: NO
atgactctatcagcgatgggcgctaaagcagaattatgtgtaatgatcaaaacggtattgccgtgttgtctgctagcgttttgcaataatttcaatacttgcttgcccgtttcaaaatccagcgcgcctgtcggttcatcacataaaagaagtttgggatttttagctagtgcacgagcaattgaaaccctctgctgttcgcctcctgataattgggacggaaagttattcaatcgatga

SEQ ID NO: 51 - DNA (genomic), 438 bp, Enterococcus faecium; double-stranded, circular
  misc_feature (B) LOCATION 1...438
  hypothetical: NO
  anti-sense: NO
tgtatgagatttttagatttattcgccggtattggtggctttcgtttaggtatggaacaggcgagccatcattgtatcggtttttgtgaaattgataaatttgctagacgtagttataaagcaattcatgatacaagtaaggaggtggaaatgcatgacatcacaagtgtatcagatgagtttattcaatccctcggaccagtggacatcctttgcggcggatttccgtgccaagctttttcaattgcgggaaagcggcaaagattttccgatactcgaggtactttattctttgaaatcgctcggttcaccactcttctccgacctaagcttttattccttgagaacgtccgaggattgctcaatcacgaaggaggggctacgttcgagacgatcctccgaacgctggatggattggggtatgacgtggagtggtag

SEQ ID NO: 52 - DNA (genomic), 213 bp, Enterococcus faecium; double-stranded, circular
  misc_feature (B) LOCATION 1...213
  hypothetical: NO
  anti-sense: NO
caagtgagattggctacaacaacaccacgtatttctctaaattattcaagaaaatcgtcggcagatcccctaaagagtaccgagaaaacagtggagaatcataaaagaaaaagccaatgtaatgaaataacttataaaaaattgtctagaaatctaattttgggctgttcttattacttgaggcaaggcagctttttcatgacctctcgataa

SEQ ID NO: 53 - DNA (genomic), 564 bp, Enterococcus faecium; double-stranded, circular
  misc_feature (B) LOCATION 1...564
  hypothetical: NO
  anti-sense: NO
aaggtgagattaatgaagataactgaattttcggaagtatttaaaacgtttagtaacatttacaatagaataccagagatagaacaaaatgttgtagttgataatgattattatatagagaatgattttaataaaccaagaaaatatgacaacctatacaattttatacacaatagaacaacaataaataacaacagtaacactcgagttttgattaattcagcatattttcatattaaatatttaaagaaatatgagtatgaagaagttgtattagattatgggctaaatagacagtcatttttaatttatgcaataaataacggaaatttgccaagcaataaaaagaacataattattgaaacatatgcctatctggaggggggatctaaaaaactaattaagtcatgtaatatagagtatcaattatcagtaggagaaattaaatgtgttttcgaagaagatttagaacttgacttaaaaaaaatttttgccagcattcatgattatataggtttgatacccgtggtgctagttaattttttcctagaggaaaatgtctaa

SEQ ID NO: 54 - DNA (genomic), 1512 bp, Enterococcus faecium; double-stranded, circular
  misc_feature (B) LOCATION 1...1512
  hypothetical: NO
  anti-sense: NO
aaaagactatctgaaaaacggatagtcttttttcttttgggaggtttgaaaatgaccgagaaaaaaatgagtcttattgatcgatgtaaacagatcgatatagtggattttgctcgaaacaatggaatggctgtagtcaataaaggacgagactatcgcttagaagaccatgattcatttgtttttgatcgaagaaaacaacgtttttattggaacagtcaaaatattagtggcgacattattgaattagctaaactttttttcatagacaaagagattcaagactctaagcaacaatttaaagcagccacagattttattctaaagaatgaagacaaaacagaacgagtagaaaatcttcattttgagacagaaaagtacaaagatcaccccgttgattatcaaccactcacagaaaaaggaaggaattatttgaaggaagaacgaaaactgcccgattggttgattgattatgcagaaaaagaaggattgatcgccgaactaaagccaaaacatgaacggcaaaatttcttagttcaagacgatcgtttggatcatgcggtcgcctttttatggaaagatccacagacaaaagagacagtaggggcgagttatcaaggaacattcattgattatgaacgttttggtgagagaggcacatataagcatatagataaaaattcgacagcgaatcatggatttaacctaaagatcggtgaccctaaacagttaaaattttttgagagtagtattgatttacttagctatgctgcactgaatcgtgatcagttaaacgatacgtggttagtctctatggaagggttaaaacaccatgtgatcagtcattattttggtgaggcagtatctgaattgagaaagaaacaagcctttcctcaatccattgagatttgtgtggataatgaccgtgcaggacatattttctacgaaaaagaacaattaatgggcgcagttgatccatttacgaatcagaaagtacgttgtgaacgaggaatcgctaatgattggcaagtgccaaaagaatacaaagtcatttatgaagaagttgcaaaagaaatgaaagttgaacctgaagcaattatggccatacacaagacagaaaacaatctgcaattaacgaaccaactggtttccgctcacaaagtaaatgcgtcttttggtcagcagctttctgttaacgattcaatagaagctattaatttgaaagatatttgtagagaagtcgcaaaagaattaaaaggttgtgaacgcgtggatggtacgtacgattttgatcgtttttatcaagaaaaaggggatattaatgctcagattcttttctcttataaagcagaacaatactacaaaagctataaaaatcatgaacatgaatttgtacctgaagtaaaaaaggattggaatgatcaattgaagcatgaaatccaccaacaagagatcagaaagcaaaaacgtgcgatgttgtttcaacaaagcaaacaacaagaaagggagtga

SEQ ID NO: 55 - DNA (genomic), 834 bp, Enterococcus faecium; double-stranded, circular
  misc_feature (B) LOCATION 1...834
  hypothetical: NO
  anti-sense: NO
cagacgctatcgtccattatgctggaggaaatgcccatgatgaataaattgatatttggtcgttatatgcctggagattccttgatccatcgattggatccccgagctaaattattagccagtttttattttatcggaatcatttttttagcaaataattgggaaacgtaccttttgttggcatttttcacattactttctgtcttcttgtcaaaagtagatttgaaattttttatccgaggcattcgcccattgatctggctaatcctcttcactgtagctttgcaggtcttgtttacaagtggcggagaaacttattggagttggggtgttttccatatcactgaatttggtgtgatgaacggcctctttattttctgtcgattcgtgttgatcatttttatgtcgactctactcacgcttactacaccgcctttggaattatcggatgcgattgagtacttgcttcgtccattgaaagccgtacggttcccagtccacgaaatttcattgatgctgtcgattgctcttcgttttgtgcctacattgatggacgaaacagaaaagatcatgaacgctcagcgcgctcgcggtgttgattttggtgaaggaaacctagttcagaaaatgaaagcagtcattcctttgctgattcctttatttgtcagcagcttcaaccgtgcggaagatcttgcgactgctatggaagcaagaggctacaaaggtggggaaggaagaacgaaatatcgtgtattgcattggcataatagagacacgatggttatcattgcttttgtattattaactgtgctactgatctttttaagaggataa

SEQ ID NO: 56 - DNA (genomic), 870 bp, Enterococcus faecium; double-stranded, circular
  misc_feature (B) LOCATION 1...870
  hypothetical: NO
  anti-sense: NO
ttttttatatcagcagtcccgcctacaattggggaacattcgaagcaggatattagcgatttttgtttgtctggagcagttgctgcacctatcgtgggacgactggaaacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcgcgaatccaggtgtccctgacgtgaaagtgttagagactttatcggaagaagcgaatcttcccaatatcctaggggaaaaaggatatattanccataaaatccatgaaaagcttgcccttaagggcattactatatccgttccgccacgtaaaaacatggataaatcagaaaaactagaccacaggttacttggaaaacaaagaaaaacagttgagactgttttttctaccttagaanaattaggtttgtcaaatttcgactcacgttctgttaaatggctaaagagtanaattgaaagcatattactggcttacagtgtttctattaagtcaaacacaacgacttttggagggaactttgagatatccttaaggatataa

SEQ ID NO: 57 - DNA (genomic), 651 bp, Enterococcus faecium; double-stranded, circular
  misc_feature (B) LOCATION 1...651
  hypothetical: NO
  anti-sense: NO
ttttgcatatcaaaaaaacatgttacaatgaaattaatcaatggtggaagcgttataaaaaaattaaggagattaaaaaatatggcaagaaaaaagacgattactagagaacagattttggcagctgcttatgaagtagctgccaccgatggatttacacgatttactgcgagaaacatcgcgaacaaaatgaattgttccacgcaaccgatttatcttgagtttaaaaatatggatgacttgagacaagctctttttgagcagatctatgatcatttacaatatgaagtgttcactgttgagcatacagggaatacgattatcgatcttgcttttaattatatccattttgcaagaagagagaagaagttgtatcgttcactgtacttagaagaatatggtggaggaaaagagatgcagaatttctcttatacttactttgtgaatacagtgaaacgcgatccagcttatgtgaatctttcagaagagcagatcgaatctttgtataatgggacatggatcatagctactgggatcgcagctttgatgtcttcaagcatcatccatccaactgatgaacagattgaaaagatgatccaagacagtatagatgctatcttgaaattcaaagaaccaatcgaaatcgattga

SEQ ID NO: 58 - DNA (genomic), 1182 bp, Enterococcus faecium; double-stranded, circular
  misc_feature (B) LOCATION 1...1182
  hypothetical: NO
  anti-sense: NO
ataaggagattgtgtatggaaaaaaacaggaagttcaacctcgtcgcaactgcggcaagcgggctagaagcactggttggtaaagaattaagagatcttggaatcgaatgccaagttgagaacggacgtgcacgttttgaaggaacaatggaaacgatcgctacagctaatttatggttacgtacagcagatcgagtaaaaatcgtggttggggaattcgatgcgtatacgtttgatgaattgtttgaaaacgtaaaagcattgccttgggaagattttcttccactagatgcagcttttcctgtagctggaaaatcgatcaagtcgaaactatatagcacacctgattgccaagcgatcacaaaaaaagcaatcgttgaacgtctccgtacctattatcaccgtccagcttctgtaccactgacggaaactggcgcacattttcagttggaagtagctttgctgaaagaccatgtgatggtaactctggatacgacaggaccaagtttattcaaacgtggttatcgcttagaaaaaggtggagcaccattgaaagaaaacatggcagcagcacttattatgttgacaaattggcgaaaagaccgtccattttatgatcctgtatgtggttcaggtacgctttgtattgaagcagccttaataggccataatatcgcaccaggattcaatcgtgagtttgcttgcgaatcttgggattggttcagtcaagaaatcatggaaaatgttcgatcagcagccgaagaaaaagcagattatgatattgaattagatattactggttcagatatcaatggacggatgattgaaattgccaaagccaatgcagaagaaatcggattaggctcttcgattacctttaagcaacaagcagtcaaagacttcaaaacggataaagaatacggggtcatcgtggctaatccgccttacggagaacgtctaggagaagaagaaactgttcggaaattatataaagaaatgggcgatgtattccgtccattaaaaacatggagtaaatatatcttgactagcgacttagcgtttgaggaattttacggacaaaaagcaaccaaaaaaagaaaattgtacaatggtgcattgcgtacggatctattccagtattggggaactcgtccgcctagaaaaaaagagaaagacgaataa

SEQ ID NO: 59 - DNA (genomic), 669 bp, Enterococcus faecium; double-stranded, circular
  misc_feature (B) LOCATION 1...669
  hypothetical: NO
  anti-sense: NO
tattcaatatcaaaagagaaagaggatctattaatggacggtatatttggttttactggtattgttttatttattataggtttaatcatgttaattgtaagatttatcaaaaaaacaaataagaaaacacctatgattctccttattatcgggattatttttactaccgtaggtttctcgctttcctcatcaaacgaggcaaatgacaataacaaacaggaaagctcatcatctgatactcaaactactacatctaacagcagcaataaaagcctaactcaatttgaagaatttttagagacaaataatcatgactggggtgctttcttagatagttattattctattactccagctactgagcaaaatacagcttttactaaatatattagtggtaaaacatatacttttgaaggaactgttatcgaatcaatgactactagaatagccattatagcagacaaagagtacgatgataaaagttggaatgatatttctgcaacacctaaagtttcatatgtaatttttgcgaaggacttaaacaatgctgatacctttacaaagggcgataaagtaacttttacaggagaaattagttcaagaggatcgaacatagaaaaatcctatgctcaatgggatatgattaatagtaaagtaagtaaaaaataa

SEQ ID NO: 60 - DNA (genomic), 2748 bp, Enterococcus faecium; double-stranded, circular
  misc_feature (B) LOCATION 1...2748
  hypothetical: NO
  anti-sense: NO
tttgcaatatcttttttttacgtacaagctggcagcttgaatattcgtgattattggcttatcctaacacctatcagtcagaattactttacttatgctgtttcttgtactttgcttttttgtagtattccttatacagttggatttttaaataaattatcgaaaacaacaattaaatatctactattatttttaacaattggattagttggctgctctactctatttaataaagacccgtttgcattacagaatggacagagtattttatggattttttatttatttttaatgggttatggtttgaaagaatggaactggaaagaaaaggtccgctataagcttcctcaagtatttatcagcttgattgttttattcggtttgattattttgatgacacaaatttcactcatcatcagaggaaatacagatacagcgctgaggttttctaaaccatattctctcttcgcaatgtattatactttctcttcgtttttatttttagaaatgctatctgataaattaggtataaaaggaagaggaaattttcttgctgtatttttgattgtcactcaagttatatgtaatttccctttagtttcttatcgcgtatctacatttatgaaacgtgaatttccaaactcagggaaggcatggctgataaatatcgggcagttttttatttgctatttattagcagtgtccctcctagttatctttttattttatatacaaaaaatccgtttcattcatcgtttcatcgaatacttcgcttttgattcgattgaacaattaactcagcgttggaaaaaaagaattcattggctttttgttcataaaagttattttttagttgcagcatttttttactgctttaccttcgtgcagattttcgttttagaaccaaaagaaggttggaaagaaactatccaggttgccttaaaaatatttactcagcgacaagcacccatgatcctgacaatcatcattattatgggatttttcttcttactattgttgatttccaatcgtttttggtacgccttgactgctaccttgatcattaacttactgctcactatttcgacagtaatcaaaatggaaatgcgggaagagcctgtctttccttcagatttaaaaatactgaccggattgtcagaactattatcgatggttagcccagtcttattaatcgtgggcggattgatccttctcctattattgattactagtattattgtacaacgtagactacaaaaacagtattccttgaagattcattggaaacgtcgatttatcagtatcgctgtattattaggatgtttttcgggtgtctttttcattaatcacaaaaattcgccttctttcttgctgtttaatttatttaaagtaaacaagactttctttaaccagcaaggcgccgtaaaagataacggaccagtcattcaattcctaaacaatatcgacattaaaatcatggaagaacctgctggctattcgaaagaaaaaattaatggaataatgaaaaagtacaacacaaaggcagatgaaatcaaccaaacaagaagtgactggttaaacaatcagacgatcgttctcaatttaagtgaaagcttcagtgatcctgcacgtgtccctaatctgacagtacctacagaccctattccttacatcaaaagcattataacagaaggaacaggaggattgatgttatccgtcggttatggtggcggaacagctaacatggaatgggaaggactgacaggcttgagtatcagtaacctgtctgcttcgttagttacaccttatacccagctagtggagcgtcagaaaataagtccaaatattaccgatctattcgatgaaaaaatagccatccatccttttacagctgctctttatcgcagaaaacaagtgtttgataaatttggttttgacaggttctattatttagacagtccggataaattaacttatacggataaaatagaacaaagcccacgcatatcggatgattcagcatacaaagaaaccttgaaagctttacaaagcaatacagaaacgtcacaattcatccaattatccactatgcaaaaccatatgccttatgatgattactatagtgaattgaactacactgctgaaggaactgctgtcattcctaatagaagaaaagaattacaaacttatatgcaaggccttcactataccgatacagcagtaaaaaaattcatccaagaaatcgacaaaatcgataaaccgattacctttgttttttatggtgaccatttacccgcaatctatagtgggaatgattcgaaaaaatatggattagaacagcaccagacagattatttcatttataacaacaagtatagtcgtgaacaagcagctacgttaaataaagaagttgttgctcctaataactttggtgctatggctcttgagcatgcgaatatcaaagtaactccttactatgcgttgttgacagaagtatctaatcatctacctgcattaacaattgatcctacagaaagcttgtctaatcgttttaatggaaaacaggtctttgttacagaggatagtcaaattatccaagaaaaaaatttaactgagaaacaaaaagaaattctagaagattatcgtctgatacaatatgatcttgttgcaggtaaccagtacagtgcaacatgggcgacacaaaaaataggctctttgtcaaatgatgttggtaaagagaaatcttag

SEQ ID NO: 61 - DNA (genomic), 681 bp, Enterococcus faecium; double-stranded, circular
  misc_feature (B) LOCATION 1...681
  hypothetical: NO
  anti-sense: NO
aaagggagatttcaaatgaagaaaaaaacgttcaaaaaactattgtttctagggggcacagctgctcttttattaagcggtacaagttattacctacatatccattctccagaacatacaatgaacactgcacaaaaaagttcaacacaaaaaacgaaaaagacaaaagagaaagcagaagttttactagatgttccattagagagccagtttgattctccttctttagaaaatggctgtgaagtcacttcgctttctatgcttttatctttttatggttatgaaacaactaaaaaccagttagctgagcaattggattacgtccctgttttcaatgcagatgggactcatggcgatcctaatgaaggatttgttggtgatatcagtggcggagaatgggctatggtcgtctatgttcccccagttgcctcccttgctcagcaaatcgtccaaacggattatcacacttttccaaaaaccgatgctcaactcgatgatatcaaaaaagcactatttaaaggaaatccagtctggacttctgtgactatcaattttgaagtcccagatgaaactgattttatgactaggaccacaaataatggagaagtaagagtcactcctcttgttcatgcttgtgtagtcaccggatctgacaaagttataattagcccagccccataa

SEQ ID NO: 62 - DNA (genomic), 3213 bp, Enterococcus faecium; double-stranded, circular
  misc_feature (B) LOCATION 1...3213
  hypothetical: NO
  anti-sense: NO
aaagggagattggtaactatgaaatggagtattccagaaaaagtcattgcacgtggacgtcaatacttgcaagaaggccgagtgttatcggttgtccctgaccaagaagaaaacgtgtggcatgcagaagtcttgggcagtgaattgtatatggttgatttggatggtacagcaaaagagatagattactgccaatgtccctattgggaggaacataaatattgtaagcatacagttgctgtggaactttatttacggtcgaaaaatctatctcgtatcatgaaaaaagaccagccaatgctagaaccggtaaaagcaacaagtgagggagaaatcattgcaaaaggtttttctcgtctaaaaacacaaaacaatcctcaagcggtgcaacctttgattattgaataccaagtagaaacgattgagactaatcagtatcacccagagctttctattttggcactttacttgcgtatcggttcattggcatcaccgaaaaaaacatatatcgtaaaaaacatctatgattttttacaagcttacacagaaaaagaaacttacactgttaataaacagtaccagtttcgtctagataaacgggcgtttcaaaaagaagatcaaaaaatactcacgcatcttgcaggaagtgctcagacgcatcaattattaggtacgaacggcttacaagtcaaaggaaaactagataaaagatatctgcttctcccagtagaacaagcccgcttcctgttagagcagatgaatcagactacacgtttgcatctgcagataaatgaacaaaacgatcaaggaatacaattttccgatcaaaacaaacctttatcattcaaagtggaaaaatttggagaagattatttgctgcaagcattgaatgattttgattttttctttatgcattatcagtggggagttatccaagggacattttattctctgacgaaatatcaacaaacggtttatcaaacttggaaacaattgattcgccgattggagaaaccagaagtagtgttcaagaaaaaagaattaccgtctttgtttaaagagattatccctctgctgtcagagatcggcgacgtagctattgcccctgcagtagaagaggaagtagcagatatccccgtcgaatttattttctttttccgaaaagcaaaaggaaaaatccaagctcgagtcgatttcgtctatggcgaagtcatctattcgactgacccgaagcatgaggtctcgacagaacaggcttttcaggtgttacgtgacacagtagaagagaaacgagtacttgatctattcagaatgtatcgctaccagaaaaatgaaactggttatgaacgtccattgccaagcggggaagaactatatgcctttttccgcacagaactatctgtcttccgtcagtttggtgaagtcagacttggaagaaaattgcgagagttgtatttagatgcgcataaacatcaaccgaaaatcgaagtaaccgagaccggttcatggctcgatattcgattcgatgtgacagggatagaggagcaagaaatcgatcatgtcctgcaaagcttgctgagaaatgatgctttttatacattagaaaatggtcaggttctttcttttgattcagaagaatttcaacaaacaagccaagtgttgcaacaattacgggaatcgatacgtacagaagaaggaacgatccatgtacctaaaaatcaaggattgatcattcaaaatcaattggaaaaaagcaatgctacttttagtgaatcgttccaaacgatggtacaagatctcattcatccagaaagataccaggcacagcttcccaaaggattgaatgcaacgatgagagattatcaaaagcaaggttttcgatggttgaagatgttaggtcattatcagtttggcggtattttagccgatgaaatgggacttgggaaaacactacagacaattgcctttttactttcggaaaaagaagaacggaaaagcttctctgctttgatcgtagcgcctgcgagcttaatttacaactggcaggcagaggtgagaaaattcgccccttctttaagtatccaagtaatcaatgggaataaaaaagaacgtgaagaattactggctaaagacacagatatccgagtgacttcttatgccagcttaagacaggatctagctaattatcagtcgcaaaaaattgattatttgattcttgatgaggcacaaatggtcaaaaatagcagtacgaaaactgcacaagcattgagagaattagctgtacctcagcggtttgcactgagtgggacaccaatcgagaataatttagaagaattgtggtcattgtttgcaacgattatgccaggatttttcccgactaaaacaaaattcagggaacttgccgcagaagaaattgcgcaaatgattcgaccgtttattttacggcgagataaacaaactgtgttgaaagacttgccggaaaaaacagagatgaatctatattctgcacttacagaagaacaaaaaactgtttatttagcttacttgcgtcaaatgcgtgaagaaatcacatcaatggattctgaagcattcaagaaaaaccggatcgggatacttgctggtctgacaagactgcgacaaatttgctgcgatcctcgtctgtttattgaagattaccaaggcggttccggcaagctcgaacaagtaaaagatctactggtagctgccaaagagaacaaacgaagagttttgctgttttctcaatttacagggatgctgactatcttgcaagaagagttagccgagctagggatctcgacattttatttaagaggcagtacgaaaccacaagatcggttaagtatggtagacgcatttaatgctggcgaaaaagatgtttttctgatttccttaaaggctgggggaactggattgaatctcacgggagcagatacggtcatcttgtatgacctttggtggaatcctgccattgaagaacaagctgctggacgtgcacatcggatcggacaaaaaaatgtggtagaagtgtggcgtatgatctctgaaggaacgattgaggaacgcatggattcactccagcaagaaaaacgcgaactgttccaaaaagtgatccaaggtaatgaagaacagttgacgaaactgactgaagaagacatccgcatgattttaagtgtaggagaaatcgaggagtaa

SEQ ID NO: 63 - DNA (genomic), 1632 bp, Enterococcus faecium; double-stranded, circular
  misc_feature (B) LOCATION 1...1632
  hypothetical: NO
  anti-sense: NO
gcaaaaatatctgtcagcgtaggaaggagcaatgatttggatcataaagaaatgcggcgcgtcatgcaaggagcatttgtattgacgattgcttctttcatagcaaaagtattaagtgccctttaccgaattcccctccaaaacttagtcggcgacgaaggtttttatgtttatcagcaagtttatccaatttatgggatagcaatgactttagctttatccggtcttccgcagttcatatcaaagtacgttgcagaaagaaagaatcctttcgagcgaaagcaagctttgcaaaatctttatcccttagtattttggacaggtgtctttttgtggttgtttgtctttgcatttagcagctggattgcttggatgatgggagacatacaattgaaaccgctgatccaagtagtttcctttacctttttgctgatgcctggtctatctttttatcgagggaatttccaaggaagattcttgatggaaccaactgctgtttctcaagtagttgagcagttcgttcgtgtttttgtgattgtctgtagtgcgtttgcttttagaaagcttggatggacggtgtaccaaacagggacggcagcaatgagtggagctgtttttggcggtttatgcgcatatgggatccttcactactatgaacaaaagattcatggaggagcgttaagcttccgacggtttccattgttcaaacagccgtcaaagcccttgatccggcgttttctggtagaaggcggactggtttcgatttatagtggattgcttatctttttccagctgatcgactctttctttgtaaaaaatgctttggaagtttacggactgtcagaatacggtgcgaagatagcaaaaggggtctatgatcgaggtcagcctttagtacaattaggtttagtgattgccactgcattaagtgcgacattcctgcctgcgttgactcgtcatttgaccaaccggatctatcgtcagtttttacagacagccaaaatctatcttagattgacgaccgctttagcattagctgcgtctttgggattagccttgctgctcccttatatcaattatgcgttgtttaaagattatgcgggaaatgcagcgcttgtattatttgttttttccattgctttcactgcagtcatccaagcttatcaaagtattgctcaaagcaagaactcgtttcgcccttctttaaaaggcgcaggatggggactattggtaaaaggattgactacttcttttctgaccggtttattaggaacagcaggtgcaagcctgtctacccttttaggattaggtgtgacgctttggtattttgttcgaattgaaacaaaagagctaaatgctttttggaaagaacggcattttggacggaagttgatgttcagccttctttgtatgacagtagtactgctgctgtattatggtgtattgaatatagtatttggtcctgtaactcatcgttccactgctttttttgtcagcgtgataggagttgggatcggggcttctgtgttcatttatgcagtgattcgtcttcgtctgtttacagtacgagaatggctaatgttgccttttggtaagaaaatcctgcgattaaataaaaaaattaaaaagtga

SEQ ID NO: 64 - DNA (genomic), 204 bp, Enterococcus faecium; double-stranded, circular
  misc_feature (B) LOCATION 1...204
  hypothetical: NO
  anti-sense: NO
cgtcgaatatctttttcggtaatgatttttttcattagtgaatacatcaatcagactcccttctattctaagaatacggagaaaataaacggtggtcaagtttcaactgatttttcaatcattgtttatttttctggagcatttactgatgataagaatttcatcatgaacttgaaaaatgataccactaaaatcaaaaaatag

SEQ ID NO: 65 - DNA (genomic), 276 bp, Enterococcus faecium; double-stranded, circular
  misc_feature (B) LOCATION 1...276
  hypothetical: NO
  anti-sense: NO
gtttcagtatcattgaccggaacctcttctccatcactgattgctttgatcatttctatcgtattttttgctaagatacgtgtgtctttaaagatcgtttgtgtttgttccccggcaatgatcgatttaacgccagcaactgtcgcatcttgtccagtaatcacaggtaaaggtttactttcactcccataccccacgccttttaatgacgaaatgattcctaaacttattggatcatatggcgacaaaacagcatccaatgtttggtcagtataa

SEQ ID NO: 66 - DNA (genomic), 1023 bp, Enterococcus faecium; double-stranded, circular
  misc_feature (B) LOCATION 1...1023
  hypothetical: NO
  anti-sense: NO
tttatttcatcatattttcatacaaatgttaaattttcatacaaatataggaaacgttttactggctttttactatttaaacaggctatcataggaaaaagtgacagagaaagtgaggcggaaaagatgaacaaaaatgacgtactgctagttgcaaaaaataaatcactttattttttgccttccatccgctctttagatgtttggtccggaaaagatttactacagtcggaattcattaaatcagctagacaacagttggcaaattatcagctgatcgtttttttagattatggatttgatatggagatggctcgacgcgtgcgcccatttaccaatgcaaaaattgtgttatttttttggaatcacttcaaagcagaacacgaggcgatgctgaagcaggcacaagatgaaccggcaatcgatgagatttatcattttgattttttggaagcaaaagaacttgggctgaaacataatagttcattttattcgaaacatatgaatttttcttctagcgaaccaaagacggatctattttttggtgcaacgaataatgggagaaaagaacgagcagaaagctataagcaggaatttataaaaagagatgttacgaccaactatttcattcttccacatcgagggaatgaacaacctggatatcttacttatgaagagtacctgaaaaaaacaggggaatcgcgcgggattctggaactgttgcgggagggtcagcaaggagtgactttgcggacatttgaatccatgtattttcaaaagaaactagtgacggataatcaagcgattgctcattatcatttttatcgtcctgaaaatatttttttgcttcgagaacgtgatttagatgaattaccggaatttctgcatacaccatttaagccaatcctatcagagctattggaattttatgatgcagaaaattgggcaaaacgatttatcactaacgattccactatttatgagcaatacgaatatgacctctcctctgttgaaaacaaataa

SEQ ID NO: 67 - DNA (genomic), 216 bp, Enterococcus faecium; double-stranded, circular
  misc_feature (B) LOCATION 1...216
  hypothetical: NO
  anti-sense: NO
cgcatttcatctctggtcatttttgaatcttcatcatcaaaagtcatcggcgtgatacgcgccaataaacttgtggaagcagaaagcagccagacgaagggcttagctactacaccaatcaagcgtatcagccctgaagtgaactttgcgacttcttctgatttatttaaagcaatacgtttagggtacaattctccaaaaacaatcgatacatag

SEQ ID NO: 68 - DNA (genomic), 363 bp, Enterococcus faecium; double-stranded, circular
  misc_feature (B) LOCATION 1...363
  hypothetical: NO
  anti-sense: NO
aatgattcatcgtcattcctcctgctatctttttctattattctaccttatttgatagtagatttaaaactttgcaacagaaccaaagaactcatcaagctggctaataagggtcaagattatgaacatctagcagatgagattgatgagctgagagacaagcgacagctccttttagtagaagatgcctccctcagtggcgagaacgagcgaatcaatgagctgattgaatttatccgcaagaacaaattccgtaccttagagtacgatgataagcttgtaaggaagataatccagagcgttacagtctatgaagaacacttcgtcatatccttcaaatctggcatcgaaatggaaatatga

SEQ ID NO: 69 - DNA (genomic), 195 bp, Enterococcus faecium; double-stranded, circular
  misc_feature (B) LOCATION 1...195
  hypothetical: NO
  anti-sense: NO
aatgattcatcgtcattcctcctgctatctttttctattattctaccttatttgatagtagatttaaaactttgcaacagaaccctttactttaattctagcacccctcattattcaaaacaggaaaattccccctcagtaccggaaaaccactcttattcccaccttttttgctcactaccaccatctgtttaa

SEQ ID NO: 70 - DNA (genomic), 360 bp, Enterococcus faecium; double-stranded, circular
  misc_feature (B) LOCATION 1...360
  hypothetical: NO
  anti-sense: NO
aatgattcatcgtcattcctcctgctatctttttctattattctaccttatttgatagtagatttaaaactttgcaacagaaccacattacggaccgttccagtcaattccatccctggtttcaagtcttccatactcaatacatctgtacgtaataagggcgctggcatctcatcacgcatatctcgtccaggttgtgtcagcccagctaaaatatcggctaacgtttcttctccgactgataggctttcagccagtttctctacggataatcgtgtcaatttttctactgcttcttctgtaccaagctctttttctgaaagttggactgaagttaatatttcttttgcaatagaataa

SEQ ID NO: 71 - DNA (genomic), 312 bp, Enterococcus faecium; double-stranded, circular
  misc_feature (B) LOCATION 1...312
  hypothetical: NO
  anti-sense: NO
aaaatatcatcagcgaatggtttggcatattctctgaatacttctcttacctcttcttcatttccaggtactccttttgcagaagttaaatcaataagtagctgttcttcttttgtatccaaatgttttcccccatttctatattcatattgtgattataccattgcttatgatttttgttcaggcaaacttggtatttttatcttttattcagaatattcaaaaataaagaaaacaagcgagcaacactcgcctgttttctttattttaattgtagtttatctggtatttgatgttgccaagatttgctaa

SEQ ID NO: 72 - DNA (genomic), 897 bp, Enterococcus faecium; double-stranded, circular
  misc_feature (B) LOCATION 1...897
  hypothetical: NO
  anti-sense: NO
agcaaatcatcagttccatttaccaaatccatggaaatagcagaaacaaggagaagaagaatgaagaaaaaaagattgtttgctctaataactagtgccttttttattttaagcgcttgcggtacagctgccgctaatcaggaagataacagctggagtaatgtagaaaaaaagaaagaattagtagtagcgacttctggcacactgtttcccgcatcttattataatgatcaaaatgaattagttggttatgatgtagatttggcaaaagaggtggctaaacggttaaatgtcaaaatctcctttaaagaatacaacgtggatggacaaatcacttctgtttcaaaaagagaatcagattttgctgcgaacgattttggtatcacaaaagaaagagaaaaaaaattctccctttcagagactttcaaatattcatttgacagtatgatcgtacgaaaaaaagatgattcaggaatccactcacttgaagatcttaaagggaaaaaagcagctggcgaacccaatactagctatatgcgtttagcggaaaaacacggagctaaattagtcacatatgacaatgccacgaatgatcagtatttaagcgatgtagcaaatggtcgaacagatgttattctaaatgattattatctgcagaaaatggccgtatctgctttaccagatatccctgtaaaaatactggagaacgtttatttcaatgaaaacgaaagtggttttttattgaaagaaggaaatgatgctctgaaaaagaaaatcgatggcgtattaaaagagatgaaagaagatgggacgacaaagaaaatatctgaaaaatattttcaaactgatgtttcagtcaaaccgaaagaaacgatggctgagtcggtgagtgagtga

SEQ ID NO: 73 - DNA (genomic), 426 bp, Enterococcus faecium; double-stranded, circular
  misc_feature (B) LOCATION 1...426
  hypothetical: NO
  anti-sense: NO
acaaggtcatcgtcaaccatatacaaaagtggttatcgacgcgatcaacgcttaatagcgtttgagaaagaaggcctatatatgatcaaaggaacatttaagcgaaatgacgcatgtcagatcgtttcattcactttgaccgggcatgctgatgctggtccttatggaagtgatatcgtttgtgcgggtgtttctgcgttagcgatcagcactgtcaacgggattgcctcattagccggttttgagccgattgttgaaatgaatgaagaagaaggcggttatctttataccgaagtcacttcaggaatgacacaagaacaaaacaatattgctgagattctattagaaaatcttttattaggattacaatcgatagaagctgaaaactcagaatatatccaaattaaaacaattaatgataaatag

SEQ ID NO: 74 - DNA (genomic), 186 bp, Enterococcus faecium; double-stranded, circular
  misc_feature (B) LOCATION 1...186
  hypothetical: NO
  anti-sense: NO
ttaattccatccatgccatacttacattcctccttaactataaaaaaatacacaaaaagaggaaaatcatcccttcaaagacctaatggaatgatcatcctctttatcctacccggtggcagattgtatatctttttctgtagtatagcacacctatccagatatcggcaatctcatactttttag

SEQ ID NO: 75 - DNA (genomic), 390 bp, Enterococcus faecium; double-stranded, circular
  misc_feature (B) LOCATION 1...390
  hypothetical: NO
  anti-sense: NO
ggcgttccatcttctaaaaagtttccgtcgtcaatgaacatgacgcgattggccacttctttagcgaaccccatttcgtgcgtaacgataaccatcgtcataccttgttctgctaactttttcatgacgttcaagacatcaccgaccatttcaggatcgagtgcagaagtaggctcatcaaaaagcatgatgtcagggttcatcgctagagcacgagcaatagccacacgctgtttttgtccaccagaaagcatttcaggatacatatcttttttatcttctagaccaactgtctgcagtaatttgattgcttttttctctgcttcttctctagattctttcttcaggtccatcggtgctaaaatgatgttttccaaaatagaaagatga

SEQ ID NO: 76 - DNA (genomic), 648 bp, Enterococcus faecium; double-stranded, circular
  misc_feature (B) LOCATION 1...648
  hypothetical: NO
  anti-sense: NO
agggatggatttgacaggaggttcaaaaggatgatgaatcgatcgattggtaaaaaagccaatgattatttcttagaaatcattgaatggattccacgtcttatccatttacagctactatggttcctgtgcgtcttgcctgttttcacattaggaactgcaagtcgaacagttctgtatatgatttatcattacaaaaaaaatgaagagaaaaagctcggttcactattctggaaaaagtttcgtgagaacttctctctttatggaaagcaagatagtttagcaagtgtttattttcttcttctattgatcgattatcagattttccgctattggggtgggggaattggctatacattgatgtatactacgttgtttttgcttctattaagcgcgcttctctttagttacaaaatcttgcttcaactggaacaaaaagaagcttcttggattactgcatttttcttgttttttaatgatttcaaaagcgcgcttttctatttggcaggcacgttgatccttcttgtcgcattctggtttgcaggaccaatctattttgctttattaggtttcagtttcttgttttattttcaagtcctgctttttatccatcgtacgcaagaaaaggttcttaaaaaggaggaataa

SEQ ID NO: 77 - DNA (genomic), 312 bp, Enterococcus faecium; double-stranded, circular
  misc_feature (B) LOCATION 1...312
  hypothetical: NO
  anti-sense: NO
tatggaccatcaaatcaggccgtttttttggagcaacatcatctcactcgtttagcatcgtatctcataagctatcgtactgctgtacttcgatatccgttacccgacctaaatcagcgtttagatggaacaacaggctatcttcatagatggatcggtctagcacattgtcatcgttcactaaagcatttttcattgctaaaaatcgcttgttcaaaaagaagatttgcaataaaaaagcgtactgctcaggatttgaataaaagagcggcaatacttcgttatcttcgacattttcataaaatggtttag

SEQ ID NO: 78 - DNA (genomic), 933 bp, Enterococcus faecium; double-stranded, circular
  misc_feature (B) LOCATION 1...933
  hypothetical: NO
  anti-sense: NO
ctagctacatcacatctatgcattgacactcaaagaaccagaataagtcatcagaaagcaagggggtgcggacataatcctggacgaaaaaataaacttaggaggaatgtccgtgtgttttcccacaaagagcgtgtaagggcaattcagttatttttaaaatacgattgctcttatgctgcaaccattcgagaattagggtatccgtcgattggtgcactacggaaatggtataaagagtatttggaatccggagagctccatcaggagcaccgaaaaaaatcaaagtattctgaagaacaaaaacgaatagcggtgaatcattattttgaatatggtcaatgttatgcacgaaccattcgcatgcttggttatcctaatagagagtccttgcggcagcggtgtgaagaacttgcaccaggagctagaaaactccgaaaaagtgcggtaaagttaacacaagatcaaaaagaagctgtgttgaaaaaattctataaaccgcaaactaataggaaaaatttagccgaatctggaggaattagtagagttactctatatcaatggaaaaacacggttcttggaaaggattttccattgtgtatgactttaaaaaatcaggaaaaacaaaaagagctacttttaaaggaagtagaagacttacaaaaacaagtacaccaattacagctcgaaaaagcattactcgaaggagcggctgaactgctaaaaaaagaaaaaggcgtcaatcttctttgtctatcaaatcaagaaaaaacgatattgattgatgccttacgaaatcagttcaccttgaaagagcttcttcaacagctccagtttcctaaaagcagctatttttatcaaaaacaagcacttgagaaaccagataagtattacaaagaacgtcaaattaattatcacgattttcaatcataa

SEQ ID NO: 79 - DNA (genomic), 915 bp, Enterococcus faecium; double-stranded, circular
  misc_feature (B) LOCATION 1...915
  hypothetical: NO
  anti-sense: NO
gaggaaacatccatgaataacaataacaaaaataataacaataaaatgaacaaccaaaaaccagtgtctgcacatccagacccaacgacaccaaaccaatcaaatggtgtgaacgatgaaaagaacaaaacagcaccagtatctgcacatccagatccagtagtccctaacgttcaacaaggagtagaagagaagaaacatgatgcagaaaagcatgcacctcatcatccaggaactccagaatctaaagttccagaacaacatgatgcaatcgatccttctaaacctgtggaagagcaaaaacatccttctgaccatgcgaaagcacaagaaaaacttagttctgaccacacaaacggacaaggaaaacttggttctgatcatacaaataaccaaggaaagcatgattctgaacaggaagattcaatgcgcggtgagctgaattatgaagataaagttgtgcaaaaaatcatcggaatcgcaattgaacaagtagacggtttattatctgcaaacggtggtttcttctctaatgtggcaggaaaacttgtgaatacagataatgtaacggctgggatcgaaacagaagtcggtaaaaaacaagtagcagttgatatggatgtcattgtggaatatggcaaagatatcgaaaaaatctttgaagaaatgcaagaagtaatcggcaaagaagtaaaaaatatgacacatttagaagtgatcgaagtcaacgctaacgtagtggacatcaaaacaaaagaagaatttgaaaaagatcaagaaacggtgcaagacaaagtaactgacgcagcgaaaaaaaccggtgaatttgcttcgaatcaaacagataaagtaaaatcagcagctggaagcggcgcacaaaaagtaaaagaaaatacagaaccacgggttcagtaa

SEQ ID NO: 80 - DNA (genomic), 813 bp, Enterococcus faecium; double-stranded, circular
  misc_feature (B) LOCATION 1...813
  hypothetical: NO
  anti-sense: NO
aacggaacatcgaacgatttgaacatgcgggcaaagggattaaacccggaantatctcaggagcagtgggaacgttcgcaaatatcccgccatttattgaaagaatatgtctgtaaacaattggggatccgtccacaagaaatctctactcaagttctccctcgggatctacatgctgaatatttctcagcgatggcgcttattgctacaagtattgaacgttttgcaacagagatacgcggattgcaaaaatccgaaacacgtgaagtagaagaattttttgcgaaaggtcaaaaaggttcttctgctatgccgcacaaaaggaatccgatcggttcagaaaatatggctggtctagccagagtggtgcgcggacacatggtcactgcctatgaaaatgtcacattatggcatgaaagagatatttctcattcttcagcagaacgaatcatcttgcctgataccacgattttattgaattacatgttaaatcgttttggcaatatcgttaaaaatctaacggtctttcctgaaaacatgaagcggaatatgtctgcaacatttggtttgatttatagccagcgcgttatgctgaaattgatcgataagggaatgacaagagaagaagcttatgatcttgttcagccaaaaactgcgtacgcttgggacaaccaagtgcagttccgcccgctgttagaagaagatccaaccatcacatcggtattatctaaagaagaaatagacgatgcctttgattatcatcatcatttgaaaaacgttgacgtgatattcaaacgagtaggtttggaataa

SEQ ID NO: 81 - DNA (genomic), 306 bp, Enterococcus faecium; double-stranded, circular
  misc_feature (B) LOCATION 1...306
  hypothetical: NO
  anti-sense: NO
aatcctgcatccggaaacaaggtgcggcgtgtcgcaggcaaacgcaatgaaccgcgcccagggcaacaacgtgagcgagcgcggcgcgtccacgtcaaagtcctttacacgggacacagcaaaaaagctgggcatttccgcccgttcggtggaagaaaatatccagattgccagggatataaccccaaaagcgcaggaagtcattcagggttccgaccgcaaaatcaagaaaaaggacttgctgaagctgtcccgcatggagccggaacagcaggaacacgccgccgcacagttggcggctggtaa

SEQ ID NO: 82 - DNA (genomic), 255 bp, Enterococcus faecium; double-stranded, circular
  misc_feature (B) LOCATION 1...255
  hypothetical: NO
  anti-sense: NO
agaccagcatcctatcgacgggatgttggcgcccgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtag

SEQ ID NO: 83 - DNA (genomic), 756 bp, Enterococcus faecium; double-stranded, circular
  misc_feature (B) LOCATION 1...756
  hypothetical: NO
  anti-sense: NO
atcataggatttattcgtatacatagaaagtctagatacaaaatgaaaaaagaaagtagagagaatatgaagaaaaagaaaacatctgcccctccggttcctttagttgcattagctgatcaatcaattactgccgagaaatatcgaacgatccggtccaacatccagtttgcagcgattgatcgtgaattgaatacattggtcatcacttcttctggtccagatgaagggaaatctattactgccgctaatctagcagtagtttttgcaaatagtggaaaacaggtcttacttgtagatgccgatttgaggaaaccaactgtagcgttgtcttttcaattgccgcataatgaaggattgagtaatttacttagtgagcgtgaacggatagcggacgattacataactgaaacacatatagaaaatctttgggtcttgcccagtggtccaaagccgccgaatccttcggaagttttagggacgaaaagaatggaagagataatagaggaactgatacttgactttgatctggtcatttttgatatgcctccggtagcaactgtaacggatgctcaaatccttgcagcaaaaacggatggaacgctacttgttgtcagagaaagaaagacaaagaaacaagagttgttaaaagcgaaagaactgttgcagattgcaaaagcaaatatattaggtgtagtttacaatggaacaaaaaaagaaagtgatctcacttattattaccaatcatttgaatag

SEQ ID NO: 84 - DNA (genomic), 684 bp, Enterococcus faecium; double-stranded, circular
  misc_feature (B) LOCATION 1...684
  hypothetical: NO
  anti-sense: NO
agaggaggatttcttcgcatgagtaagatgactaaagatatgagccctgaagataaaaaaatgatgcggtccgtcttctggcggtcttggaccatgaatgccagccggactggggccactcaataccacgcagtcggtgtcatgtacaccttgttaccagtgatcaatcgtttctacaaaaccaaagaagaacaggccgatgccttggtccgccataccacttggttcaatgccaccatgcatatcaacaacttcatcatggggctggtagcctccatggaaaaacaaaacagtgaagacccaaccttcgatgacagctccatcaccgccgttaaggcttccttgatgggccctatctctgggatcggtgattccttcttctgggggatcctgcgggtcatcgcagctgggatcgggatctcaatcgcttccactggttctcccttaggagccatcgtgttcttagctttgtataacatcccagccttcttgatccattactatgctttgtacagcggctactccgttggtgccagcttcatcaaaaaaatgtacgaatctggcggaatgaagatcctcaccaaagcttccagtatgttaggtttgatgatgatgggctccatgacggcttccaacgtgaaattcaaaacgatcctggaagtttctgctaaaggtgccgaataa

SEQ ID NO: 85 - DNA (genomic), 474 bp, Enterococcus faecium; double-stranded, circular
  misc_feature (B) LOCATION 1...474
  hypothetical: NO
  anti-sense: NO
atttttcaatcaagcagaaaaacgttgacattgactagattagcgggtaatatgttaaatggtattgtttgccccacaaacgtcttcacgatgcaacgcctagcggaaacccgcgacaaactgactgtagtaaatgaccagtttgggcgaccaacttggacacgtactttggcagaatttatggtatatgtcatcgaagaaaaagcaccatttggtatttatcatttgtcgaacgaaaatagctgttcttggtatgagttcgcaaaagaaatattgaaagatacagatgtagaagttgcacctgttacgtcagaagaatttccgcaaaaagcaacacgtccgcagtattcagtcatgagcctgaaaaagacagaagcgttaggttttgtcataccaacttggcaagaagcacttgcgcaaatgctggaagctgccaaaaaaatgaataattcttcaccacggggtcggtttaca

SEQ ID NO: 86 - DNA (genomic), 351 bp, Enterococcus faecium; double-stranded, circular
  misc_feature (B) LOCATION 1...351
  hypothetical: NO
  anti-sense: NO
ttaactcaatccacttttacagcacctatcatatcctgttccattttacttaattcttctcttaggttggttatctgctgttcaagttctatctgctcttttngatatttccccgacagcatgatgaagtttcgttccgttatcttctcacaggctctatcttcatacatttttgcaaataaacggtcaatctcattttgtcggttctcggctttcttcaaggcacttgcctttttcttcttttcccgtattcgctctgcattgccgactttctgtattttgttcaataccttttcttcgtcctgctgtactgccttagcccaatactgcaatcgttccaatacagcttga

SEQ ID NO: 87 - DNA (genomic), 879 bp, Enterococcus faecium; double-stranded, circular
  misc_feature (B) LOCATION 1...879
  hypothetical: NO
  anti-sense: NO
tctgatcaatcaaaacatttcaaggaggaaactattatgataaaaattacttttccagatggtgcagtcaaagaatttgagtctggaacaacaacattggcaattgctgaaagcatttcaaaaagcttagcaaaaaaagctttagctggtaaagtgaacggaaaactcgttgatttgactcgtccaatcgaggaagatgcaagtattgagatcatcacaccagaccatgaagatgcacttggcttagtccgtcattcagcagctcatttgatggcccaagccatgcgtcgcctctatccaaatatccactttggcgttggaccagctatcgattcagggttttactacgatacagataatggacaaaaccaagtaactgcagaagatttgccggcaatcgaagcagaaatgatgaaaatcgtcaaagaaaatctgccgatcgaacgccgtgttctttcaaaacaggaagcattagaaatttttgcaagtgatccgtacaaagtagaactgattagtgaattgccagaagaagaagtgattactgcttatcaacaaggcgaattcatcgatttgtgtcgtggaccacatgttccatccactggccgtatacaagtatttaaattattatcagtggcaggtgcttattggcgtggaaactcaaacaatcaaatgatgcaacgtgtatacgggacagccttttttgacaagaaagctttgaaagaatatatccgtctccgtgaagaagcaaaagaaagagaccatcgtaaactaggaaaagaacttgacttgttcatggtttccccagaagtaggttctggtttgccattctggcttccaaaagcgccacaatccgacgcacgatcgaacgttatatcgtag

SEQ ID NO: 88 - DNA (genomic), 297 bp, Enterococcus faecium; double-stranded, circular
  misc_feature (B) LOCATION 1...297
  hypothetical: NO
  anti-sense: NO
atggcccaatcaattagtgtccaagacttcaataaattgcctctcgatgctgacagcatcgttttagatacaagaaataccttagattacacaaaaaaccacttaagccactcgctttctatccccgctgctatcttgccaagacaattaaaaaatctagatccaaagaaactttattatattctaagctatacaggcaggcgatcagaagcattagccgatcaacttactgctaatggttttcgtgctgtttatatcattggtgggatggaagctcttcagtcgagtgttgcttga

SEQ ID NO: 89 - DNA (genomic), 1026 bp, Enterococcus faecium; double-stranded, circular
  misc_feature (B) LOCATION 1...1026
  hypothetical: NO
  anti-sense: NO
gattgccaatcaattattcgaataaggagggatcagtgtatggaataccacgaactaaatcccttgattcgcggaagagagcttgaacttttgtccaatgagacatttgaacggatgattcaaacaaattctgtcgaagcacttggtgaaatattgaaatccacgatttacagtccatatatttatgacggatatgaatatgacttcgaacagaatcttttaaaggagcagagccgtctatttcgctggttaaaggaatcagcaccggagcctgaaatcgtttggatctatacgatgcgctatactttccataatctgaaggttttgacaaaagccgagatgacaaatcaaaatctggaccatttgtatatcgacgatggattttattcattagaaaccttgaaggatgccattcatacgcaagtttcaaatgaactccctgaaagcattatggacagtatacgagaagtacgtgattattttgaagagtctaccattcttcagggaattgacgtgatttatgatcgacagtttttgacagagcagcgacggcttgccgataagctaggatatcaagaattgctgacagaagtcattgcttttattgacttgaccaatatcacaacgatggctcgaggaatattgcagaaaagaacatatgggttcatgacgacggtactttccagctcgggaagtatcgaaaaagaagtatttttgaactttgtagataaagatatggaagattacacgaattttctattagagacagattatgctgattttctgcgccctgtcatccgtgagggaaatcttgatctcgtaaagcttgaacagttgaaagatgattatctaagttcattgtatcaagaagcacaaacccaggctttcggaccactgccactactagcctttttgaacgcaaaagaggtagaaagcaaaaaccttcgtttactggttatcggcaaaagaagccatttcgaaccagaaacaatcagaaagcgggtgagacaagtctatgacgcataa

SEQ ID NO: 90 - DNA (genomic), 459 bp, Enterococcus faecium; double-stranded, circular
  misc_feature (B) LOCATION 1...459
  hypothetical: NO
  anti-sense: NO
aaaagacaatcaaaaagattggagcgaatccaagtgacgaaaaaaagcaataaaatcgctgcgctagatacggaatatgcaaagaaaaagtatgctgaatttcagcaacaacaacgtcaactgatttttcgaagacgcagactggctgcaatttttgttggtgctttggtcattttcgcgataataggtgtgcagattttccatgacatgcaaaggatgcatcaattgaacgaattgagagtcgaagcaaatactgaaatgaaagaagtcaacgcagacgttgatcagctgcaccaagatgtttcattgctgaaagatgatgagtatgtagctaaacttgccagaagcaaattcttttactcaaaagacggtgaaaaagtttatcctatattagaatcaaatacagacagctcgacaaatgaaacagatcaatcaactagttctacaactgcaaaataa

SEQ ID NO: 91 - DNA (genomic), 507 bp, Enterococcus faecium; double-stranded, circular
  misc_feature (B) LOCATION 1...507
  hypothetical: NO
  anti-sense: NO
ttgaagcaatcatggcaacaaaggagtttttccaacatgggactatctaaattagacaatttataccgtcaagtgatcttggatcattcttcccatccgcatcatcgtggaagcttgactgactcgacaagcaagatcgaattgaacaaccccacatgtggagatgtgatcgaattgcaagtcgatgtaaaagacggaatcatcaaaaatatcgcctttgacggcagtggctgctccatcagtacggcaagtgcctcgatgatgacagacgccgtcatcggaaaatcaatagaagaagcagaacatttaactgtagactttctacagcttgtccaaggaaaagaagtcaaagatcccgaccaattaggcgatgctgctatgcttggtggtgtanctaaatttcccgctcggatcaaatgtgcgacacttgcctggaaagcactaggaaaagcaatggaaaacgatggtaccgcagctttccatcattaccacaaggaagaggagtga

SEQ ID NO: 92 - DNA (genomic), 816 bp, Enterococcus faecium; double-stranded, circular
  misc_feature (B) LOCATION 1...816
  hypothetical: NO
  anti-sense: NO
tcaaataaatccatggatcaagatgtccctcaggaggcaaaagtcatgaaaaactcacttgtcaatattgaaaaacgtcaaaaagaaattttggaactgcttcagcagactgaacaactatcaactttcgaattagctgaatcccttgatgtatctattagtacgatacgaagagatttaaatttattagaagaaaaaaacgagatcatacgcaattacggttattgttcttataattacaaaaaccagactgattttgatcaatctggtcctgaaaggattaaacaagcgattgccagagaagctagtaaatacattaacgattatgatacgctgtttatcaattctagctcgactgcgttgaaaacactggattttcttcaatctaaccatttgacagtcattacaaacaacgtgaaaatcaattactctccgcacaaagataattgtagttatattttaactggtggagagatgcgctttccaaaagaagcactagtgggcgacatcgcattaaatacgatttcttcagtcaatgcagacatttgtatcattggctgtagcggagtcgatgtagtacatggggtcacaacaaagatattaaatgaatcaacgatcaacgaaatgatggtcaacaagacaatcaaatgtaagattttagtcgctgatcatcgaaaaatcggactgacatcaaagttcaagattgctgatatttcagtctttgattatttgatcactgataaattttgttctgaaaaagtattagaggagatcagaaatacggggataaaaaccattcaagtagattcattttaa

SEQ ID NO: 93 - DNA (genomic), 357 bp, Enterococcus faecium; double-stranded, circular
  misc_feature (B) LOCATION 1...357
  hypothetical: NO
  anti-sense: NO
tttgacaaatcatatgatataattacgtattacaagaatgaacagaaaaaattatttaagtataaaggaacaaaaagatgggacaataggcattggtacgatttagaccaagaaaagaaaacaagcatactgaagttgatgaaaagacttaatatcgacaaatctctatatttttctatatatggaattggatcaatggatgttcatggaactggcactattaatcatattgcatcaaatattggaatagaatcggcgttacaaatacatgtattggaaaaactatcatttgtgataactttagatactttgaaagtaataaaagaattctatagatgtaacatcgagagagtgtaa

SEQ ID NO: 94 - DNA (genomic), 507 bp, Enterococcus faecium; double-stranded, circular
  misc_feature (B) LOCATION 1...507
  hypothetical: NO
  anti-sense: NO
agcagcaaatcgtacagttatcgaagaaggaagagcaggaggcttatcatgacaatcattcatgaagagaacatttttttacaacagccattagatagtcaagaagaagcatttaagtttttagcaaagcaaacattctgtttaggaatcgctcatgacgaaaaagaagtatatcaaaaacttctagaaagagaaaaagaaggtactacaggaataatgtcaggttttgctatccctcatgcgaagtctcaaacaatcaacgaacctagtttgattatcgtcacactgaacaaaggaattgaatggaacagtttagatagacagtcagttgattttatttttgcgttatttatcccagattcagaagcaggaacgactcatttgaaattattgtctctcgttgcacgatcattgatgcgaaaagaggttacagaacagttgagagcagcaaaatcaaaaacagaaatagccacaatattaactaaagaaataggtgaagatatatga

SEQ ID NO: 95 - DNA (genomic), 2004 bp, Enterococcus faecium; double-stranded, circular
  misc_feature (B) LOCATION 1...2004
  hypothetical: NO
  anti-sense: NO
gatgaaaaatcgaccgtgatgagacataatagatgtgttatcatgatcgattttttatttagaagggagtttctgcacattatgaatcagcgtcagcaatctttgatctatcaattaagtgagaacaataattatataacaacaaaaaagctagcagagcatttccatgtgtcagaaagaacgattcatagcgatttgaataccattgaaacttggttgagagacaaacatctgcctttaatgtttgaaagaaaaaaaggtacaggtatcttgttgaatggtctgcctcacgaaagggaacaactgaaacgagcgcttaatgaagagactcaaacagaaatggataaaaaacagcttcgtcagttattgattttccatctgctagtagcaaaagacggatttagtcttgaagaactttcagaaaaactatatgttggaaaacgtacgattcgtaaagaattgacagagttgcaaagcttttttgagtatcaccatttacagctagtatccaaaacaaaactaggaacttttcttaaaggcgatgaacaagaaaaaagacagttgcttgttaagacattacgaaatatgcagaaagaagatccacaaagtccgtcgttgaaagaattcttcgctaaagatacattaaaagttatccaacatacattacaagatgttttttatgaaaaccatttagaacagccgaatggactggctagtgtggagattcacatctactttatgctcgagcgaatgaaacagtaccagaaagtgaaattaagtaaagacgaaaacgaagtcgtggaacacacccaagcacaaaagttaagtagtcaaatattagcaaaactagccaccatctatccaattgaattttctcctgatgaaatcaattatctggctttgcgtatcgccaatctttttacaaattcacaagcagccacacgttttcaaaaggaatctagcgcacttgctgatcatttgatcgaacaagtggaacagtttctaggctattcattaaaagaagatcagctactaaaacaaaatttaaggtctcatttatcttcaacttattttcgactccattatggtttgcagatttctaatccattgacgaaaaatgtgtttagtacgtacacacaacttttcttagttttacagttaattttagaagattattttgaaaaggaaaatttttatgttccacaagaggagacagcttatttaacgatccatttccaagcagcgatcgagcgacacaaacatcagaaaagtagaagatatcaaacggttttagttagtgaatattcaaaagctatggctacttttctcgaagcacggctgaacagagaacttccagaattaacgattatggatctagttgaatataagccagaattaaagagacaagattttccctctgttgattttatcttggctacgttaccatttaaacatataagcattccagtaatcgagatctcaccaatgatcacagaaactgatctagcctatttgacaaaatatatgctggagcatgtgcctatcaagaagaaaaaaacatttgatctagcaagctttactcatccatttctgatctttcctcaacttgaacggacagacccagccgatattttaaactttatgggaaacgtcttagtggaacatcattatgtggagccggaattcatcgattctgtcttggaaagagacagtcactccagtactagagtagcaccatttgtaacaatccctcacggtaatccgctgtatgtgaagcattcgatgatttctattgctacaatgaaagaaccagtcctatggcacggggaacagatacgtatcgtactgctattagcaataaagaaaaatgatttgaaacatgcagagttcaaaaaaatattttctgttattcactatctagaaaagcagccagaacaaatggctcagttgatgcaatccaatcatccgctagaaatcttaacgttgttatctagttatgaataa

SEQ ID NO: 96 - DNA (genomic), 2298 bp, Enterococcus faecium; double-stranded, circular
  misc_feature (B) LOCATION 1...2298
  hypothetical: NO
  anti-sense: NO
agcatgaaatccaccaacaagagatcagaaagcaaaaacgtgcgatgttgtttcaacaaagcaaacaacaagaaagggagtgaaatcgtcatgatgaaaaccgttattttagcagaaaagccgtcacaagcgaaagcttatgccgatagcttctctaaagccacccgaaaagacgggtattttgaaatccaagatagattgtttcctggtgaaactgtgatcacgtatggttttggtcatttagtcgagttagattcgcccgatatgtacgatgaaaattggaaacaatggtcattagagcatttgcctattttccctacacattatcactatcatgttcctaaagataagaaaaagcaattcaaggtggtgaaacagcaacttcaatcggccgacaccattattattgcgacagatagcgatcgtgaaggggaactgatagcttggacgatcattcaacaagcaggcgccgatcatggaaagatatttaaaagactttggatcaactccttagaaaaagaagccatttatcagggattccagcaattacgagacgcagaagagacctatcccaaatttgaagaagcacaagcacgccagatcgctgattggttgatcggcatgaacggcagcccactgtatagtttactcttgcagcaaaaaggcataccaggaagtttttccttaggcagagtccaaaccccaacgctttacatgatttatcagctgcaggaaaagattagaaacttccaaaaagagccttattttgaaggaaaagcccaagtaatcgctcaaaatggcgcatttgatgcgaagcttgatccgaatgaaacccaagcgacgcaagaagcatttgaagattatttaaaagaaaagggggttcaattgggaaaacagccaggtacgatccaccaagttgaaaccgagaaaaaaagtgcggcaagtccacgtcttttttctctatccagccttcagtctaaaatgaatcagctcatgaaagctagtgccaaagatactttggaagccatacaagggttgtatgaagggaaatatctaagctacccacgaacagataccccttatattacagaaggggagtatgcgtatctgttggatcacttagacgaatacaaacactttttaaaggccgaagccattcctactcctattcatacaccgaatagtcgatatgtgaataataagaaagtccaggaacattacgcgatcattcctacaaaaacggtcatgacggcagcggcttttgaacaattaagtccactgcagcaggccatttatgaacaagtgttaaaaacaatggtggccatgtttgcgaaaaaatatacctatgaagaaacaacgatcttgacgcaagttcagcagcttcagttaaaagcaatcggaaaagtgccggtagatctaggttggaagaagttatttggaaaagagagcgacggaaaagagaaggaagaagagccgctacttcctaaagtgacaaaaggagaaatggtgacggtagatctacaagtccttgaaaaagaaaccaagccaccacaaccttataccgaaggtacgttgatcactgcgatgaaaacagctgggaaaaccgtggatagtgaagaagcgcaatccatattgaaagaagtagaaggaatcggtacagaagcgacacgggcaaatattattgaaatcttgaaacaaaaggaatatatcaaggtagagaaaaataagctcgtggtgacgaataaagggattttgctttgccaagccgtggaaaaagagccgctgcttacgagcgccgaaatgaccgccaaatgggaaagctacttattaaagattggagaacgaaaaggaacacaaaccacttttctagctaatatccaaaaatttgtctctcacttattggaagtcgtaccagggcaaatccaatccactgattttggatcgacgttacaagaagtgaaagcagccagtgaaaagcaagaagccgcgcgtcatttagtaatttgtccaaaatgccaggaacaagaagtcatactttatcaaaaggtggcagcatgtacgtctgaagtctgtgattttaaattatggacaacgattgccaaaaagaaactcacagcgacacagctgaaggagattattcaaaatagccgaacaagccaaccagtgaaagggttaaaaggtcagaagggttcgtttgaagcaacgattgttttaaaagaagacttcactacaggctttgaattttctgaaaagaaaaaaacgaacttcaagaaaagaacacgacgcactacaaaataa

SEQ ID NO: 97 - DNA (genomic), 270 bp, Enterococcus faecium; double-stranded, circular
  misc_feature (B) LOCATION 1...270
  hypothetical: NO
  anti-sense: NO
cacaagaaatcgatcatcaaaagcaggaagctattcgatatgctggtagaaaagggaaaagaaaatatttattacgtgaatgtagcaaaagttagagaagatgaaaatgagtggaaagaattcaagagtcgctactcaattaactcgactccgacatttacagtttacagagaaggatcgatagaaaaaactgttttttggactaaagaaagtggaatgtctttagctgaagtagaagagtttttggattatgttagtatgcaacagtaa

SEQ ID NO: 98 - DNA (genomic), 999 bp, Enterococcus faecium; double-stranded, circular
  misc_feature (B) LOCATION 1...999
  hypothetical: NO
  anti-sense: NO
acatggaaatcgaatgatatgggtgattattgttattgttggtatgcagttcatcggtcctgtcctttatttgatttttggcaaggaggatgcgtagtggctatcttgacacttgaaaaagtctcaaagtcttttggtacaaacaaattgctggatgatttatctttttctgtagaagaacagacgatttttggtttcatcggtaaaaacggtgctggaaaaacgacaactatgaaactaatcttaggtcttatcaaaaaagacagcggaacgatccgagtgaacggaaaagaagtagagtacggacaaacaacgaccaatcaagaaatcggctatttagctgatgtaccggttttttatgattatatgaccgattctgagtatttgatcttttgcggcgaactcacaggaatgcctaaacagcggataaaagaaaaaatcagtgaactgttgtcacttgtcggtctgtcgaatgaaaagaagcggatcaaaaaattttccagagggatgcgacaacgtttagggattgctcaagcattgttgaacgagcccaagttactcatttgcgatgaaccaacttctgctcttgatcctgtgggtcgaaaagaaatattagatatcttatcatctgtgaaagagcaaacgacgattttattttcaactcatattttatctgatgtggtgcgtatctgtgacaaagttgcttttttggataatggaaaaatcgtgttgtctggatcagtggacgaattgaaaaagcaaacaaatgctagtggatttgagatcgtatttttttccaaaaaagagcgcgaacaatttgaagagcttttacctggagggatgatccgaagtgaactgcgtatagcttatccacaaaaaagtaaagaagaaatgctttttgctatggatttgctagccaaatatcaattgccagtccaatcagtccagatggaagaacctacgctagaaaaactctttttggaggtcgttcaatcatga

SEQ ID NO: 99 - DNA (genomic), 2808 bp, Enterococcus faecium; double-stranded, circular
  misc_feature (B) LOCATION 1...2808
  hypothetical: NO
  anti-sense: NO
caaaatgaatccgttttctatgatggaggaggggtgaataagttgttgaagaaggaaattttatgttacttagagaaccagacagcctttttcgatttagaacatatgaacgaggtctttacagcacaaaggttagctgatcattttggggtaaaaagaaacacagtcagtcattatttgaaccagttaaatgatgagcaactactagtcaaaatcaattctcgaccagtgatttatttccacaaagaagcttttgaaaaacaattttttaagttacgcacgaatttttatttttctatcgatgatctcaaagaggaacagccttttttcgcgcaaccaaaagacttattctcttttatgatcggatacgacgccagtttgaaagaaagtatcgaacaaatcaaaacagctctttactatccagatggcggattaccacttttgattacaggcgaaagtggcacaggtaaaagttatttagttaatttggtctatcagtattgtctgcttcatgatctgctagaagattctgcaccattcatcacttttaattgtgcacaatatgcagataatcctgaacttttgactagcaatttgtttggacatgttaagggagcgtacactggtgcagaagaaaataaaaaaggggcttttgaagcagcagatggtgggatcttgtttttagacgaggtacatcgcttaacaccagaaggtcaggaaaaactgttcacctatcttgatcaaggtgtgatttatcgtatgggagaacctaatttgtcacgccggatcaaaacacgtctcttttttgctacgactgaagagattactagtcatttcttaacaactttcattcgaagaatacctatccgaatcgaactacctgcacttaatcagcgtagtcgtaatgaacggctagaactgatttactctttttttctcgaagaacaaagaaaaatggggagccctttgtcagtcagtggaccagctttgtcacttttaacaagtcagaaattatccggaaacataggagagctgaaaaatatcgtcaaagtttcagcagcaaaagcatatgctgaacagcgtgaacagcctgaaatccatgtcacgatccatcagttgcaaaaagaactacttgcgcagcctattactaaaaatacagcacagcaaggaatctatattacgcaagaccagaccttagagcaattaatggagaagcaacagcccgaacagcagcgaatcgttaaaagttttgagcaaatcctaattgatttcaagaaaaataactgtctgctatattcttgcgaaggaaaattaaagcaagaagtgattcaattatttgattttttgctgtttgagaccagtagacaagaaaaacacgagctgctggtttattggacacaatctatccgagagacctttcgacaaatggaaactgcctatcaaatcaaattcgatggaaacagtgtctatgccttgagttactatctctatcagcgaagcactatcaaatggttaccggaagaacatgatattatccaactaatcaaagaattagaacaacaagtttctcagtcttatccatctagttatcactatgtccaacgaattctggaattaagtaagatcaaattagatattgaagacacaagtatggatcggattttactgacgatctatctaaaaaaagcgaaatggtcaaaagaaaaacgactgccaaaagcgatgattgctgctcacggttatgcaactgctagcagtatggcaaatgtagtaaatcgtttattacaagaggatctatttgaatcatttgatatgccactagatgtcacaccacagcagattgcttcagaaatccttgattattgcgaaaacagcgatgtttcaaatggattgatcatattagtagacatgggatctctgaaagaaatccatcagttttttaaaaaacagttatccgtaccgcttttgattttgaataatgtgacgacacctttagcaatcacagtaggggaatgcctgcaaaaaaatgtatcattagaagagatagcagaagagactgttcgacagatccagccagaatggcgactgctctatccagaggaaaacaaacccaaagcactcattactacttgcttcactggaatcggtacggcggtccacttaagtgaactgctagaaaaaagcttacctacggcttgtcagttgaaaatcatcccatatgaatatcagcaattaaaagataagaaaaacagtgacccattattttccatatacgaagtcgtaggaatgattggcaccacagatcctgatatcaccaatatcgactatctttcattagaagacctcatctcgggggaaaagatgtctgtactagctgaatggttggacactactatgaatgcttcagagaaggaaatattcaatcagcgcatcattcgtaatttttcattggaaaaagtactggattccgtgactattctagatacagagaaggtgatgggagaaatcgatcattttatgagagaattagaggtgcagttgaatcgaagcatcagcaatcccaaaaaattagcgttgtatgtccatgtgagctgtctcattgaacgattgatccgacaaatgccaatcgaaacctatcaaggattagagaaatggaagcagtgtcaaaaagaagggttatctgctattaaatctgcgtttagtgtcattgaagagcattatagtgtcatgatccccaattctgagattgcctatatctatgatattttgagtgaagatacagagtttctctcgatagaagaattttga

SEQ ID NO: 100 - DNA (genomic), 1128 bp, Enterococcus faecium; double-stranded, circular
  misc_feature (B) LOCATION 1...1128
  hypothetical: NO
  anti-sense: NO
atggcttttttatttgtctcgcttaattatacaaacggcgaagatatcaatgatgatggctcaagaaaaaaagtggagaaagttggcggagacacccgaccagaggccgaagctgctttacgaaaagttttatcagatattgacgaaacaggacaatactttttaggtacggatactcgagtaaaacaataccttgatttttggatggaggaatacgttaaactaaatctaaaatacaatacctatgaaaactaccgatttaccatcaaaaatcatataaacggttatttaggaaagaaaaaacttacggatctctcccctgctcttttacaaaatttcatcaatgctgaatttaaaaagggttactcgaagaaaacaatgactattactcactctgtccttaagaatgcgctgaatatggcggtttatccttggggattaatcaagcaaaatcctatgctgtatgtaaaaataccaaaatatgaagcacgaccaacgactaaaaaagatctaaaaatcatttctcttgaggactttgatcatatgctagaaattactcctgaaggacatcctttctatattcctttgaatattggattttatacgggaatgcgcgttggcgaagtttgtggtctgacgtgggatgatgtcgatttttcaaatggaacaattactgtagagaaacaaatggtaaagaatgacggcgcatgggtatatggtacgccaaagacaagcagttccaatcgaacgatttttattggacaaaccttgctagcaattctgaaaaaacataagaaacaacaattagaaaatcgaatgaagtatggaaagctctacattgattcaaatgcagtatgtacgaaggaagacggtgagctagttacgccaagtgtagtgaaatggaatactaggaggatatcgaatgcactctccctctcttttaacttccattctctcagacatactcatgctacacttcttctcgaaaatggcgcaaaaatgaaagaaatctctgaacgattgggccacagcagaatttcaattacgatggatacttactcgcatgtaacagataagatgagaaatgaaacggtcgatatcatggaaaatcttagaaagaattcttga

SEQ ID NO: 101 - DNA (genomic), 759 bp, Enterococcus faecium; double-stranded, circular
  misc_feature (B) LOCATION 1...759
  hypothetical: NO
  anti-sense: NO
atggcttttttatttgtctcgcttaattatacaaacggcgaattgaaaaaaaggattttagtaacaattggtctagcttttttgttagctggttgtaccaacgggaatgaatcgaaaaaagaatcaacaaaagaaacagcgaaagcaacagttgcaactactacaacaactagcacagagagcaagtcaactgcagcaagtacagaaacagcagatacctctacttcgtcagagtcttccaaaacgactgaaacaactcaaacatctacttcaagttcttctgtagaggcttcatcttcctcttcagaaagcagcgaacaagttgaacaaacactgtggaatgcagacaaatccgcacaattagaggcatttatgaccaaatggggccaaacaatgggacaacaatacaaaagttatacgaatcaaatgagtgtggacttatatggtcttaaagtccctcaagctattttgaacggggagtggaagatggctattggtggagtgcctgtttctgcagaatggtcagaaagtgggacaggtcaagcagactatcaaatcacagccgtctattccgatgcagagacagaaccatatctgaaaaagcacgtctatctattcgggtttcagcaaaatcagccaaaagtattggtgacacaacaaaatcaggggaatcccgataattatctttacttcaacgagacagcgaataatgaattgaaaaatggctttaatcaaatcgtttatggacaagcaaattaa

SEQ ID NO: 102 - DNA (genomic), 228 bp, Enterococcus faecium; double-stranded, circular
  misc_feature (B) LOCATION 1...228
  hypothetical: NO
  anti-sense: NO
acaatccgatcagttttcacagtaaatgaaagattctcatttgcccgttcatttgcagaagtactgattccaatcattgctgcaattatactcagcccaagaataacaaataatacggtcgctgttttcttcatttctatcactctccatataattaccttctatttgataaaggaattatataaaatgaaaatgatgagaacacgacagtcagttgtgaaaatctaa

SEQ ID NO: 103 - DNA (genomic), 414 bp, Enterococcus faecium; double-stranded, circular
  misc_feature (B) LOCATION 1...414
  hypothetical: NO
  anti-sense: NO
tccagacgatcgaaccaaaagatgtcttccccgggggtcgtgcctttactggattctttaaaagaagaaaaaatcaagattgctcttgcttctgcaagtaaaaacgggccattcctacttgaaaaaatgggtcttacaccttactttgatgctattgccgacccggcagaagcaacaaacggaaaacctgcgccagatatcttcctccttgcagcaaaagctgtcggactaaaagcagaagaatgtatcgggatcgaagacgcgcaagccggtatccaagccatcctctcaagtggcgctcaaccaattggcgtgggacgtgctgaagaccttggagaggagatcccgcttgtccctgatacgacttttcttacgatcgattacttgaaagaaaagtggcatgaccatggataa

SEQ ID NO: 104 - DNA (genomic), 1239 bp, Enterococcus faecium; double-stranded, circular
  misc_feature (B) LOCATION 1...1239
  hypothetical: NO
  anti-sense: NO
gaagatagatctttcctgcgaatcctcactagcttttttgtaggaaggggcagcaaaatgacaaacaaagtaagagagctaggtgtatcttcgattgaggaaatgtttgatttagccacttatgcatttaatggggcagatacacctgaaaggcgagaacgttttcgtacacttgcggagaattcttggaattacggattttttgatgaggaggatcggctaacaagtcaagtcatggcgaccccttttccagtgaatttttacggacaagagtacctaatggccggcattggctatgttgcttcttatccagaagcaaggggacaaggcgggatcaatcagatcatggaaaagatccttgaagattgccgtgatcgtaaagtaagcttatcttatctggcgccattctcctatcccttctatcggcgctatggctatgaacaatcatttgataaaatcagttatcaactaaacagtcgtgatgtgccgtttatcaaaaaaaaatctggaaaaataaagcgtatggattttgaagatgcaaaagctgcaatcagaagaatttatgaacagatgccggaaaaccaacgagctggtctgaagcgcgaagactggtggtatacgtataaattcaagcaaaaaggcaattaccagtttgctttgcattttgatgataatgaggaagcaacgggatatatcgtttatcagcttgcaacgtcttcctttattattgcggagtggggatttttggatcatgatgctttttgcagccttgttcgcttcgtaagttctcacaatggtgcttttgaaacatttgaatattcatgcggctacggcggtaatgatcaaaattatctattagaaaatccatttgcttctgtaatgatcacaccttatatgatggcgaggatcgtagatatttctttgtttttggaaaattatccatttaaaaagagacaagctgcatttgccctacaaatagaagaagatcattatgcgaaatggaatgaaggaatcgtggaagtaacaatcgaaaatggaaaaaatcatctctcaaaagtagaacaaacaaaactcccaatcgttcgaggaagtatccaacatatcacgcagctattattagggtatcgtaaagtggaagagttggtattccaagaaagaatacaggtgacaaaagaatatgaagaaacgttaagctcaatcttgccacagcaacagccaattcttaatgactatttttga

SEQ ID NO: 105 - DNA (genomic), 990 bp, Enterococcus faecium; double-stranded, circular
  misc_feature (B) LOCATION 1...990
  hypothetical: NO
  anti-sense: NO
tacagcagatcccggaagaagaacttgaagaatatatggaggaacatcttgatgactaagctagtatttatgggcacacctgctttttctgtgccgattcttgaagggctgatagaatcaggttacgagatccaggcagtggtaacacagcccgaccgtccagttgggcggaaacgagtaattacgccgacaccggtaaaagaagcggctctgaagcacggtatccgtgtgctgcagccagagaaaatctccggttcgccagaaatggaagaaatcattgaattggtgcctgatgtgatcgtcactgcggcatttggccaattcttgcctgaaaagttattgcaagtaccaaaattaggggcaatcaatgtccatgcttctttacttcctaaatatcggggaggtgcgcctgttcattatgccatcatgaatggggagaaagaaactggtgtaacgatcatggaaatgatcaaaaaaatggatgcaggcggaatctatgcgcaagaaagcataccaatcactaaacaagatgatgtagggacgatgtttgaaaagcttagccttttaggaagaaagctattgctagaaacattgcccaatattttggatggacaaaaaccagtacctcaagacgagtcagaagcaactttttcgccaaacatcacacgggaacaagaagcaatcgattggcataaaactgcagaagaaattgacaaccaagtacgcggaatgcgtccttggccaattgcattcacgacctatgagggcatacgctggaaattattatcggttgaagtattggcagaaactacagacaaagcacctggtacgatcatccggaaagacaaaaaaaatctatggattgcttgcggtaaacagaccgtcttagccatcaatgaattacagccagctggtaaaggaaaacaggccgtacatgatttccttaacggaagcggtcagcaagttcagattggtcagcaggtgaaataa

SEQ ID NO: 106 - DNA (genomic), 1383 bp, Enterococcus faecium; double-stranded, circular
  misc_feature (B) LOCATION 1...1383
  hypothetical: NO
  anti-sense: NO
aataggagatcgacgatgaataaaaatatttctttaaaagaaagtatcgctgtattgatcgtgttgttggcactcctaggagtactgatcatcggattccagctctcgccacatatcccgatccttgcagctttcatgtgtttgttgttttatggcagatttaaaaagttcacatgggatgagatccatgacgggatcatcaaaggaatcactccagggatcattccaatcctgatttttcttttgattggtgtcttagttgcttcatggattttatctggaaccatccctacgattatggtttatggatttaaacttgtttctgtgcgtttctttttaccgacagcatttcttgtttgtgcaattgtcggagtgactgtcggcagttcatttacaacgatttcgacgattggaattgcttttttggggatcggtcatttacttggattcaatgatgcaatgactacaggcgcagtcgtttccggtgcctttttagggaataactgctcgcctttatcagatacgaccaacttggcagcgggtattggaggagttaatctattcgaacatatcgctggtatgcgttatacggatttcccagcattcgtcctttcgttgattttttatacgatattaggacataacagtcattcagccgatctagctagtatcaatgaaatgatccaaaacatgaaagcgagcttttggatctctccttggacattgattccactagttattttatttgggggggcaatcaaaaaaattccggctatccctacattactagcgggatcgacagctgctctcgttctttcttttatccatgagaaaagtttgacggtcggaaaagcagcagacatcttgatgaatggttatgtcgcaaatacacctgatccaaagctagatgaactgctttctcgaggcgggatcatgagtatgttaggttctgctagtttgattttacttgcattggcattaggtgggttactgatcaaatatctgatcgttgataccatcgttcaagaattaaaagaaaagatggaccgaccttctcgtttagtcgggtttactgccttgagctgtatcggaatcaatctgatcgttggagaacagtatctgtccatcattcttccaggagaaacattcaagcgttcttttgatgacgttggcttatcaaaaacctatttgacacgaacactagcggattcaggtgcgaccgtcaattctctcgtaccgtggggagtcagcggcacattcattatgggaacgatgaaagttagcgcgttgcattacttgccattcgcctttttctcgattcttgcacctgtctttacaatattaggcggttttttattgaatcgtcgacgtgtaaaaaattga

SEQ ID NO: 107 - DNA (genomic), 807 bp, Enterococcus faecium; double-stranded, circular
  misc_feature (B) LOCATION 1...807
  hypothetical: NO
  anti-sense: NO
tgttttggatcgtgcaatagaagccggaggtaccacgattcgcagttatttgaatgcattaggagaatcaggcggatttcaagtagcactgcatgtctatcagcaaactggcaaaccatgtatacgttgtggaacgccgatcgtgaaaacaaaagtggcacaaagggggacgcactattgtccgaattgtcaaaggctaaaaatcgcaaagtaggatttgttttaggtttgacgggtggaatagctaccggtaaaagtacggcagccaaagtctttcagtctcatggatttcctttgatcgatggcgatgtgattgccagagaaactgttgagcctggaacgcttgctctgaggaaaattgtatcagtgtttggccaagaggtattgcagcctgatgggcaactagatcgagggaaacttgggatgattgtttttccatcaaaggaaaaacggcaaaaacttgatcagctattagatccgtttatccgaaaagcgataaaagatcaaatcgcctctctaagttccaatcatcctttagtaattgtagatatcccattgctctacgaaggtcattatgaccactatatggatgcagtagctgtcgtttatactacgccagaaactcagcttcagcgtttgatgaaacgtaatcaactgacgctagaacaagcgcagcagagaattagtagtcaacttccaatcgaagaaaaaaagcagcgtgcggatattttgttcgacaacaatggaacaaaagaaaaacttgtgggacaaatcgaaaattggctttttgctaatcgctttctttga

SEQ ID NO: 108 - DNA (genomic), 537 bp, Enterococcus faecium; double-stranded, circular
  misc_feature (B) LOCATION 1...537
  hypothetical: NO
  anti-sense: NO
tcaattggatcgttcagttctgtaaaggcattagcaaattcgcgccccactatgaatagttcgaatcgatctgtgaatcgaggatcttctggatttttcttcgctaaaggcgaaacttcgactggatgtccgtatacaaacgtcggttgtgtcaatgtttcttcaacaaatgtttcaaagaattcattgataacatgtccgacacccatagcttcggttacttctacattgtgtttttcggctaaagctaatgcttcttccaatgtcatttcttgccagaagtctacaccagtttgttctttgattgcatctaccatatggatgcgtttaaagtcactttctaagtcgacagcttgtccatcatatgtgatttttgctgttcctagtactttttcagctgcgttacggataataccttctgtcagattcattacatcattgaaatcagtatatgctgtgtatgcttctaacatcgtaaattctggattatgtgtagtatcaattccttcattacggaaaacgcggccgatttcataa

SEQ ID NO: 109 - DNA (genomic), 519 bp, Enterococcus faecium; double-stranded, circular
  misc_feature (B) LOCATION 1...519
  hypothetical: NO
  anti-sense: NO
ggggctggatcaccaccatttaacacagagccctctggttctacaccgattatcaataaagaattagagaaaacgggagaaccagtgacactttctctggattgttttcctacacaaaccaaacaagagcttattcatttattgacagaaaaaagtaaagccaccaaaaagaacttagtaaatgcttggcatggtctattacctgagcgattgttggttttctttcttgagcggcttgaaatggatagcctaacaggacaacaagcctctcaaaaacaaattcaagatttcgttcaattatgcaaagagtttaagctaccagtcaacaagacttttcctattgagaaatcatttgtaactggcggatgggtttctctaaaggaaattcatcctaaaacgttggagagtaaaatcattgatggtctgtattttgccggagaattactggatgtcaatggttatactggcggctttaatatcacagcggctttcgctacaggacatgttccaagaaggaat

SEQ ID NO: 110 - DNA (genomic), 1317 bp, Enterococcus faecium; double-stranded, circular
  misc_feature (B) LOCATION 1...1317
  hypothetical: NO
  anti-sense: NO
tgggatggatcagtctttttttattttcaaaaaggaggaaatcatatgttagatgtaaaaatgatgcgacaaaatattgaagaagtacaagaaaaattgatgactcggggcgtaaaaaaagaaacattagctgaattcatggaactagatgaaaatcgtcgtaagctactagtcaaaagtgaagaattaaaaaaatatcgaaatgatgtttctgctgagatcgcccaattgaagcgtgcaaaagaagatgcttctgctaaaatcgctgaaatgaaagaagtcggtggcaacatcaaagcattggatactgaaattgctgaagtggatgaaaaattgaaacaaattgcaactactttgccaaaccttccccatgattctgtgccagttggaacagatgaagaggacaatgtagaaatccgtcgttggagcgaaccacgtacatttgcttttgaaccaaaaccacactgggaaattgcagaaaatcttgatattttagattttgaacgtggcgcaaaagtagccggtagccgttttgtctattacaaaggattaggtgctcgattagaacgtgctgtctacaacttcatgcttgatcagcatatttacgaacacggctatactgaaatgatcactccttatatcgtcaacagtaaagcgatgtttggtacgggacaatttccaaaattcaaagaagatgttttccaattggagaatactgatctaacattaatcccaacagctgaagtaccattaactaactattataatgatgaaattttagatggtgcagatttacctatttatttcactgcactaagccctgcttttcgttctgaagccggaagtgctggtcgggatacacgaggactgattcgtcttcaccaattcaataaagtagaaatggtcaaattttcggatgtagagcattcttacgaagaattggaaaaaatgacagctgatgcagaagatatcttgaaaaaattgcatttgccttatcgtgtgatggccttatcaactggagacatgggcttttctgcagctaaaacttatgacttagaagtatggatacctgcacaagatacttatcgtgaaatcagttcttgttctaactgtgaagatttccaagcacgccgcgcaatgatccgttatcgcgataatgatggaaaaatccactatactcatactctgaatggttcaggacttgcagttggccgtacagtagctgccattttggaaaactaccaaaatgaagatggttctgtcacagttccagaagcgctcgttccttatatggggaatctgaaagttattaaataa

SEQ ID NO: 111 - DNA (genomic), 375 bp, Enterococcus faecium; double-stranded, circular
  misc_feature (B) LOCATION 1...375
  hypothetical: NO
  anti-sense: NO
gaattcggatcctcacccttagcgctgcccggtatgaatgggcatgaacttctacgtgaatttcgggcgcaaaatgatacccccattctgatgatgacagccctgtcggatgacgaaaaccaaatccgggcgtttgatgcagaggcagacgactatgtaacaaagccattcaagatgcggattttactaaagcgggtggaagccctgttacggcgcagcggtgcgctggcaaaggaatttcgtgtgggcaggctgacacttctgccggaggattttagggtactttgtgacggtacggagctgcccctgacacgaaaagaatttgaaatcccttttgctgctggtgcagaacaaaggcagaaccttaacccatga

SEQ ID NO: 112 - DNA (genomic), 1212 bp, Enterococcus faecium; double-stranded, circular
  misc_feature (B) LOCATION 1...1212
  hypothetical: NO
  anti-sense: NO
atgtccggatcacggacggtatggtcaaacccggagacaaaatcaaacttgatgagtaatggcaaaacatttgatgttacagaggtcggggtcttctcgccaaaagcagttgctagagactttttgatggtcggtgatgtcggttatatcacagcaagtatcaaaactgtccaagatacacgagtaggggatacagtaacgttagcagacaatcctgccgctgaagctttaccaggttaccgaaaaatgaatccgatggtttattgtggtctttatccaattgatacttctcgttacaacgatttgcgggaagctttagaaaaactgcaattgaatgatgctgctttacaattcgaaccagaaacctctcaagcattaggttttgggttccgctgtggattcctcggacttcttcatatggatgtcgtccaagaacgcttggaacgggaattcaatctagaattgatcacgactgcaccatccgttatttaccatgttaataaaacggatggtacgactgctacagtagataacccggcagattttcctgaacctgtaacgattcaggatgtagaagaaccattcgtcaaagcacagatcatggtcccaaatgattttgtcggtgcagtaatggaactttctcaacgaaaacggggagaattcattacgatggattatttagatgattaccgagtaaatgtcgtctataatattccgctttctgaaattgtctttgactttttcgacaaattgaaatcaagcacgaaaggctatgcctcattggattatgaaatgtctggttatcaaaaaagcaagttagtgaagatggacatcttgctgaatggagaaaaagtcgatgcattaagctttatcgttcaccgagactttgcctatgaacgtggaaaagcaatcgttgaaaaactgaaaaaactaatcccacgccaacaatttgaggtgccaatccaagcagctattggacaaaaaatcgttgcccgttcagacatcaaagccttgcgtaaaaacgtcttggctaaatgttatggtggagatgtttctcgtaaacgtaaactcttagagaaacaaaaagaagggaagaagcggatgaaacaaatcggctccgtcgaagttccgcaagaagccttcatggccgttctgaaaatggacgaggacgaaccgaaggaaatagcaagggtttgtttgaaaacagtgtaa

SEQ ID NO: 113 - DNA (genomic), 1185 bp, Enterococcus faecium; double-stranded, circular
  misc_feature (B) LOCATION 1...1185
  hypothetical: NO
  anti-sense: NO
gggaggggatcgcaaatgatctcaaaagagaaacggacaagcattctttacagttttattgcattgctgttcagtattgcgctgtacttcaatgcaaatggccagtccgttccaaatacgctttctggaaatgaagcgtataatcaaacagttacgggggtgccgatcaagatttcttatgattcaaagcgctactatatccatggatatgaaaatgcagtgactgtcaaactttccagtgcaaaccgagttcagttgaatgcagaggcaaacgaagatacacggatgttccgcgtcacagcagatatcactaagctgggcgaaggaacacatgaagttccgctaaaaattcaaaatttgagcagtgctgtcacagcaaagatcgaaccatcgactattacagtaacggttgagaaaaaggtaataaaagatttcgatgtggaaacgttgattccttcaacgttcacaccatctggatatgaacttgatgatacttccgttagtcctaaaaaagtctctatcactacaggtgacaaaacattggcagaaatcaaacgagtagtagctgatgtggacgcttcgatggtcacagatgatgggattaatagtgaggtcccaatacaggcgctgaatgcagcaggggaagtattaagtatcgtctctgatccagtgcaagtaacagtgagagctgattcgatcaagccaagcaagtcggtacgactttatgggatacagcaaggaacaccagctgccggggtagaaagctatgatttcagtttttcaaaactggaagcagaagtaagcggctctagcgatttgcttgcatcgatcggtgacagtattgctgtaccgatcaatgtctcaggtatcaatcatcgaacaactcgtaaaattgaaataccagtagaagaggggttaagtatcaagcccgaatcagttagtgtggagattacacccgtgttgcaaacgtcaagcagtagctctgcttcgacgagcagtcggacacaagaaaatacaagtacgagtagaagtatttcatctgctgattcaggaacggaaccatcgacaacaaccatttcttccagttcggaatctgggacaagcagctcgaccacaagtacagaagaaacatcagaaacaagcgaatcaacacaaatgagcagaacaaattcctcagaaaattaa

SEQ ID NO: 114 - DNA (genomic), 210 bp, Enterococcus faecium; double-stranded, circular
  misc_feature (B) LOCATION 1...210
  hypothetical: NO
  anti-sense: NO
gagcttttgtcatcgctcaaggctgaacgtttctttcaccacctctccactaaacggtgttctcctaccaactggtcacaagtcacaatattcatcaaacatgagaagctgttttttgaaattgttccttgtgactggaaactaagcggttccttcttatttcttgaagctgaccacttctgtcacaacctctttaagaatgatggatag

SEQ ID NO: 115 - DNA (genomic), 1083 bp, Enterococcus faecium; double-stranded, circular
  misc_feature (B) LOCATION 1...1083
  hypothetical: NO
  anti-sense: NO
acaattttgtcaataaaaattttttatttttttgaggagtgtgtaaaaatggttggaattagagatgtcgcacgaaaggcaaatgtctctcctgctacagtttcccgtgtgttgaataacgatcagacgatccatgtggctcagactactcggcaacggatagtagaggcagctgctgcgttggattatgacatcagtactcgtaaatatatcaaaaagagaatgccttcgattggtgtgatctctacgatcggcaaagcgagcgaagaacaggatatctattacaaacatttgcgagtagggatggaagaagaagctcgacgtctgcatttagggatgaatcgaatctataatctatctgataatcctaaacaatgggaagatctagatcagttaggtgcggtgatcgttgttgggactgttacgaaagaatcgattaccgccttgttaaaacaaaacatgcaaatagtcgtcgtggataaccctgacatccagcaagaggtcgatatggtgtatgcagatcttgaacggatgactaaaaccgtactggaattgttcttagaaaatggtcataaaagaatagcctatatcgggggatataaagtcgatatggatgaattcggtgggaagcagatttctataaatgaaaagaggatgcgtgcctatcagcattttatgatcgatcatcacttagaaaaatatatgtcttatcatctaggtggctggacagaaaaacaaggtgaggtacttgcgactaatctattagaaaatgaatcccctcttcctactgccattcttgtcgggagcgatccaatggcaattggtgtctatcgggcattgaaacaaaaaaatatccaaattggagaagagattgttgtagcaagctttgataatatcgagacaatcgcaaacctctcccctggcttgaccagtgttcaaatcaatgcgaaatcaattgggcaagcagctgttcgaatggcattggagcgaattgacggtatacgggacgaaccaatcattttgacttatcctgcacgattgattgttagggaaagttttatcccaagaacaaaaaggtattga

SEQ ID NO: 116 - DNA (genomic), 345 bp, Enterococcus faecium; double-stranded, circular
  misc_feature (B) LOCATION 1...345
  hypothetical: NO
  anti-sense: NO
agccctttgtctcggcgcaaatgccgtgggtacttcaggaaccgtactgacgcatctgatgaatcacggcgtagaagaaactattatactgatgaagcaatggcaagaagagcttcgtctgctttatactatggtcggcgcaacgaataccgcggccctacaccaacaatctctgatcttttccggaccagtgaaggattggtgcgaagcaagagggatcgacttagtgaagtatggaagacgcacagaaaagagcgtgggacaaaagtaaagaacacttttgtctcacgctctaaacacgtacaaacggcggaagtaaaagcaactccttcggaaataagctga

SEQ ID NO: 117 - DNA (genomic), 780 bp, Enterococcus faecium; double-stranded, circular
  misc_feature (B) LOCATION 1...780
  hypothetical: NO
  anti-sense: NO
gaattcttgtcaataatgcaccttgcggatatgtttattggaaatagtgaatggattggagcaattgccggtacggtcggacatttagctgtttttttactagctttatttcttgctagtaaggtcgaaggaaaaagaatagaagattatggtgtttctgttcgaggaaaagactgggggtatttagcgggaggtctcgttgttggaattggagtgtttctgcttattactagtccattatatttgacgggggcgtatcggttagattcaggaaacgcaaacattgtgccgctgataacgagttttattttatttattgcagtgggggcatcagaagagcttttattccgtggcttttttcagcatcagatgcttagatttggtccgttaatagcaatgattggatctgctgcattatttgctcttttgcacggattgaatcctaacatgacatttctggcagttttcaatatctttttagcaggttgctttttcagcgcacttatctacagtacaggaagtttatttacggctattggtgctcatattacttggaattggacacaaggagctattttgggtataccagtcagcggaacgcaagaacaaggttttttctccactctgatccaatcgcaaaatacaataattactgggggaaactttggggctgaagcatctatatcaactacattattcttgttagtcttgattgttggtttgttactctatgcatataaaacaaagcggatgaagaaatacactgctgtttatcaataa

SEQ ID NO: 118 - DNA (genomic), 324 bp, Enterococcus faecium; double-stranded, circular
  misc_feature (B) LOCATION 1...324
  hypothetical: NO
  anti-sense: NO
cttaagttgtcgataataaagagatttattaacggaaaaagaataagtttttttaaaataacgtataaaaaagagcataaaacaaagtcgtttgttttatgctcttcttttattattttgtgctttttattttatcaaatcactttgtttttttataaaatttctgcgcctagtgtggactcaaaatgtctcaatgcccattcatgtccaacgggatcgaaacttgccacggaatctttgaaaatatggagtttgtatcctaaattatacgcatcgactgctgtatgcaacacacagatatctgtacatacgccggtcaaataa

SEQ ID NO: 119 - DNA (genomic), 1050 bp, Enterococcus faecium; double-stranded, circular
  misc_feature (B) LOCATION 1...1050
  hypothetical: NO
  anti-sense: NO
gccatcatgtcggtttttgttacttttgtattcggctattatttatcaaaatcttatgacgttgaagtatttttcggtggtgccgtgtcttttgccagcttcttgattcttacgccttttgcaatgaaaaccgctggcggtgaagatgtgactggtgtgctttcacttgatcgtcttggcgcaaaaggaatgttcattggaatgatcgctgctttcttggctggagaaatctactgcagaatcacgaaacgcggctggcagatcaaaatgcctgatggagttccgcctgcagtaacaaaatcatttgccgctttgatccctgctgtagtgacactaactattttcttagtaatcaatgctgtgatgactggtattttcaatgctaacttacatgacgtcgtttatgaagtgatccaaaaaccattaactggtttgggaagtagtttacctgcaacattgattgctttgttctttgtccaattcttatggttcttcggacttcacggacaaatcatcgtcaactctgtaatggacccgatttggaatacactgatgcttgataacttagaagcttatcaacatggaaaagaattaccacacatcatcacaaaaccattcatggaaaccttcactgttggtattggtggctctggaatgactttagctgtcgttttattgatggcctttgttcttaaaaagaaacagtatcgtgatgttggacgattagctttagcacctggtattttcaatgtaaatgaaccagcgattttcggtttaccgatcgtattgaatgcaacaatccttattccttgggttgtggcacctctaatcgtaacgacgttcaattatttggtaatggctgctggacttgtccctgcaccaactggcgtctctgttccatggactgtgccaatcattgcaagcggtgtcttagcaacaaattcatggcttggtggtatgctgcaagtcatcgactttgtcatcgttgcctttatctggtacccattcctgaaagtactagataaacaaccagatttagatattgcttaa

SEQ ID NO: 120 - DNA (genomic), 729 bp, Enterococcus faecium; double-stranded, circular
  misc_feature (B) LOCATION 1...729
  hypothetical: NO
  anti-sense: NO
agagacgtgtcgtcagcagtacatacgattcggcaagcaatcgctgtgttggtaaatgagggctatctgcgtaaagaaaaagggtcgggcacatatgtagatgacagctataagaaagaaaaaacaccattgaacagaacaaaaacgatcggtgtcatcaccacatatctctctgattatatttttccgtcgattatccgaggaatcgaaaatgaattacgagaatctgggtattcattgcttttagccagtacgaataacgatcacgaattggagaaagagtgtttgaagaaaatgattgcttatggggtagatggtttgatcgttgagcctacgaaaagtaatcagtataacccaaacttagcactttatgttgctttgagagaacaaggcattccgatggtgatgatcaatgctgcttatgaagagttaaatgcctcttatatttgtttagatgatgtgaaagtcggttttatggcagcagaatatttgataaaaaaaggacatcagcgtctgttgttcatcacaaaaatcgacgatcttcaaggaaaatacaggatgaaaggttttatcagcgcgtgtgaacagtataatgtgcgttttttgacggaagatatcattactttcaccacggaaacacgagaaacaatcgctgaaaaaacagtacaacggttgaaagaagaacaagctttagatggcatcatttgctataacgatcaaaatagctag

SEQ ID NO: 121 - DNA (genomic), 708 bp, Enterococcus faecium; double-stranded, circular
  misc_feature (B) LOCATION 1...708
  hypothetical: NO
  anti-sense: NO
tggacttcgtcaatagcctgccgcaagacgacgaacaattggctaaagagatcgtcacttttgcaaatgcttcgaataagtagggggagtaaagtgtataaagacggtttaaaaagagggatagattttttattatctttagttggtatcatcgtattgtcaccgatccttttgattctatgtatagctatcaaaatcgattcaaaaggtccagtcatctttaaacaaaaacgggtaggaaaaaacaaatcccatttttatatttataaattccgaacaatgaaagtagatacgcctcaagagacaccaactcatttgttatcaaatcctgacttttttattacacgagtaggaaaattccttagaaaaacaagtctggatgaactaccgcaattatttaatatattaaaaggggacatggcagtcatcggaccacgcccagcgctatggaaccaatatgatttgattgaagaacgagacaagtaccacgcaaatgatatccgtccaggactaacaggcctcgcacagatcagtggacgggatgaattagagatcgactacaaagcacgtttagatggacagtacacagcaaatgtcacgccatggatggatctaaaatgcttttttggaaccataatctccgtctttaaaagcgacggcgttgtcgaaggcggaactggttcggtgaaaaaggaggatgcaaaatga

SEQ ID NO: 122 - DNA (genomic), 243 bp, Enterococcus faecium; double-stranded, circular
  misc_feature (B) LOCATION 1...243
  hypothetical: NO
  anti-sense: NO
ctggattcgtctgaagccaaccatgcagctgtcgccgctatttcttttggttcacctacgcgtcctagtgggatcatactttccaagagttctttttgttcaggatcatcaaattttgccgcattaataggtgtacggatagcaccagggcctatactattgattctgattcccttcggtgcatactccattgctaccgtttcggtaaataattttaccccgccttttgaagcagcgtactga

SEQ ID NO: 123 - DNA (genomic), 1137 bp, Enterococcus faecium; double-stranded, circular
  misc_feature (B) LOCATION 1...1137
  hypothetical: NO
  anti-sense: NO
agaaaaccgtccaaaacggctgaagaaaaacagaagagtacgcgagggggtggcacggctgcgatgaaaaaattacaatctctgtttttaggtattctcatcattattgcggtgctgctgcttggtgttcgtcaacttgaaaaaacaagtggcatgagtggagcaaaggtacttaccatctataactggggagattatatcgatcctagtttgatcacgaaatttgaaaaagaatatggatacaaagtgaattatgaaacatttgattctaatgaagcgatgttcacaaaaatccagcaaggtgggacaaactacgacatcgctataccaagtgaatatatgatccaaaaaatgatcaaagaaaaactagtacttccattagatcattcgaagatcaaaggattaaataatattgatccacgatttttagacttggattttgatccagataatcagtattcgattccatatttttggggaactttagggatcgtatataacgataaattctttgatgcaaatcaaattaagcattgggatgatttgtggaagccggaattaaaagacagtttgatgctgattgacggtgcacgagaagttatggggctttctttgaatagtttaggctattctttgaatagtaagaatatggcacagctgacagaagcagcaaataaattgaatcatttaacaccaaatgtcaaagcaatcgtggcagatgagatcaaaatgtatatgatcaatgaagaagcctccgtggcagtgacattttctggcgaagctgccgatatgatgtgggaaaatgaacatttacattatgtgatcccaccagaaggatccaatctttggtttgataatatcgttatgccaaaaaccgtgaaaaataaagaaggtgcctatgatttcatcaactttatgctagaaccggaaaatgcggcacaaaatgcagagtatattggttattctacaccaaatgaagaagcaaaagcgttattgccaaaagacatttcgtcggacgaacaattctatccatctgatgacacgatctcccatcttgaagtctacaaagatctaggatcgaaatacctaggcatctataatgacctattcttagaattcaagatgtataggagataa

SEQ ID NO: 124 - DNA (genomic), 243 bp, Enterococcus faecium; double-stranded, circular
  misc_feature (B) LOCATION 1...243
  hypothetical: NO
  anti-sense: NO
acatatcagtcgattggattaatccatagcaaaattctgttttacgatacttatgaaataaaagaacatagacctatatttggtcctatgtatcgattagttataaatgattatcagcccgatttgatttctagtttttattgcaacttgatgcaaacacaatctagaaatacagctgtcatagcctttaaaataattcgtaagtccccctcctatctatcaaaatgtgacttgactgcctag

SEQ ID NO: 125 - DNA (genomic), 657 bp, Enterococcus faecium; double-stranded, circular
  misc_feature (B) LOCATION 1...657
  hypothetical: NO
  anti-sense: NO
agatttaagtcgctatattttataaaaaatcggaggacgacaatgacagacttgctaacgaaaacccgcaagataaacacacttttgcagcaaaagaatacttttgacatgcaagcagatttgccttacgataaaatggctgtcacactaggtggtattcttgacagcaacacctatatcataggaagtgacggagtattactaggttataatgaacgtcacgatgtgaacaatgaacgaatcaaaacaatgtttgttgagaaacaatttcctgaatcttatactgatacagtggcacagttgatgaaaactgaagctaatatcccaattactagtgatattactgcatttccggtagagtcaagagagaaatatccatttggtctgacgactgtcgttccgatctttggagctggcgaacgtttgggtacgattatcttatctcgtatggaacaatcgtttgcagatgacgatctagtcttagcagaatatggagctacggttgtcggtatgcagatcctttatcagaagtctcgaagcatcgaagcagatgtacggagtgcaacggctgtccaaatggcaatcaacacattatcttatagcgaattgaaggctgtacaagctatctttgaagcattggatggagatgaaggtcgt

SEQ ID NO: 126 - DNA (genomic), 990 bp, Enterococcus faecium; double-stranded, circular
  misc_feature (B) LOCATION 1...990
  hypothetical: NO
  anti-sense: NO
actcttaagtcttttaaaagctaccgtcctcacctttttttaagtgcgggattcttaattccttttattcaacaatctagagcacaagaattgaaagtcccactgggaaaagaattaagtggtatggctcctagtgatatgctgacacacattttaaataataactataacaactatactattggattattcttatttctcggattgattggtgcttttatttttataaaaaaattaactgctgatgatttatttattttctttcttggtgtatttgttcttttttgttcaaccaatttatttccttggcaactttttaaccatacaccagttaagagtctacaatttgtctggcggttaaatggtttttcttctttatttatagcctatacgatgagtatagtgatctattatattttttctactaaaaataattcatggaaaataatggtctttacgtttcttgcactaatattgcatctctcaggagtaagcaattctatccatgctaacaaagattcattaacacttatagcacctgaagacgctgttgctatagctgaaaattacaatcatactgattatgcaaacaaagagtcaatctatcatcctgatatgattaataatgatcaatatttactaggtaaccaggaaataaatccaacaactcattttatgagtaacaaacttacaattgaattagataattcgaataataaaaatactgtcttgacgacacctatttatcgttataaagggcaagtggcttctattaatggcaaactagtacaaacaaaattatctaagtttggcacaactgaattaactattcctccaggtataaataaagtcgttattacttatcagtacacaaaactagcaattgcttcaagatatttatctatcgttactttgattttatttttactttatcgatttactttttctaaacaaaaacaaccgagaagagaagtacaacattctcactag

SEQ ID NO: 127 - DNA (genomic), 204 bp, Enterococcus faecium; double-stranded, circular
  misc_feature (B) LOCATION 1...204
  hypothetical: NO
  anti-sense: NO
gaacttaagtcgtcatggcctttttcccattcgacgaaaccaccgaaaatacttcggcaagctgaaccagacccgcgtcgagcaaatcttgaaagagagagatcatctaatccaagcttaagagcagtattgcaagcgcctgctaaagcagctagcccgctggcagaggaggctaatccagctgcggtaggaacgaaattctga

SEQ ID NO: 128 - DNA (genomic), 939 bp, Enterococcus faecium; double-stranded, circular
  misc_feature (B) LOCATION 1...939
  hypothetical: NO
  anti-sense: NO
ttaccagagtctcttacgagaccccttcagaagaaaaagacgttggtcgtcgatgctgttctctcgcctactcctcgtgcttgtagaagttgtgtttctactgtggtagatggaaacgggaaagcaattatagtgaaaaatggaaaaaaggaaacgattgtccgttttgaacaatacaatcatatgcctttggttatgcgcctaaaaaagcaacgctatacctgtaaaaactgtcgcacccattggacggctcaaagttattttgtccaacccagacattcaatcgcaaatcatgttagatataaaattgcttctttactgactgaaaaagtatctttatcttttattgcgaaaagctgtcaggtatctttgaccaccgttattcgtacattgaaagagtttaaaagctatttaccaaagcaatctaagaagatcctccccagagtattgatggttgacgaatttcgttcgcatgcttccatagaagataagatgagctttatttgcgcggatggcgaaacaggaaaattaatagatgttttgcctacgcgtaaattacctcgattaacaagctatttcttaggttgtaccaatccagaagaagtagaattcttggtgacagacatgaacgccgcctacttccagctcaccaaacgtgttctgccaaatgcgaaagtcgtgattgatcggtttcatattgtcaaacacatgaatcaagcgttcaatgagttgcgtatccgtgaaatgaatgaacttcgtaaagccggacagaaaagccaggcagaaaaactgaaaaagaactggcgctttttgctaaaaaatcgtgcaaacatcaaccattatgaatacaaaacatggaaaagtttccgagcaccaaaatacccatttccgactgaagcaatgatgattaatcgagacccggctnttctcctaatatga

SEQ ID NO: 129 - DNA (genomic), 1041 bp, Enterococcus faecium; double-stranded, circular
  misc_feature (B) LOCATION 1...1041
  hypothetical: NO
  anti-sense: NO
tgcgactggtcgagtctacgatttgcgtacgatcacaactacacacaaagtggcgttgaaagatggaggtgcaagctaatgtggaaaacgattctgcgacgtgttttattgatgatcccgcaagttattattttaagtgttctgatcttcttattagcccaagcgatgccgggggatccatttaccggtttgatcaatccaaatcaggatccggcagtgatcgaacagatgcgacaagcagctggcttgaatgacccatggtatgtccagtacttccgttggatcggaaatgctttgcaaggcgattttggtcaaagtttcttatacaaacgctctgttgcagacttgatcggcgaacggatcatcaacactttatatctatcgatcttgacagttgtccttacttatttgattgctgtgcctctggggatgcttgctggccggtatcaaaattcaatcttggataagattgtcgtaatctacaacttctttagttttgctgttcctttatttatcttcggcttgatcatgctatttgtttttggttatcgtttaggctggttcccaacaagtggatcacaaacactaggtttgcaaggtggatttatcactcaatggatagaccgtttgaaatatattctgttaccatcaattacccaagcatttttggcgactgccgtcacaatccaatatctgcgaagtgaagtaatcgattcgaaatcgctcgattttgtcagaacagcccgttccaaaggggtaccgacgaataaagtattcagtcgacatattttccgaaatgcagcgttgccgatggcttctcaaatggggtatgaaatcacttcgttgattgctggttctgtagttatcgaaaagatttttggttatccgggagtcggaaaactatttattgattccatcggccaacgggactataccgtgatcacatccttagtattgattttaggaatcgcgacgctagtggggacattactttcagatatcatcatgagtatcgttgacccgcgtattcggattcaataa

SEQ ID NO: 130 - DNA (genomic), 249 bp, Enterococcus faecium; double-stranded, circular
  misc_feature (B) LOCATION 1...249
  hypothetical: NO
  anti-sense: NO
cagaagtggtcagcttcaagaaataagaaggaatttacgaaaattgcttctcaaatttttgtgatatttcggcttattgccgaagaagtaacagcaaacatcgcagatccaatgataaaaaaagccactacattagaagtatatgtcgcaaacggcaaacttgtgtgtcccgttttttacgtaaccaaatatccaaggttaaaccatctgcatcgatggctcgatacaaataatgccattttcctttaa

SEQ ID NO: 131 - DNA (genomic), 1290 bp, Enterococcus faecium; double-stranded, circular
  misc_feature (B) LOCATION 1...1290
  hypothetical: NO
  anti-sense: NO
cggaagcggtcagcaagttcagattggtcagcaggtgaaataatgaaaaaaatccctaaaaaaatgaaaaaatcagtacgatatatggcattactgacattagagcgagtgaacaagggtggcgcctactcgaatcttttgttgaatgagatgatcaaacaaagcgagctaaatcaaaaagatgtgggtttatttacagaattgatctatggtacgattagccatcagcgactattggaattttacgttgcaccattgatcgctaaagcaaaaaaagtggatgactgggtcaagacgcttctttatctttctgtataccaattagaatttttagataaagtccctgcacatgctattttaaacgaggcggtcgaaatcgcaaaagtaaaaggaaatcctgggacagggaaatttgtaaatggtgtcttgaggaattatcagcgtcaaggagcaccagatctgcaaggcattgctgatcctatcgaaagactttctgtcaaaatcagcctgcctctatggatgactaaacgactggtggatcaaatcggatacgaagaaactgaaaagctcggtttatcgctatatcagcctagccatgctagtgcccgagtagatacacgccgactttccagagatcaggccatcactgttttgcaagaagaagagatcacagctgaaaaaagccaagtcagtccatacggtatagtagcgaaaaaagggcatttagcttctagctcattgttccacgatggcgtcatgacgatccaagatgaaagttcgatgcttgtagcgccgtctatgcaaatcgagcctgaacatcatgtcttagatgcctgtgcagcacccggaggtaagacgacgcatattgcttcttttttagatccgtcatgcggtggagaagtggtcgctttagatgtacacgaacacaaagtcaaactcattgaagataatgcagcacgtctaggtgtctcttctgctgtctacgctcaaaagatggatgctagagaagtcagtaaacagttcgaagcagagcagtttgatcggattttagtagacgcgccttgttcaggtcttgggctgcttcggcgaaaaccagatattcgttataaaaaacagccggatgaattagcgaatttaccaaaaatccaattggaaattttagaaagctgcgcaccaactttaaagtcttccggtattctgacttatagcacttgtacgatcttaaaagaagaaaaccaagacgttgtttctgctttcttggaaagacaccctgattttgggagcgattga

SEQ ID NO: 132 - DNA (genomic), 240 bp, Enterococcus faecium; double-stranded, circular
  misc_feature (B) LOCATION 1...240
  hypothetical: NO
  anti-sense: NO
gacattaggtcttcatcaaacccgctaacgagagtagtgatcattgctacgactagactaacagccagtcctgctaagtaccagaaaaaagtaccggaaatgaatgcaggcaatgtggtcagactaccaaatacaaaagcgatcgctttcacttgggcaaatcccattacagctccaccagcagctgcaccaatgcaagcagcaacaaatggttttttcaatgggatcgcaattccgtaa

SEQ ID NO: 133 - DNA (genomic), 705 bp, Enterococcus faecium; double-stranded, circular
  misc_feature (B) LOCATION 1...705
  hypothetical: NO
  anti-sense: NO
tggatcaggtctggaaccaacactgggggaaatacaatgcttttattactgacattaattttatttgaaatcccttattttctggaaaagatattaaagatacagattccaaatatgctagaaatcattttgttatcttttatttttagttcaacagttttaggagagttaagtgatttttatggctatttttcaatgtgggatacttttctacatgcattcagcggatttttagctgggggtgtcggcttttcccttgtttatttgctcaataaaaatacaaaaaccatgaacttgactcctttattactagcagttgtttccttctgtttttcgatgacagttggtgttatgtgggagtttgtggaattttcagcagataaattactgcaattcgatatgcaaaaagatacgatcatccagcaaatcaatagtgtggagttaagtaaagacggaaacactgtctatcatgttccagatatcactcggacaatcattgaaagtcaaaatgcagatggtaaaacagataaaacaatcatccaaaatggttacttagacgtgggaatcatggatactatgaaggatttatttgttaattttattggagcagttgttttcagtgtatttggttacctctatagtcgaaacgattaccaaaaatttacgttcatcaagaattttattcctaaaaaaatcaaacgataa

SEQ ID NO: 134 - DNA (genomic), 189 bp, Enterococcus faecium; double-stranded, circular
  misc_feature (B) LOCATION 1...189
  hypothetical: NO
  anti-sense: NO
caccacgggtctgtatttatgtttatgtactttattggaggtgcggctggttcattgctagggacgacaatgtggcagcagtatggctggttaggtgtaacggttagcgggcttgtttttcaaggatgtgcgttcttctttcaaacagttgtttttaaaggaaagagaaatctcgaaaataaaaaatag

SEQ ID NO: 135 - DNA (genomic), 480 bp, Enterococcus faecium; double-stranded, circular
  misc_feature (B) LOCATION 1...480
  hypothetical: NO
  anti-sense: NO
actgtcactttggaacttttgccaaaaggagacggattacaactgtttatcagtaaaaatcttccggatgaagaaatttctcaatcagaagattctactgttgattcagaagatgtgagtgactttcttcgtcagcagattattggcagcgatccggaggaagaattatctggaagcgccctagaagaacaggaaagacaagcaacttttgcttttgaagattttgaacaagtgatccaacttgcaacagatgtcgaactagagtctgcttggactgatttgtatttattcgaagagcgctattacctagtcgttcacttctggatggaaaatctcaaccaagcggatgtagagaatcagattgctcgaattttggagtttgctgaaaagagcgatcgtacaccagaaacattgaatgaatatggacaatgtctgatggcgcgtaatgctatcgagcgaacgaaattttattttgtataa

SEQ ID NO: 136 - DNA (genomic), 198 bp, Enterococcus faecium; double-stranded, circular
  misc_feature (B) LOCATION 1...198
  hypothetical: NO
  anti-sense: NO
acaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataa

SEQ ID NO: 137 - DNA (genomic), 1020 bp, Enterococcus faecium; double-stranded, circular
  misc_feature (B) LOCATION 1...1020
  hypothetical: NO
  anti-sense: NO
attcggtttttgccaatatttttttgtaaattcattttatttgaaacaaaaagatcaaaaagacgtatgttttttgtggaggggagaataatggaaataaaacgattatcggatcaaatgataagtgaaagttttgccaaacatgcccaagacgtatatatattgccagcttcagaagtattttacatctattttcgctatggaaaaaaacgaacattctggaagaaagtctcttcggcagatggacagcaactgatctcaagatttaagtatttgggacagatggatatcggagaaaaaagaaaagctcagttaggtgcatttacttattctttagaaaaacaggaagttcgtctgcggttgtcttctgtaggagattaccttcaacgagagagtttagtgattcggctattatacggtacttttgaaacaccccatcgttgctttagttctcgagattttgcaactattttacagaaaaccgtcagacgtggattataccttttcagcggaccagtcggatcaggcaagacttctctaatgtatcggttggctttggaagaaaaattgcaagtgattactatcgaagatcctgtagagatagaagaaccgttttttctgcagctacagatcaatccgaaaatagcacagacttatgatacacttttgagactcgcattacggcatcgtccagacttgctaatcattggcgagataagagatgaatcaactgcacatgctgcggtaagagcagcactaacagggcaccgggtttttgcaaccgtacatgcacgcaatcttgaaggtacattggtcagaatccatgaactgacaaagaaaaaagaagagctatctgaatgtttagctggtgtcatttatcaagaacttttggaagatgccaatcaccatccttctgttttatggagttatcaatttatggaggaagaatcagtaaaaaaatcatgggaggaaagttatgaagaagctcaggaaaatatttggcagtcagaactattctaa

SEQ ID NO: 138 - DNA (genomic), 468 bp, Enterococcus faecium; double-stranded, circular
  misc_feature (B) LOCATION 1...468
  hypothetical: NO
  anti-sense: NO
atgaacacttttgaaggaaatttagtagcagaaaatataaaaatcggtattgttgtagcaagatttaatgagtttataacttctaagctattagcaggtgcattagataatttgaaaagagaaaatgttggtgaaaaggacatagaggtagcttgggttccgggagcatttgaaatacctttgatagcgtctaaaatggcaaaaagtaaaaaatatgatgcgattatttgtttgggagcagttattcgaggtagtacaagccattatgattatgtgtgtagtgaggtatcaaaaggaattgctcaaatcagtttaaataccgaaacaccagttatgtttggtgttcttacgacagatacgattgaacaggcgatagaacgagctggtagcaaagcaggaaataaaggctctgaatgtgcacagggagctattgaaatggtaaatctaattcgtgcattagaggtataa

SEQ ID NO: 139 - DNA (genomic), 885 bp, Enterococcus faecium; double-stranded, circular
  misc_feature (B) LOCATION 1...885
  hypothetical: NO
  anti-sense: NO
caccggttttttctgcttttccagttcttgcatacaatctgggcaaaagataaattcctgcctcacatgtatcaagatcttggggatcgactaggctattccaatgggattatcacactagcgctaggttcgatcgtattgctgtttattttccatggctcaacagaacgcttgattccgttatactctatcggcgtgttcattccatttgctttatctcaaacagggatggtcgtcaaatggaaaaaagaaggaaaaagatggttaagcaaatcgattgccaatattacgggtgcgttcatctcatatgcaatcattgcgattttgtttgtctatcggttaggggacatttggcctttcttcatcattatgccaatcgttatgttcattttttataagatccatgatcattataaaaaagtagcagaacagcttcgtttagaaaatgatgcaaaactacatgattatgacgggaataccgttcttgtattagtcgggaatgtgacacgggtaaatatcggtgcgttgaattacgcacgttcgatcggtgattatgtcgttgcgatgcatgtttcgctagacgaagatgtcgaaaaagaaaaagaaatcgaagcagaatttaaaaagcatttcccagatgtccgtttttcaatcgtccactcttcttatcgctcgattgaaaatccaattatccgttatgtagatatcgtaagtaaaaatgcagcgaaacaaaactatacaactactgtgttgattcctcaatttgtaccaaacagacgctggcagaatattctccataaccaaacaagtttgcggttaagattgcgattgtcttggcgtgaaaatatcgttgtcagcacctatagctaccatttgaagaaataa

SEQ ID NO: 140 - DNA (genomic), 540 bp, Enterococcus faecium; double-stranded, circular
  misc_feature (B) LOCATION 1...540
  hypothetical: NO
  anti-sense: NO
gaaggcactttgctgaatagaaaggaagagcagtcaatgattggaatcagtgcatgtttaggcggtctggcctgtcgctatgatggacagaaaaaagaagtaccagaattgatggaactagttgaaactggcgaagccgtcatggtctgtccagaagtaatcggcggattgtcaattcctagagatcctgctgaaatcattggtggaaatgggttcgatgtgtggaaagatcaagcaaaagtatggacgacaagcggcgaagatgtaacggaagcgtacaaaaacggcgcgatcaaagcctatcaaaaattgcaggaaaagcacattgatctagtcatcgtgaaggaaaaaagcccttcatgcgggacccattcgatttatgatggaagcttttccggaataacaaaaaatggcgccggagtggccactgcttattttattcagcaaaaaatgactgtgctctctgatgaagaatggctgaaaactagaggtgagcagaatggaaatcgaaaagaccaatcgaatgaacgcgctctttga

SEQ ID NO: 141 - DNA (genomic), 186 bp, Enterococcus faecium; double-stranded, circular
  misc_feature (B) LOCATION 1...186
  hypothetical: NO
  anti-sense: NO
cagtttttgtttacaagtgtaatctttattcataagctattgattacatttgtaaacgaaaggtgtgaaataagtggagaaagtcaaaacgccggtaaaaatcagcgattcagaatgggagatcatgcgggttatttggacacttgggcagacgactgcccaagaaatcacgcagatcttagctga

SEQ ID NO: 142 - DNA (genomic), 1227 bp, Enterococcus faecium; double-stranded, circular
  misc_feature (B) LOCATION 1...1227
  hypothetical: NO
  anti-sense: NO
gtatattttcctattttttcaataatgtatgttatgctaagttcgggctatattttatacaaaggaatgatgagaatggaatttattggtattttatgcctgatattgatttcaacaacgattggctcacatatctcgcggagattaggtatcccagcagtgattggacaattacttgttggtgttttgctaggccaagctggattgaattgggtcaaacctgatattctagtccatgacttttcggagattggtgtgatcttattaatgtttttagctggtctggaaagtgatttatctcttttgaaaaaatatttccgacctggtatgttcgttgctttgcttgggatcatcttcccggttgtttttggctggttgacaggcaaagcattccaagtttcgggaaatgaagcgattttctttgggattattcttgcggcaacttctgtcagtatttcagtagaagtattaaaagaactaaacgtagtgaatacaaaagaaggatcaacaattttgggtgcttctgtggtagatgacattttagtcgttttagttctaagtttcagcctatcttttctaacgggggaagcttctagcaatgcttctttaccgcttgttttgattgaacagctaatttattttgtttttattttcttattagtcaaatggattgcgcctttcctactttcatttgcagaaaaagtgtacgcaaattcttctattatcatcgtatcgctagttatttgtttaggaatgtcttacgtagcggatcttgttgggcttagctctgtcattggtgctttttttgctgggatagctgtcagtcagacaaaggttaaagaagaagtataccacaatgtagaggctttaggatatgcagtatttataccagtattttttgtcagtgtaggattagaagttgatttttctgactttagtgaacaactactctttatttctatattgacgcttgtagcgattttgaccaaattgcttggaggttattttggtgctcagattgccggtttttctcaacatagttcattgatggtcggtgctggtatgatttcgcgtggagaaatggctttgatcattttacaaattggacagcaaagtcaattgatcgaaccacagtactattcacctttagttatcgtgattttattaagtacacttatttctccacttgttctcaaatattttacaaaaaaagtttatgaagtgtga

SEQ ID NO: 143 - DNA (genomic), 642 bp, Enterococcus faecium; double-stranded, circular
  misc_feature (B) LOCATION 1...642
  hypothetical: NO
  anti-sense: NO
gtgattttgtttactctaagaaaaaagggaggcaaaagatacatgaattactttatcagtgatatgcactttttccatgaacgcttattaggaaaaaacgactttgctccgcggctctttgcaaatgtggatgaaatgaaccaacagttgatcactagctggaatgcagtaataaaagaaaccgaccatgtttatcatctaggcgaccttgctatgcatccgcaatatgaaaaagcaaatgcagaaattttggaactggtcactcaactgcaaggaacaatccacttgatcaaagggaaccatgacagtcgcgcttttttccgttatttagaaaaaaatgatcctaggcttactgacggaagtcccaaattttatttttatgatgtaggtgccatcgttaaattcgaccatcaacaatattacttgactcattatccgatgttgctcgggcctaacgacactatccgcaatcttcatggacatatccatcattacagcgtacctatcgagaacgatgtcaatgtaggcgtagacgcaccggaaagagaactcttaaaggaaaaactaccatttggcactccgttatctgagcaacaaatcaaagaaatctatgaagcaaagaggaagtacgataggtcgtga

SEQ ID NO: 144 - DNA (genomic), 279 bp, Enterococcus faecium; double-stranded, circular
  misc_feature (B) LOCATION 1...279
  hypothetical: NO
  anti-sense: NO
tacgtctttccttttttgcttcttatccccaaagaaacggatataacttattatgtattgaatttttttggaaaggcgaattatgacaagatataccttgcgttgaaaaaactcgcggaaaaaatatcacacgtttttaaaaagatacaaagtaagaaagcagctgtcaatagaatggaaacaaaaatggcgagacatcaatcagtctcgccttgttttttattgtatacattagatatggagcaggttaccataaagatgattattagtcgttattaa

SEQ ID NO: 145 - DNA (genomic), 876 bp, Enterococcus faecium; double-stranded, circular
  misc_feature (B) LOCATION 1...876
  hypothetical: NO
  anti-sense: NO
cctatgtttcctttttttaagaaaaaaccattaaagctccagaacacgatcatccttgtcgtttgtttctccacattcgtttctttgattgtttctgccatattgatcaggaattttattctttcgatgaaccgatctagtgtgtcagataaaatctctagcattgctaaaatcgttgccaatgataaactcatccaaaaaaagctgcagactggtgacccgacacatgcgattcaaggaataacaaatgaaatcatgattgcatcgaatttagattttatcgttgtcatggaccctgaaggcattcgatattctcacgcagacccaagttacatcggtcttcctttctcaagtcatgaagatgtgaaaaaagtgattggaggacaagaatttttctctgaaaaagaaggaatgttagggttcggcttccgctatttcgtccctatttattatgatcaagagattattggtgcagtttgtgttggcttaacaaacaacacgattgacaatcaagtcaaagatggacaaaaaatgattgttttttcattgattattggacttagcgtaggcatcataggcgccgtttttcttgcccaaaaaatgaaaaaagtactgcttggacttgaaccacaagaaatagcagaacagttaagtgaaaaaacgattatcgaaaatgaagtagatgaaggaatcttagccatctcttctgataaaactatcctcttgatcaatacacctgcaaaaaacattttctaccaaacagagcagctattggatttcgaagtaggaaaaaaatcagtgataatctatatgacgttttgtttaaagagacgattgagcatcaaacgaccgttcggactcaatccatgtatttaa

SEQ ID NO: 146 - DNA (genomic), 195 bp, Enterococcus faecium; double-stranded, circular
  misc_feature (B) LOCATION 1...195
  hypothetical: NO
  anti-sense: NO
tttttgcttccatattcttccccgtccatcttccacatacttcatatcatttcacatgatacttatgctctcatcataccacaggttgaattagaaaagaaaataaatcacacaaaaaagcaagacaatctgttagtgagattgtcttgcttttcgaaaaagactgaatacttttcgttaaaactggttgcttag

SEQ ID NO: 147 - DNA (genomic), 621 bp, Enterococcus faecium; double-stranded, circular
  misc_feature (B) LOCATION 1...621
  hypothetical: NO
  anti-sense: NO
ggcatcttgttaaagaaagagagagagaaaataatgacaaatgtaaaaatcgtaacagattcttcatgtacgatggaaaaaaatgtacgcgatgctttaggcattcgtgtcatgccgctatccatcatgatcgacggaacagtatatcccgatgatgaccaactagacggcgaaagatttatggaaatgatggcgaaagcaaaaaatctgcccaaaacaagccaaccaccaattggagaattcatctcgatgtatgatgagctaggagaagacggcagtgaagtgatttcgatccatatgacaaaaggcttgagtggaacagtagaagcagcaagacaagccagtaatctaacaaaaacgaaagtaacggttatcgacagtgataccactgaccaaggattatcttttcaggtaattcgagcagctgaattagcaaaagaaggtaaaacagtagagaaaatccttgaagaagtcaaaaaagtacaagacaatacaaaattatacatcggaatatccacactagataacttggtaaaaggtggaagaatcagccgaacaactggtttgctgtctagtgttttgaacatacgcgtggtgatgaatttcgcccatntgaattaa

SEQ ID NO: 148 - DNA (genomic), 225 bp, Enterococcus faecium; double-stranded, circular
  misc_feature (B) LOCATION 1...225
  hypothetical: NO
  anti-sense: NO
tggagaattcctttctatatgaaagaaacgcagatcaccgttcggatattcttatgttcaaacaggccttttttcaagtatttatgtagcatctacttattaaaaagcttggtacttaggagattagtggcgtttagagttcttttaacaactgttcgtagtcagctttttcatcgacaggaaggagcttgtaagttaattcgtctgtctcgttgtcatgaatga

SEQ ID NO: 149 - DNA (genomic), 225 bp, Enterococcus faecium; double-stranded, circular
  misc_feature (B) LOCATION 1...225
  hypothetical: NO
  anti-sense: NO
gctgggattcccaataataccttgatttcagtacagaccgaaaacccgaagagagtgccttcttttcgggttttcttatataatcctcgaatggcttccatgcctttaatcgtggtagaggcagtgcgtaaacttcgatataatttattgcgtctctttactggacgatggtcttgttcaatcaaattattcaggtatttaatggtacgatgttctgtcccttga

SEQ ID NO: 150 - DNA (genomic), 225 bp, Enterococcus faecium; double-stranded, circular; identical to SEQ ID NO: 149
  misc_feature (B) LOCATION 1...225
  hypothetical: NO
  anti-sense: NO

SEQ ID NO: 151 - DNA (genomic), 225 bp, Enterococcus faecium; double-stranded, circular; identical to SEQ ID NO: 149
  misc_feature (B) LOCATION 1...225
  hypothetical: NO
  anti-sense: NO

SEQ ID NO: 152 - DNA (genomic), 321 bp, Enterococcus faecium; double-stranded, circular
  misc_feature (B) LOCATION 1...321
  hypothetical: NO
  anti-sense: NO
gtatacttgtttttccttttatacattttatggtattatcattttattagttattataaaacaatcgttagaaaggacgtcattatgcaagtatacggaattgatgcggtgcttcgaatcgtgagtcatttggcgtttatctacttagccttctgttctttacgttcgttacgcattgaaacttttttcagaccaatgcataatacgcaaattagaatggcaatcgtacttttttcaatttttttagggtacactgcaagtaattttttctntagaaattatcgctttatgccgaatctggtccttagcctgtacatttta

SEQ ID NO: 153 - DNA (genomic), 315 bp, Enterococcus faecium; double-stranded, circular
  misc_feature (B) LOCATION 1...315
  hypothetical: NO
  anti-sense: NO
gtatacttgtttttccttttatacattttatggtattatcattttattagttattataaaacaatcgttagaaaggacgtcattatgcaagtatacggaattgatgcggtgcttcgaatcgtgagtcatttggcgtttatctacttagccttctggtctttacgttcgttacgcattgaaacttttttcagaccaatgcataatacgcaaattagaatggcaatcgtacttttttcaatttttttagggtacactgcaagtaatttttttcttagaagttatcgctttatgccgaatcttttcgttagcctgtaa

SEQ ID NO: 154 - DNA (genomic), 741 bp, Enterococcus faecium; double-stranded, circular
  misc_feature (B) LOCATION 1...741
  hypothetical: NO
  anti-sense: NO
gccaacttgtttcacaagggcttctttgatattgtagtagcaagaagaaagatggagggattttttatggcaaaaatcatggtagtcgaagacgaagagatcattcgacaattgatcatggaggaacttgagaaatggcaatttgaaacctttggaacgaccgatttcaatcaagtgttctcagactttgaaagagaagaaccacagcttgtattactagatattaatcttcccgttttggatggctattattggtgtcaaaaaatacgtgaagtatcgaaagtaccgatcatttttatctccagcaggaatacgaatatggatatgatcatggctatgaacatgggggcagatgattttgtgacaaaacatttccaaatcgatgtactgattgcaaaaatcaatgcattacttcgccgttcttacaactacacagaattatctagtgaaatgatgagccacaatggcattacgttgaatgttgacaacggaagtatggaaatcaacggagagatcattgatttgagcaaaaatgaatatcgtctattatttattttgatgaagcacaatggaaagatcttaagtcgggaaaaattgctgcgagcactgtgggatgacgaacgatttgtagatgacaatacattgacagtcaacatcaatcggttacgccgaaaaatcgaacaggcaggtatccaaggatatatcgaaacaaaagtaggacagggatatatcgttccctga

SEQ ID NO: 155 - DNA (genomic), 1812 bp, Enterococcus faecium; double-stranded, circular
  misc_feature (B) LOCATION 1...1812
  hypothetical: NO
  anti-sense: NO
aaaggcttgttctcttttcattctaaatttcctaagctacaatgtggtagtacttgttttttcaattgtggacaaataaataataggaggaatcatatgattcagttattacgttatgcaaaagactatcgtaagcaaatcattttgggcccgttcttcaaatttcttgaagctgtcttcgaacttgtcctgcctttaatgatggcttccttgatcgataatggactaaaaatgaatgaccgaggaaaaatcattgaaatgggcttatggatggtcgctatgtctgtgattggtctgatttgtgctatcatttgccaatactatgcttcagtagcttcacaaggatttggtacagagttacgtaatcagctaatcaaaaaaatcaatactttctctcacaacgagttgaatcattttggaacagataccttgatcacccgaatgacaaacgacatcaatcagcttcagctagctttagcaatggtcattcgtttattgatcagagcaccgtttttaagtatcgggtcagtggtcatggcttttgtgatcgactgggaagtaggtctgtttttcttagcattattgcctattttctcaatcattttattttttatcatcaaaaaaaccgttcctctctaccaaaaagtgcaagaaaaactagatcagctcaatgaacacgttagtcagaatcttagcggtgttcgtgtcatccgcgcatttgcgcagacaaaaaaagaaacagagaagttcgataaaagcacaaatgatctagcgaacaattatttacgtgtttccaatatctctgccctattatcacctgctacaaccttgatcatgaatgtcgggatcatctgtttgctgacagttggcgggatcaaagtaaatattggtagcttgcaacaaggacaagttcttgctttgatcaattatatgaatcaaatgcttttggcactgatcgttgtttcaaacctcgtcgtgatcttcacacgtgccgaagcttcaggaaatcgggtgaaagaggtgctagacacagaaaattcgattcttgaagctgaggtcagtactactcccgatttttcttctgaagcaattatcgcttttgaccatgttgacttccgttatactcctgattctggtctttctctccaaaatattacatttcagctgaagcgaaatacagtccttggaatcattggtccaaccggaagcgggaaaacgactttgacacaattgattccgcgtttctatgatgtcagttccggtacagttataatggacggaatggatgttcgttcttggcagctggatcatctccgtcagcaaattgctcttgttccccaaacttctgtactatttaccgggactattcgtgaaaaccttcaatggggtaagaaagacgccacagaaaaagaatgttgggaagctctgaaaatcgctcaggcagaagaatttgtccgtcagcttccaaatggtttagatacaaaagtcatggaaaatgggaaaaatttctctggcggacaaaaacagcgactgacgattgcaagagctttgattgccaagccagcattactgattttagatgactctttaagtgcgttggattatcaaacagacttggatttgcgtaaggcgctacagacttatcttggcagtacagtgattattatctcccaacgtgtccgctctattcaagaagcacatcatatcttagtgatggatcaaggtaagattgctgctcagggtacccatgaagaattacttgctcaatcagcagaatatcaggaaatcgtcgcatcacaggaggaagaatag

SEQ ID NO: 156 - DNA (genomic), 1196 bp, Enterococcus faecium; double-stranded, circular
  misc_feature (B) LOCATION 1...1196
  hypothetical: NO
  anti-sense: NO
gaatggttccttcaggtgcttcaactggtgaatacgaagcagttgaattacgtgacggagacaaagctcgttatggcggtaaaggtgtaactaaagctgtcgacaacgtaaacaacatcattgctgaagcaatcattggctacgatgttcgtgaccaaatggctatcgacaaagctatgatcgctttagacggaactcctaacaaaggtaaattaggtgcgaacgctattttaggtgtttctatcgctgttgcacgtgcagctgctgactacctagaagtacctttataccactacctaggcggattcaacacaaaagtattgccaacaccaatgatgaacatcatcaacggcggatcacatgctgataactcaatcgacttccaagaattcatgatcatgcctgttggcgctccaacattcaaagaagctctacgtatgggtgctgaagtattccacgcattagcttcaatcttgaaagctcgcggattagcaacttctgttggtgacgaaggtggatttgctccaaaccttggttcaaacgaagaaggttttgaagtaatcatcgaagcaatcgaaaaagctggctatgtacctggtaaagacgttgttcttgctatggatgctgcttcttcagaattctacgacaaagaaaaaggtgtttacgtactagctgattcaggcgaaggcgaaaaaacaactgacgaaatgatcaaattctacgaagaattagtttctaaatatccaatcatctcaatcgaagacggattagacgaaaacgactgggacggattcaagaaattaactgacgtattaggcgacaaagttcaattagttggtgacgacttgttcgtaacaaacactcaaaaattatctgaaggtatcgaaaaaggaattgctaactcaatccttatcaaagtgaaccaaatcggtacattaacagaaactttcgaagctatcgaaatggctaaagaagctggctacacagcagttgtatctcaccgttctggtgaaacagaagattcaacaatctctgatatcgctgttgcaacaaacgctggccaaatcaaaactggttctctatcacgtactgaccgtattgctaaatacaaccaattactacgtatcgaagaccaacttggtgaagttgcagaatacaaaggtttgaaatctttctacaacttaaaaaacaaataa

SEQ ID NO: 157 - DNA (genomic), 243 bp, Enterococcus faecium; double-stranded, circular
  misc_feature (B) LOCATION 1...243
  hypothetical: NO
  anti-sense: NO
aggatattgttcattgatattggcgcatcaagccaagaagaagccaaagagtggggcatacgtcctggagatatggtcactccatatatgaatacaaaccgaatgaatggcagtaaatatttactggcaaaagcatgggataatcgtatcgggacagctgtttctctgcgagtattagagatctatctaaagaagcacacccaaatgttttattcgcaggaagcgatgtgcaagaagaagtag

SEQ ID NO: 158 - DNA (genomic), 591 bp, Enterococcus faecium; double-stranded, circular
  misc_feature (B) LOCATION 1...591
  hypothetical: NO
  anti-sense: NO
aaaacattgttatttgaaagaaggaacatcatgaatgatttaaaggaaaatatgatttttgatttatcaaaaactgcttttgtcgcgatcgacatgcaaaaagagatcgtaaataacggtacactctctccacacactgcagcatctattctgacaaacaatgatttgttagtaagaacattgaaacgtaccgctgccttgaaagttttagtgaacgtagacatctccactttcccttatttgagtcaacaaactgatatgggtggaatgactgcttctgtacctccagaattcactgatttacttttgaaggattctttgaaagatacagataatatgttgactatcacaaaatacaatccaagtgctttttttggtacttctcttgatcttcaacttcgccggcgtggaatcgaaactatcattttaagcggtgtagcgacaacaaacggtgtatatgctactgcattagatgcctttcaacacgggtaccatatcgtgcttgctgaagatgcttgcagtgatcgtgacaaagaatcccatcaattgttcatggacaagatatttccgnntctatgcatcggacagtga

SEQ ID NO: 159 - DNA (genomic), 381 bp, Enterococcus faecium; double-stranded, circular
  misc_feature (B) LOCATION 1...381
  hypothetical: NO
  anti-sense: NO
caagtttctcctctaatttcaaaatcgatacagattttaccggataaatccacaaaactgcttgcgccatttcgcacaaagtgttattttgtatcatggactttattgatcggaggcaatagtatgatcgcgatcggtcaatttgttttttatattcctttttttattatgataagcattcttttgtattacttaaaatggacaaaaaagaagttttcagttttactggcctctttacctgctgtatattttacttatcaaattttttcttttaggcattgggaaacaacgtctgtattaataacacacatcatcgaattgacgctttcagtaatttttcttattatttggatctattttttatataagaatcagaattga

SEQ ID NO: 160 - DNA (genomic), 429 bp, Enterococcus faecium; double-stranded, circular
  misc_feature (B) LOCATION 1...429
  hypothetical: NO
  anti-sense: NO
tctgcttctccaagtcccgcacgcgggcctgccactcggcggctttttccctggcttttgccaggtcggtttttaatcggtcgaatttcacgttatccctcctgttctgtttggaatgtaatcggcaaagtttttgaccgtgtaaaaaatccgcttattattcacccagcgctgaagctggcgggtgattttcggtgcggccgggcggtcgtagaccatcacataggggtcatatcccatgccgcgcagggtttccacccggtacaagtcctgctcatgggtgctgccgtaattggtcaggacgtagacgcgccgctttcggtcgctcttaatggcggtcagttccagaaagcgccggaaatacccggtcaagtcctcgtctggattgttccaggcaaaatgcaccgccctggtgcgtacccggtttag

SEQ ID NO: 161 - DNA (genomic), 306 bp, Enterococcus faecium; double-stranded, circular
  misc_feature (B) LOCATION 1...306
  hypothetical: NO
  anti-sense: NO
tgtttgttgtttgacttttttactaagagttttatactatctattatagataataagaatgtgttagaggaggcactcaccatgaacgtaaaaatcttttctaaaaataattgtatgcaatgtaagatggtcaaacggtttttaacagaaaatcaaattgcttttgaagaagtcaatatcgatgaacagcctgaagcagtagactggttgaaagcacaaggattccaaagtgttcctgtcattacttctgatgcagaaacagttatcggattccgtcctgatcagttgcgtaaacttgccagctaa

SEQ ID NO: 162 - DNA (genomic), 222 bp, Enterococcus faecium; double-stranded, circular
  misc_feature (B) LOCATION 1...222
  hypothetical: NO
  anti-sense: NO
tttattcctcctaaatattgttctgtccacgttcattttactccaaagttttcctcatttcaaaagaaaatcacagaatacacgaagaagcgtttctatttgtataaactatatcaaagttctatacttaaattatcaaataaaaaggacgtgaagataaatgtcaaatttagaaaacaaagaagaaaaagttgtaaacaaaattgtttctgttgtcaataa

SEQ ID NO: 163 - DNA (genomic), 1929 bp, Enterococcus faecium; double-stranded, circular
  misc_feature (B) LOCATION 1...1929
  hypothetical: NO
  anti-sense: NO
cccccccctcccccctccctctccccctccttcctctcccctctcccnaacgctccccccccctctccccccccgccccgccccctcccctcccttcccccccccccccccccccttccggccacgacccgccctacaacgaacncctctgtcgtggacgcattgaatgaagataaccatggtgaaggtggaattttctcactctacacacttgtccgaaaaggtgggaaatatttgatcattcctgcaatgatcggaggagctgccttactaccagatggggtattgacccctgctgtgacggtaacgactgcgattgaaggcttgcgaggaattccgcagttttttgaccggttcggtaataaccagaacgtgatcgtcattatcactttagttattatttttgttttattcatggtccaacgctttggtacagatattgtcggaaaagcattcggaccaatcatgttcgcttggtttacttttttaggcgtaatgggattaatgaacttcagtcaagactggacagttatccgtgcactgaatccttattatgctatccagctgctttttagtgcagataacaaattaggcttgttcattcttggaaatattttcctggctaccacaggtgcagaggcgctttattccgatcttggacatgtcggcaaacgaaatattcgtctgagctggccttacgtcaaaatttgtttggttatcaattattttgggcacgctgcgtggttgttgaatgtttatcaaaaccctgaagcacagcaaatcaagaacctgaatccattcttccaaatgatgcctcaaagttggatcgtgatcggcgttgcttttgcaacagtcgctgcagtcattgcttcgcaagcattgattacaggttcgtttacgctagtttcagaagcaatcaagttgaaactgctgcctcggttaaagatcatgtatcctgggaacagtatcgggcaaatgtatatcccagcagtcaatctgattttatggatcgcctgttctctagtggttgtcacattccgaacgtctcatcatatggaagctgcttacggtctatcgatcactgtgacgatgttgatgacaacagcactgctttacttttatcttatccaaaatgggcattctcgttggcttgcatatttagttacctttttcttcggtgcgatagaagtcgttttctttatctcaagtgttgtcaaattcttccgaggcggttttgtagccgttctgattggtttgatcatcttagtcgtgatgtttatttgggaacaagggaacattattcgcgaatcgtcaaccgaggatgtgtctttgagagattatatcccgcagcttagagaattacgtgatgatacttctttaccaatctatcagacaaatgtggtcttcttggttcctgatatggctgaagataaagttggccgacagttcatctattcgattttagataaacggcctaaaagagcacgagtctattggtttgttcatgtggaagtgacggatgagccatatacgaaagaatatcaagtagatatgatggacactgattttattgtccaagtgaatctgttcttaggtttcagggtccaacaggaaatcaacgtatatgttcgccaagtcatccatgatttgatgaaacaaggccgtttgccaaaacagccacaaagatactctctgacaccagggcgagaagttggcgatttccaatttgtcctgattgatgaagtagtttccaatgtgacaactctaggaaaatggcaacgtcaaatcatgcaggcaaaactggcaatcaaaaaaatcgctacctcgccagaaacatggtttgggctagagtacagcgaagtaaaacatgaaactgttccgcttatcattggaaatactcggaaaacatggttgaaagagcggttgtga

SEQ ID NO: 164 - DNA (genomic), 354 bp, Enterococcus faecium; double-stranded, circular
  misc_feature (B) LOCATION 1...354
  hypothetical: NO
  anti-sense: NO
tgctcgttgttgttgtctatctgtttgaaaaattcatgcacaagaaacaaccagctctgtttgaaacgccaactgatacgcagaaaaaacgaaaattaccgcttcccttggtatgtattagggtttgtgatcttttgtntggtcaacagcttgttttctttacctgtagttattgaccaatcggcacattttatcagcagctggtttgagatcactgctttagcggcaattggtctgcgtttagactttgcaaaattcatgaaagaaggtacacgcttcttatcttatggattagctgtcgggcttctccaaacagtgatggctttactatttatttggctgatcaaagtttag

SEQ ID NO: 165 - DNA (genomic), 1143 bp, Enterococcus faecium; double-stranded, circular
  misc_feature (B) LOCATION 1...1143
  hypothetical: NO
  anti-sense: NO
aaatggttgtttgtaaaaggaggcttttttatggaaaaaattgccattatcggtggcgggatcattggtatgaccctagccagttacttagatacatcaaaattcaatgttgctttatttgatgaagggacaggacaggcaactaaagctagcgctgggattatctccccttggttgtcgaaacgcagaaacaaacaatggtatcgtctggctaaagacggcgctgcttttttccctaaacttataaaagatttccaacttgatcaaacgatttacgcacaatcagggacacttttgcttcgacctgaaaaagatttagctgaattggctgttcttgccgagaaacgaaaagaagaagcgccagaaattggaaacatcgaatggctttcacctgaacagacatctcaagcacttccgttattgaaaccagcagtttcactgcgtatcagtggtggtggtcgtctggatggaaaagcatatttagaacatcttggtcagcgtttagcacaaaaacaaatggagcagatccaggcaaaagtcactttgcataagaagagcgattcttggctcatcaagggaccgtttggagaatacacagctgatcgtgtaattttgacacctggcccggcacttaagcctttattacaagaattaggctatgctgcagatatacgtccgcaaaaagggcagctcttagcatttcagacatcttataagatgagtcaagactggcctgttgctatgcttgacggagaagctgatttcattcctttcatggatggaaagatccttttaggtgctacccatgaaaacgatcaaggctgggatttggctcctactagcgaagcttataagggattgactaagagtacagaacagttcttgactgatccagatcagataaaaaactggccatacgagttccgtgtaggtacccgtgcttatacgtcagatttttccccatttttcggcgtactgccagatgatccaagcttactggctgctagcggtctaggctcttctggcttgaccacaggtccttatatcggctatctattagccaacttcttaaatactggtcattggcctacggaagattatcaaaaggacatctccacctatattacgaaaaatccatcatag

SEQ ID NO: 166 - DNA (genomic), 231 bp, Enterococcus faecium; double-stranded, circular
  misc_feature (B) LOCATION 1...231
  hypothetical: NO
  anti-sense: NO
atttcaactccttctaaattgttcttattatctatcatccgttgttgtctattaatttatgtattggagggtaagaatatgaaattatcgattgaaggtacttcaggagaaataaaagagttgctccaagctattggtggtagcaaggagcaaaatataaaaattgatgatatttataaaaaaagtaaagattttttaattaacggtcaagctgttgctcctagtttttaa

SEQ ID NO: 167 - DNA (genomic), 2358 bp, Enterococcus faecium; double-stranded, circular
  misc_feature (B) LOCATION 1...2358
  hypothetical: NO
  anti-sense: NO
ccatctgctccgggcttttttattgcgaaaaaggagggaaacatggcgaataagctacaaaccgtgtcgcagcttgcagaccagaccgccaaggccgtcacgcggaacgcggagggctggaaaagctatctgaccactgcatcgcggctttataaatactcgtttgacgaacagcttctgatttacgcccagcggccggacgccaccgcctgcgccagcatggaattatggaatgaggatatgcggcgctgggtcaaggccggctccaagggcatcgccctgatcaaaaaggacggcatccgcccacggctgacctatgtgttcgatgtggcggatacccgcccggtgcggggcgcgaaaatgccctatctgtgggaaatgaaagacggacaccatgccgccgtcatggatacactggcacggcgttacggggaaacggaaaagaaggacatcggatctgcgctgatggagcaggcgaaacacgccgtagaggaagtgtaccgggaacacctttctgaccttgcctatgacgcccaggacagtcttttggaggggctggacgatttcaacctggaagtgcgcttccgaaatctcctgaccgccagcgtccagtatacgctcctttcccgctgcggcttaaaccccgccgattacctggaggacgaagattttgacggcatccatgaattttccacccccgccgtcctccaccacttaggcagcgccgccagcgaagtgtccatgaatatgctgttggaggtcaagaaagcaatccggcaggcggaaaaagaaaaggcacagaaccggcagaaaatcccgaaaaatcccgaaaaaccacttgcaaaagaaccggtgatcggttatactaaagtcaaggaacagtttaacacattaaaacgcgaaagcgaagaaaggagcatacaaaatggcagaactggcatacaagaggacgggcgactacctgattcccgacttggtgatggacggggaggacgaaatggaggaaatgccgctgggcaagtacggcaggctgcggcagacctttcttcaggaacaccacaaggggacatacacctcgatgctgctgaccgggcggctggaaccccacctgcgggagatcgaccggcaggcgcaggaacaggcagaccggatcgtggcggaattaaagaaacagaacggcgtggacgaggggatgaaagcccgcgaccagatgggatgggtgcaggcagtcaacctgtttctcgcccaggcggaggaaaccgtactgaacgagatcgtttacaagtaaatcaggagaaccagcaggaagcggcgggcgaacagtccgccgtttctgcgtctgaaaagccggcatttacacagttttctttattccccactgtggaacagcagattgaaactattgctcaggcacagaaaaccgagcaggaactgcgccccgccgtttcctccggcaaggtcacggatgcggtcattggccgcgccctcacaagcggcggcaacgagccggacagcatcctgcgtatcgtcgcttttttccagaaagaccctacggagcagtctgccgccgattttctgcaaaaggaatacggcagcggcggcaaggggcttaaaattgccgggcatgagtattcgctgtggttcagccatagcggtatccacatcgcgccggggcgctctgccgggggcggctcccttgtcacctggaagcaggcggcggcacagatccggcagcttttgaacagcggccagtttgccagccaggacaaaatcgacgcggcccgtgacaatgaatttcgggaattgtcggaaaaactgtggtttctgcggcagaatttcagcgaggaagcaaaggaaaagggcttgctgcccaccattgacgcgctgtacggtggtttcccggacagcacggctaaaattgccgcgctcctgaaagacccggcagaacgagccaaaattgcacaggaagtccggcagtttgccatctcccatcaggagaacccgaatctgctgcgcttccgccagcggcccgcgccctccgaactgtttacccgcctgaccgatatggataagccggtgacggcatttcatggggtggagggctttgcgcctgcccgtggagcttttgtcaccgaggacgagattacccggatgttcactggcggctctggcgtttccgaggggaaattccgtatttacgcctactttatgcaggggcatgatgccaaagagtgcatcgaatttctgaaaaacgaatacggcattggcgggcatggctacattggctatgatgaatggcacgacggcaaaggcatcaagctgtcccgcgccgacgatttttcccggtggcaattatga

SEQ ID NO: 168 - DNA (genomic), 219 bp, Enterococcus faecium; double-stranded, circular
  misc_feature (B) LOCATION 1...219
  hypothetical: NO
  anti-sense: NO
agtacagctcccattgatttttaccaaattatagcacaattggcgtattatttttttaatttttcagggattttgaattcagaactcataccaaagcagcagccagatacaaaaaagtcagataagttagttaattgtttaatgattgtttttttcatgaaagattcctccaaaattcatcaagtagtttgtaataggaagcaacgtagctatttctaa

SEQ ID NO: 169 - DNA (genomic), 213 bp, Enterococcus faecium; double-stranded, circular
  misc_feature (B) LOCATION 1...213
  hypothetical: NO
  anti-sense: NO
cacacctatccagatatcggcaatctcatactttttagtaaagtgtaccaagcactgacggatatatcgttagcggaaaagaagatgaatgctttgcaatttcatagaaagaagttgttatttattaatcatttaaaaaaaacagtaactagaccttatttctatatattatcgggcaataaattaaaaaaagctttaccttacaataagtaa

SEQ ID NO: 170 - DNA (genomic), 870 bp, Enterococcus faecium; double-stranded, circular
  misc_feature (B) LOCATION 1...870
  hypothetical: NO
  anti-sense: NO
atggctctgtttaagaaaaagaaatatattcggatcaatcctaatagagagagcaaacctgctaactcgccatctgttcctgataacatgtgggcaaagtgtccaaattgcaaacatatcctttatacgaaagacatcggtgaagaaaaagtatgccctcattgcggatacgcttttcgaatcggtgcatggcagcgtctagctttgattattgatgaaaaaagttttgaagaatgggatacggatcttgtaaccaaagatccgctagcatttcccgaatatacggaaaaaattaaaaaaatgcaagataaaacaggacttcatgaagcagtcctcactggtaaagcaaccattcaggggattcccttcattattggagtgatggatcctaattttatcatgggaagtatgggaacgattgtcggagaaaagatcaccagattattcgaacgagcaacaaaggaaagtcttccagtcgtcttgttcacagcttcaggtggcgcacggatgcaagaaggaatcttttctctaatgcagatggcaaaaatctctgctgctgtcaaacggcatagcaatgaaggtcttttttatctaactgttttaacggacccgacgaccggaggagtaactgccagttttgcaatggaaggcgatattattctagcagaaccccaaagcttgatcggttttgctggaagacgcgtcatcgaacagacgatcaagcaggaacttccagaagatttccaaaaggctgaattcttattatctcatggttttgtcgatcagattgttccccgcatggaattgaaacagaaaatccatacgcttcttgaattgcatacacagaaaggatggatagatcgtggataa

SEQ ID NO: 171 - DNA (genomic), 711 bp, Enterococcus faecium; double-stranded, circular
  misc_feature (B) LOCATION 1...711
  hypothetical: NO
  anti-sense: NO
tcacgacatccttgtattttgttattttcggganaaatgatcggtgggcggatcggagacatgggtggtttttcatatatggaattcatcgttcctggtttgattatgatgtctgctatcactagttcgtatgccaatgtttcttcgtccttcttctctcaaaaatttcagaaaaatatcgaagaaatcttggtagcacctgttcctacgcatgtgattatttggggctttgtgattggtggtgtgggtcgcagtattctcgtcggctctctcgtaacgatcatttccttgttctttgtaccacttcatgtgtattcatggttcatggtcatcattacattattgatgacggcaatcttgttttcattagcaggactgctcaacgggatttttgctcagtcttatgatgatgtatcgatcgtgcctacatttgtcttgcagccgttaacttatctaggtggcgttttctatgccatctctatgttaccgcccttttggcaagctgtttcaaaagtcaatccgatcgtttatatgatctccggtttccgttacggattccttgggacgatcgatgtgccagtagcaacatcgatgatcgtacttgtgttattcatcgttgttttgtacgccgttacttggtatttgatcaataaaggaagacgattgagtagtttgaaagccgcgccctnatcnaanaaatatggtgggagg

SEQ ID NO: 172 - DNA (genomic), 357 bp, Enterococcus faecium; double-stranded, circular
  misc_feature (B) LOCATION 1...357
  hypothetical: NO
  anti-sense: NO
gttcataatcccgatcgtacattccaattgaatattgcagctcctggtaaacgcgtcgaaaatgcaaccaaccctgaacaattgtttgcagctggtttcagtgcatgttttaacagtgcattagaattgatcaaacagcaaaaaaatatctctggggcttctactgtcagtgcacaagtttccctttattcagaaagtgaaacgagctttgtcttaggtgtagagattgaaggatctatcgaaggtctttctctggaagaaacgcaagaattattagaggcagcgcataaagtgtgtccgtattcaaaagctacagctggaaatatagaagttactctgaaagcagttagtgaatag

SEQ ID NO: 173 - DNA (genomic), 357 bp, Enterococcus faecium; double-stranded, circular; identical to SEQ ID NO: 172
  misc_feature (B) LOCATION 1...357
  hypothetical: NO
  anti-sense: NO

SEQ ID NO: 174 - DNA (genomic), 219 bp, Enterococcus faecium; double-stranded, circular
  misc_feature (B) LOCATION 1...219
  hypothetical: NO
  anti-sense: NO
gtaatcaatcctgaaacgaccggtgcgaaaataaaaggaacagccatcatcgggttcatcacgatcggtgtggaaaaaataattgattcattgatgttgaaaaaagctggtaaaagagcaagatttcctaattctctgtatttcttcgatttcgcaaaaaccgtcataaaaaatacagcccctaacgtcaatccagcacccgtaaccgtcatgaactga

SEQ ID NO: 175 - DNA (genomic), 186 bp, Enterococcus faecium; double-stranded, circular
  misc_feature (B) LOCATION 1...186
  hypothetical: NO
  anti-sense: NO
ttaccaaatccaaataagattaccccaagacctgcaatgatcatcaaaatgatcgttatgactttgatgatcgaaaaccaaaattctaattcgccaaacgccttgacagaaataagatttgccagcataagaaacaagacgacaatgattccgggaataattgccggcaaatcaggccaccaataa

SEQ ID NO: 176 - DNA (genomic), 1455 bp, Enterococcus faecium; double-stranded, circular
  misc_feature (B) LOCATION 1...1455
  hypothetical: NO
  anti-sense: NO
aaaggaaatcctattatgtatagttatcaagaagatgcaaaagtccaaaaaaatcgctggtggattttgattgctatatctatgtttaccttcatgtccacattggatggcagtattgtcaatattgcactacctaccatctcagatgatatgggcataccaatgaatcaagcggaatgggtagtgtccgtttatctgatgattgtctgttcttgtttgttgctgtttggtaaaattggcgatagccgtgggaaaatcaaagtatttcggattggtacgctgatctttgtcttgggatcgctgttgtgtgggttcaatcattcgctaggtattttattgttcgcacgggtggtacaagccattggtgctagtatgactatggctacaaatgccggaatcatcacggaagtctttcccatacatgaacgtggtcgggcattgggagcaataggtgcgtttgtttcattaggctcgattgctggaccaggtcttggcggcttgattttgtcccaattttcttgggcgtacattttttggatcaatgtaccggtgggaatcgtaacgatgttgattgctgaaaaattcttaccaaaagatatcaccatgagcggccatacaatcgatggagggggctttgctgccattgcggctacgattatcagcttttttggagcaatctttttggggcaagaaagtggctttttccatccagtcccccttgtactgttcgtaatttcagtgattgcctttgtcagctttttaaaagttgaaaagaaagcagcctctccattgatttctttcggtatttttaagaacaagatttttaccatgagcttgattacagccttgttgattttttcttccaacttctttgtcaatgtagtgattcctttttatctgcaaaatgctcgcgggttgagtcctagctatgctgggctgttgatgatggtctttcctttgatgatggtcgtcggggcgcctttaagcggctacctgaccgaccgggttggcccggagattttggtattagtaggcttgggcttattgtcggtaacccaggtcatgtatatgtttttgtcagtggactctcctttgtggctatacattgtcgctactgccatcatgggtgccggcaatgccttgttccagtcccccaataatacgatggttatgagctcggtcactatcgaaaacttgggactggcaggctcgatgaattcctttgcccgaaatttggggatggtcagcgggatttcgctttctacgacggtcttatatcaagcgatgtctgctaagatgggccagcaagtaactaactatatcgcaaatcggccggatgtctttttatatggaatgaagattacctttttaggcagctttgttttgtgttttgttgcctttttcctgactatctggcgtatcaaaaaacaaggaggtattcagaaaaatgtctga

SEQ ID NO: 177 - DNA (genomic), 768 bp, Enterococcus faecium; double-stranded, circular
  misc_feature (B) LOCATION 1...768
  hypothetical: NO
  anti-sense: NO
caattgaatccaattatattgaaacgttctgtccatcatattccagtgttagaagttgttctgaaagaattaagagaggaacgtattcccgttgtcatctattatcacggatggcagacaagtaaggagttagttttgacgcaaggaagaaaaattgcgcagcagggcattcgtgtgatcctgccagatgcgatgaatcatggggagcgcaaacagccggtttcttctattccatcctatacattttgggatagtatctacggaaatctgtttgaatttgacacacttatcaagcatttagaaaaaagaggtcttctacatgatcagcttgcagttggcggggtttcgatggggggaatgacaacatgcgccttgttggctaaacatcctcatatagtagcgggcgtgtgtttgatgggttcccctgcacctttggaatatggaaaagaaatcgtaaggcgcgcatcggaatataattatgtcgtaccaaaagactattttgatttgatttcatgggttaagagctatgatttgtcattgcagccggaaaagttagctggacgtcctctgttcttttggcatggacaagctgacgaaaaaatcccttatatacaaacggaacgatttgtagaaaaaaatcggcataagtcttacggaaaagaaattgtttttcgttcctcaaaaacacagcgacatatggtacaaataccactaatggaagaagcttccacttttttagcaaaaaatttgataaaaaagtataaataa

SEQ ID NO: 178 - DNA (genomic), 372 bp, Enterococcus faecium; double-stranded, circular
  misc_feature (B) LOCATION 1...372
  hypothetical: NO
  anti-sense: NO
tttcatgatccaaggcggcgatccaactggaacaggaatgggtggcgaagtatttatggcgaaagttttgaagatgaattcagtcgtgaactgttcaaccttcgcggagctttatctatggcaaattcaggtccaaacacaaacggaagccaattctttattgtaaataacacaaatgtgccagctaatatgcttggacaactagaaggtgctggattcccatcagaaatcattgaagcgtataaaggtggcggaactccttggctagatttccgacatacagtctttggacatgtactagaagggatggacacagtagatgaaatcgcaaatgtacaacgtgtccacaagaccgacctgtacatgatgtag

SEQ ID NO: 179 - DNA (genomic), 267 bp, Enterococcus faecium; double-stranded, circular
  misc_feature (B) LOCATION 1...267
  hypothetical: NO
  anti-sense: NO
gatcccgatcccagctgcgatgacccgcaggatcccccagaagaaggaatcaccgatcccagagatagggcccatcaaggaagccttaacggcggtgatggagctgtcatcgaaggttgggtcttcactgttttgtttttccatggaggctaccagccccatgatgaagttgttgatatgcatggtggcattgaaccaagtggtatggcggaccaaggcatcggcctgttcttctttggttttgtagaaacgattgatcactggtaa

SEQ ID NO: 180 - DNA (genomic), 321 bp, Enterococcus faecium; double-stranded, circular
  misc_feature (B) LOCATION 1...321
  hypothetical: NO
  anti-sense: NO
acgttctgtccagacaaagagcaactatataaaaggatgatgaagaaaatggtgaacggtttaaaagtgaaaacaggccctcaattttatttatatgaagaaggtggtatttcaaaagtttctgatctcttgaaatcatacggcgcgaaaagagtactggtcacccacggaacggtatcatgggaaaaggcgctacctaaattagtatttttgaatgacgaaacgattcaatttttttatcatcgttattctggagaatgtagttatgctgaagccagacgaatagctacaatcatcaaaaaaatgaaatcgatttcgtag

SEQ ID NO: 181 - DNA (genomic), 360 bp, Enterococcus faecium; double-stranded, circular
  misc_feature (B) LOCATION 1...360
  hypothetical: NO
  anti-sense: NO
agcaggtgtcctgcgatgattaaaaactttttcaaaggactgttatttggagctgctgctggcactgtcggaggtctgttattggcgcccaggagcgggaatgaaacaagaaagaaactgatcgaagaattggaagaagcaacaactctgacaaatgatttaaataacagcctgaatcattttaaaagcgcattgatcgaaacaaaagaaacagctgaatctgtgattcctgctttccaagaagcaatcaaaaaagatatcgaagattttaaattccaagccgaaccacgtatcacacaaatcaatgaacaagtagaaaaactaaaagctgatctgccagagtatcctgaacaaatataa

SEQ ID NO: 182 - DNA (genomic), 483 bp, Enterococcus faecium; double-stranded, circular
  misc_feature (B) LOCATION 1...483
  hypothetical: NO
  anti-sense: NO
ttgttgctgtttgccttttttaccttttttattataacgattacggttattattattaaatttgccgcgattgttattgtttggtttgttgttattgttagtacggttttgattgccgccttggctcgttccttgacgattttggctgctggtatttcccgtattattttggtttgttgttggtttttttccttgattcacttgaccgctcccttgaccgcgatcttgataactgcggttatttttatttttttgttgattgttcgttgtttcttttttacgttgatcgttcggctgttgattggctggttttctgcttgcttgttgtgcagcttgttgtttcgtgcttgggtttttgaacgcttgttgcaatttcttctcatcattgctagtaatcgcacccatatggtttttcacatcgatgccaagttgttgtgctttttccacgacgtctttactaaattttttgagttcttttgctaa

SEQ ID NO: 183 - DNA (genomic), 2709 bp, Enterococcus faecium; double-stranded, circular
  misc_feature (B) LOCATION 1...2709
  hypothetical: NO
  anti-sense: NO
atcatacgtcctagaatacgaaagtattttaggacgttttttagtttaaaggaggaaaacagcatgacggaagaaaataacctatcaacaaaatataatccgcaagaagttgaagctggacgttatcagcattggttagaacaagatttgtttaaaccgagcggagataaaaaagcaaaaccttattcaatcgtaatcccgcccccaaatgttactggaaaacttcatttagggcatgcttgggatacgaccatgcaagatatgctgattcgtcaaaagagaatgcaaggatatgatactttatggctgcctggtatggaccatgcaggaatcgcgacacaagcaaaagtagaagcgaagcttagagagcaagggatttctcgttatgatctaggtcgtgaaaagttcatcgatcaagtgtgggaatggaaagaagagtatgcgagccacatccgcgaacagtgggctaaaatgggcttatctttagattacagtagggaacgttttacattagatgatggattatctgaagcagtacgtaaagtttttgttaccttatacgaaaaaggtttgatttatcgtggtgaatatatcatcaactgggatcctcaagcacgaacagctctatctgatatcgaagttattcataaagatatcgaaggcgccttttatcatatgagctatgaactagcagatggatcaggcgtagtagaaattgcgacaacccgtccagaaacgatgttgggagatacggcgattgctgttcatccagaagacgagcgttatcaagcgctcatcggcaaaaaagtgattctacctttagtcaataaacaaatcccaatcattgcagatgaatatgtagatatggaattcgggacaggtgtagtaaaaatcactccagcacatgatccaaacgactttgaggtaggtaatcgtcatgatcttccacgcgtaaatgttatggatgatgatggtacgatgaatgaactagcaggaaaatatgctggaatggaacgttttgctgctcgtaaagcaatcgtgcaagatctgaaagaaatcggtcgattgattaaaatcgatacgatgatccacagtgtgggtcattccgagcggacaggtgtcgttgttgaacctcggctgtctactcaatggtttgtaaaaatggcgccgttagcgaaaaaagccattgataaccaagaaacagatcaagcagtggaattcttccctccaagattcaatcaaacgtttttacgttggatggaaaatgtccatgattgggtaatctcacgacaattatggtggggacatcaaattcctgcatggtatcacaaagaaacaggtgaaatgtatgtagggatggaagcaccagcggatagtgaaaactgggtacaagatcctgatgttttagacacttggtttagttcagctttgtggcctttctcaacaatgggctggccagatacggaaagcgaagattataagcgatacttccctactagcactttagtaaccggttatgacatcattttcttctgggtaagcagaatgattttccaaagcttggaatttactggcgaacgtccatttgagaatgtcttgattcatggattgattcgtgacgaacaagggcggaagatgagtaaatcattaggtaatggaatcgatccgatggaagtaatcgaaaagtatggagcagatgctctccgctggttcttatcgaatggttctgcaccaggacaagatgtccgcttcagctatgaaaaaatggatgcttcttggaactttatcaacaaaatctggaatgcttcacgtttcgttatcatgaatatcgaaggaatgaccgtagaatatatcgatttatctggagaaaaatcagtggctgaccggtggatccttactcgtttgaatgaaacgatcgaacgagtaactgagctatttgatcgttttgaatttggtgaagcaggtcgacaactgtataactttatctgggatgatttttgtgactggtacatcgaaatgagtaaagaagtactttatggagatgatgctgtttcaaaacaaaccacccgtagcatcttagtccatacacttgatcagatcctacgtttattgcatccaatcatgccattcgttacagaagaaatatgggaacatattcctcatcagggaaattctctagtagtggcagaatatcctgttgtacgtccagagtttgatgatgaaacagcttctaaagggatggaagtattgaaagaattgattcgagccgttcgaaatattcgttcagaagtgaatacaccattgtctaaaccaattacgttgctaattaaaacaaacgatgctaaaatcgatcaatttttagttgaaaatacaagctatatcgaacgcttctgtaatcccgaagagttgacgatatcaagtgagatcactgcgccagatctagcgatgtcagctgttctgacaggtgcagaaatcttcttgccgttagcaggattgatcaatattgaagaagaaatcaaacgattagaaaaagaactggaaaagtggacaagcgaagtaaaacgtgtccaaggaaaactttctaatgaacgttttgtttctaacgcgccggaagaagtagtagaggcagagcgtgcaaaagaaaaagattatttagagaagcaaacggctgtcaaagaacgaatcgaaagtttgcgtactattcaataa

SEQ ID NO: 184 - DNA (genomic), 219 bp, Enterococcus faecium; double-stranded, circular
  misc_feature (B) LOCATION 1...219
  hypothetical: NO
  anti-sense: NO
ccgctgcgtccacatggtctaccgggactacctgcaagacccgaagccggagaaaatgccggtgctgggcgacctttaccgccttttgcgggaacagccggaggcggaagcacagcggcttgctaccgcgctggaaatctacgttactggcagcttaaatgtgttcaaccaccagaccaacgtggaaatcaagagccggattgtctgctatgtgattaa

SEQ ID NO: 185 - DNA (genomic), 246 bp, Enterococcus faecium; double-stranded, circular
  misc_feature (B) LOCATION 1...246
  hypothetical: NO
  anti-sense: NO
ggaaagctgttggacgaagaagtgaaagtaaaaatcagagaggattttacggtaggagagatcagttctcggctgtttggctcatttgttgagcatatgggaagtgtcctctatacagggatttatgaaccgggccatgaaacagctgatggtgacgggtttagacaagatgtcccctccttatgtaaaggaattagaattaggtgtcattcgctatcctggaggaaactttacatctggttatga

SEQ ID NO: 186 - DNA (genomic), 222 bp, Enterococcus faecium; double-stranded, circular
  misc_feature (B) LOCATION 1...222
  hypothetical: NO
  anti-sense: NO
attataagtccatgggaagaaggtagatttatgaattctttaaaagaagatttcattttagcaaaggctggaaatgaagaagctgttgaggcaattctcaaaagatttagctctttgattcataagcaatcctggagaactggaaaatatgatcaagattgttatcaagaatgtatgcttgcaatatatctagctatctcgaaattcgaaattaaagaataa

SEQ ID NO: 187 - DNA (genomic), 873 bp, Enterococcus faecium; double-stranded, circular
  misc_feature (B) LOCATION 1...873
  hypothetical: NO
  anti-sense: NO
cagtcaagtcccctnttcagttcgtcaaacaatcgaagagaatttttcccggaaatcaatgtgttgttcgctgatgcggggtatagacaccctaagtttgttcactttttgaatcatttgacctttcgaccttgtttgctttattcaaggcccaaagggaaaaaggagctattatcaaaatatgagtttctctatgacgagtattttgattgttatatttgtccgcaagatcaaatgctcgctttttcaacggttactcgagaagggtaccgagaatacaaatccaatccaaaagaatgtgtgaactgtcctctgctaaaccaatgtaccataagtaaaaatcatcaacgagtcatcacgagacatgtttggggagatctgatggatgaagtggaacatcttcgcctaacagatctgaataaatcaatttacaaaaaacggaaacaaacgattgaacgaatatttgcggatgcaaaagaaaagcatgggatgcgttggaccaagtatcgaggcttggaaaaagtcgcgacgcatacgatgctagtgtttgctgcaatgaatttaaagaaattagccacctggctatggaaaggcaaggagcctttatttttttgttcaaaaattcgaaacgaagtagataaaaagctgttccaagctcgagttacgagtttggaacagcttttgtctacagtctgcgatgtcggagacatctcgttttctattaggaatcaactcaggttcaaaagaagcctcccggtctctgggaacatcaatgtttactttaccaaagctcgttttaagcgtcttattgccataaccgtttcgtcgattgtcatgtttctttggctctttagaatgggcgtcataccctaa

SEQ ID NO: 188 - DNA (genomic), 486 bp, Enterococcus faecium; double-stranded, circular
  misc_feature (B) LOCATION 1...486
  hypothetical: NO
  anti-sense: NO
atgcttatgttacaacaatacaaaaaaatcatggttgccgtagatggttctgatgaagctgaattagcttttaaaaaggcggtcaatgtagctatccgaaataacggagaacttgtattagcacatgtcattgacacacgttctttccaaaccgtttcatcctttgatggaatgcttgcagaacaagctactgaaatggcaaagcaaacattggcagattatgaaagcaatgcgaagaaagctggcttgaataatgtaacctctgtcgtagaatatggctcaccaaaacaaattattgccagagaaatcccagaagataatcaagtagatttgattatgttaggagccacaggattgaatgctgtagaacgtttatttattggttctgtttctgaatatgttattagaaacgcagcttgcgatgtgcttgttgtccgaactgatttagaaaaccaattgccagctaaagaccacaccaaagcttaa

SEQ ID NO: 189 - DNA (genomic), 684 bp, Enterococcus faecium; double-stranded, circular
  misc_feature (B) LOCATION 1...684
  hypothetical: NO
  anti-sense: NO
cggaatatgttaagcaaacaaaaaacaatggaagctctagaaacgatgtatggaatgtttcccgaagcacatggagaactcaagcacaataatccatttgagttattgattgcagtgatcttaagtgcccaggcgacagatgtatcagtgaataaagcaacgccagatttgtttgcctcttttccgacacccgatgcgttagcagaagcttcaatcgatgaaatcattcttaaaataaaaacgattggtttgtatcgaaataaagcaaaaaacatcaaagcgtgtgcacagcagctgattgaacgtttcgatgggcaagtgccaacgtcaagagaagaattgatgtctcttcctggtgtaggcagaaagacagcaaatgtcgtattgggggatgcattcgggataccagcaatcgcagtagatacccacgtggaacgtgtctcaaaacgcctgaggatctgcaaactagatgctacggtcatggaagtagaagaaacactgatgcggaaagtaccacaagaattatgggtaaagacacatcatacactgattttttttggtagatatcattgcacggcaagaaatcccaagtgcgaggtatgtcctttgctatcaatatgtcaagatgggaaaaatcggatgcgtctaaaagaaaaggcgctaaaaaagaaaccacgcctgtag

SEQ ID NO: 190 - DNA (genomic), 303 bp, Enterococcus faecium; double-stranded, circular
  misc_feature (B) LOCATION 1...303
  hypothetical: NO
  anti-sense: NO
atcgatatgttaccattctttatttattggggcgttattctggcttgtatcgcctggttagcgttaagcgtttatttctctgttttttatcttgtacgcaaagaaaatggaaatctttgggcttttgctttattcaacgtgattgccgcaattgttttagccattacattagccgtatatcgaacatggggctggggaatcacccaatactcaagtttgatttatctaatattagccatttatggcgtcgttgttcttttgcaagcgatcctaggacgtgagccaaagaaagcggcagcttaa

SEQ ID NO: 191 - DNA (genomic), 459 bp, Enterococcus faecium; double-stranded, circular
  misc_feature (B) LOCATION 1...459
  hypothetical: NO
  anti-sense: NO
ataagtatgttaacaatatcaaaaggagtgtctcttatgaaaatcgctttgatcgctcatgaccgaaaaaaacctatgatggtgaaattagcaacagcgtataaaacaatattggaaaaacatgaactttttgctaccgggacgactgggcagaggatcacggaagcaaccggcttgccgatccatcggtttaaatccggaccgttaggcggggatcagcaaattggagccatgatttcggaggatcagttagatttggtgatttttcttcgagacccgctggctgcacagccccatgaaccagatgtaacagcacttatccgtttatctgatgtctatgagattccgttagctacgaatatcggaacagctgaggtgctactaagaggactggaagccggcttcctagattttcgaagaatcgtccatgaaatagacaagcatccactttcattttga

SEQ ID NO: 192 - DNA (genomic), 1557 bp, Enterococcus faecium; double-stranded, circular
  misc_feature (B) LOCATION 1...1557
  hypothetical: NO
  anti-sense: NO
caaagtatgttagatgtcatagatggtcgtacatctttagggattgagtttggatcaactaggatcaaagctgtattgattgattcatcttttactcctattgccgctggtagttatgagtgggaaaacaaactagaaaatggtatctggacctattcattagaagatatttggaaaggactgcgcgtcagttaccgaaaaatggcagcagaagtattcgaaatctatggcgagaatcttacgacaatcgggtcgattgggttcagtgcaatgatgcacggttatctagcatttgatagcaaggaacagttactagtaccatttcgtacttggcgaaatacaatcactgaagaagcagaacgaatattaacggaaaaatttcaatacaatattccgcagagatggagtatcgctcatttgtatcaatctattttgaataaagaagaacatgtgaaagaaattaattttttgacaacgcttgcaggttatgtccattggcagcttactggtgagaaagtactaggcgtaggagatgcatcaggcatgtttcctatcgatccttcaacgaaaacctaccatcaagaaatgaaaaatatttttggtcagttaatcgaaaaagcgcacgtagcgattgacttggatcacattttgcctaaagttctagtagcaggagaagaagctggcaagttaagcgaatcaggggcttatctgatcgaccctacgggaaatttgagaccaggaatcccggtttgtccgccagaaggggatgcaggaaccggtatggtcgctacgaacagtgtagccaaagggacagggaacatttcggctggtacttccgccttcgctatgatcgtattagaaaaagaactagaaaatgtccatccggaaatcgacatggtcactacaccttcaggagaactagtaggcatggttcatacgaataactgctcttcggatatcaatgcttgggtcagtatttttgaagaatttaccaattctttgggtatggagataagcagagataaattattcacggtattattcaacaaagcgctagaaggcgatacggattgcgggggattactttcttatggttatttttccggtgaaaacattacaggagtaaatgaaggaaggccattatttgtacgtacaccaggtagccgttttgatttagcgaatttcatgcggatccatttagccagtgcttttggtgcaatgagaatcggaatggatatattgaaatctgagaatgtccaaattgatcgtttagtggggcatggggggatttttaaaacaccagaagttggacagcggattctagcatctgctatggaggcaccagttacagtgatggacacagccggagaaggtggagcgtggggaatcgcgttattagcagcctatatgatggatcgacatgggaagtctttagaaaacttcttggcagaagacgtgtttggacaagaccaaggaatcaccatcacaccttcagcagaagaaatagcaggctatcagatatttatgagaactgttaccgtgagggatcgacattga

SEQ ID NO: 193 - DNA (genomic), 2031 bp, Enterococcus faecium; double-stranded, circular
  misc_feature (B) LOCATION 1...2031
  hypothetical: NO
  anti-sense: NO
ctgtacatgttagaagcgattaaaacagctttttcaccacaaaatgatcaaaaagtacttgatccattaaagcaactaggaaatcgggaaatagaaattttaaaatccaaaggatatgatttagattttttaaaacaagtgatgccacaaggtggattaaatttcgatgaagagtatgtgacctatggaaatggttattcacggtgtgtgacagtttatcactacacaaaaaatcctactcttttttggttggccaatctcatgaacaatcctcatacagtggccacactagatgttagcacagatgaaaagcaaaaagtgattgatcaaatcaatcgcgcattagatgaattaaatgatcgatcagataatgaacgaaaagcgactgaccgaaataaaagtgcggaagaatacctggagctagcggaatatgcccgaaaattgacttctaatggggaaatttctaaacaagtcaaagtgagagtacatgtttacggaaacacgattcaagaagtagatgaacgggcgcaggaactgatcaaaaatctaaaagggatggattatcgtgcggtgacttatctgcataaaaccaaacgagattggcaatcgatgtttaccatgttcgatgaacaagctgaatggttcggaaatatcaaagggcaatcactaccatcgttaaacattggcggaggtttcccgttccaccaccaaacgctaaaagatccaggaggtacacaatatggggaaaccatgacaggcggcccatttgtctggaatgcgacgtataaaaatagtgtacggttgtctactaataccttgcttctaggaatgatgggagctggtaaatcgaccgttcttaaaatgatcgcggaagcccatttagctgcaggagactttatttggggctttgaaaagggaaaagactttattcctttcttaaaggaatataacggtattatggtgcgtttagacggatctgacgggatgatcaatcctttagagatatttgccacacggacgtatgatgaagcatccagtttatatgacgatggatcagtcaaagatttgaagatcaatgaagcagcgtcctatcaaacacacttagacaaagtggtctatcaggtacagttagtgagtcctcagctaaaaggaacgatgaaagcagaatttaagacctacttaaatcgtttttatgaagagtatggaacagtaccacgcggctttacttcctcaaattcgcgttcaaatactgagacgcaagtcacagggaaagatccagaagcttatccgacgttcaaagaatttttagactttttaggacaactggaattaccaggtgcttcccaagagaaaaagaatcgaaaagaagaaatggaatccatcgtagaatccttatgtgagacgtatggcatgatttttgatggtcacagtacgattcgacaccttgaccaacaacagttggtcttttttgacattgactctattacaggcttagatcgaggggtacaacaatgtcaaatgtacatggctatgacgttgatttggaatcaggcattgattcaaggaagaagacaacgacgtttaattaaagaaaaacaaatggaagaacaagacttcaaacgcttcttggcgatgattgatgagtgccataatgcgattaatccagattttattgaaacggtaaattatgtcacaaactttcaacgagaaatgcgtaaagtagaagcaatgactgttttagctacacaatccccacaagaaatggtgccagaaaatatgtcttctgataacttctcgaaactgaagaaagtctttgaattttcttctacgaagatctttatgcgtatggatgaatctattttacgtcatatagaaggattagttggtaaatcaatgacgaactcagaactagaatccattcctcaacaaaatcaaggagacgctgtgatcaattttggctcaaaagaaaccattcgtgttcattttagtccgaacaaacgtcaattaaaattgtttgatggaggaaaataa

SEQ ID NO: 194 - DNA (genomic), 183 bp, Enterococcus faecium; double-stranded, circular
  misc_feature (B) LOCATION 1...183
  hypothetical: NO
  anti-sense: NO
ccccttttcccaaataaacggtgttctcctgccaactccgaatcacgagtcacaatattcatcaaacatgagatgctgttttttgaaattgctccttgtaacgcagagttaaacggcaggcacacaacctctgaatggttgtccttttattattttgtagatcctttttcttcgattccataa

SEQ ID NO: 195 - DNA (genomic), 1038 bp, Enterococcus faecium; double-stranded, circular
  misc_feature (B) LOCATION 1...1038
  hypothetical: NO
  anti-sense: NO
cggaaaatgtttttagaaatacatgatctcaatctgttttttgatgaaaaacagattttagctattgatgaaattcagattgaaaagggtgagctggttactttactaggtcccagcgggtgcggaaagtctacgttgctgcgctgtatcacgggattggaacaaccaaagagcggtgagattgtgctggacaatgagaatattgccgataagcctacgaaggatcgcaatatcggctttgtttttcaacagtatgcattgtttccaactatgactgtttttgaaaatgtagcctttggtttgaaggtaaagaagctgagtcctgaggtgattcaggaaaaggtttttgagatgctatcattggtggatatgacggagcaggcagataaaaatgtccagtttctttctggcggtcaacgacaacgggtggcactggctcgctcattggtcactgaaccgaaagtcctgctgctggatgagccattaagtgctttggatgcccgaattagaaaacagctgcagcgggatttgcgcgctatccagcaatcgctagggatgacgatgatttttgtgactcatgaccaagaagaggcgatgcgaatcagtgatcggatttttgtgatggaagctgggcgggtggctcaggtttccacctcgaaggaattgtatcagaatcctcagagccgatttgttgcggaatttatcggcaactataatcgtttcgaatggtatgagctgaatcagtatacccacgagttttccgctaagggcaatcgctgcatttattatttaagaccggagctgattcaatttgaaccggttcctcagggggttaagattccggttctatggaaggaatcatttattttaggcaacattcaacggtatgtttttcaaacgctggagggcaaagaaattttagtggatcggttgaacgatcgggaagagaaaattagcgatgccttatacattcagctgaaagatattctagcaatccctgtggaaattgatactcagcattttgcacaacaaagctag

SEQ ID NO: 196 - DNA (genomic), 405 bp, Enterococcus faecium; double-stranded, circular
  misc_feature (B) LOCATION 1...405
  hypothetical: NO
  anti-sense: NO
tccgccttcccgtggctgatgactattttcaaaaaacatataaaagggaataggagaacacaaatggaaaagcaaacaatcactatctatgatgtagcgagagaggcaaatgtttcgatggctactgtttcacgtgtcgtaaatggcaatccaaacgttaaaccagcaacaagaaaaaaagtcttggaagttatcgatcgcttggattatcgtccaaacgcagttgcgcgtggcttggcaagtaagaaaacaacaacagttggtgtaatcatccctgatgtcagcaatatgttctttgcttctttagcacgtggtatcgatgatgtggcaacaatgtacaaatacaatattatcttagcaaattcagatggcaacgaccaaaaaagaagtcaatgtattgaataa

SEQ ID NO: 197 - DNA (genomic), 222 bp, Enterococcus faecium; double-stranded, circular
  misc_feature (B) LOCATION 1...222
  hypothetical: NO
  anti-sense: NO
aatagcttcccctattttacaaaattgtgccttattgccgatagtctatctcttgaacaccgtttaccaagagattatgaacctgccaattatcgccgagtcacaaggaataatttcagaaaaagctcgtcacgttttatgaatatggtaatttgtgaccgagaattttgcagaaagacaccgattaagaagaaggttgtcacaacgattttcttcatttaa

SEQ ID NO: 198 - DNA (genomic), 1035 bp, Enterococcus faecium; double-stranded, circular
  misc_feature (B) LOCATION 1...1035
  hypothetical: NO
  anti-sense: NO
aggagaatgtttaatatgaaagaatcagtattccaaggaagaagtttattagcagaaaaagattttacaaaagaagagttacaatatttgatcgatttttcagaacacttgaaagacttgaaaaagcgtgggatcccacatcactatctagaaggaaaaaatatcgcacttttatttgaaaaaacatctacacgtactcgttctgcatttaccactgcagcaatcgatctaggtgcacatcctgaatacctaggtgcgaatgacatccaattaggtaaaaaagaatcaacagaagatacagctaaagtgttaggtcgtatgtttgacggaatcgaattccgtggattcagtcaaaaaatggtagaggaactagcagaattctctggcgttccagtttggaatggattgactgacgaatggcatccaacgcaaatgatcgctgactttttaactatccaagaaaactttggaactgtagaaggcatcactgttgcatactgtggggatggtcgaaacaatatggctaactctttattagtaacaggtgcaattttgggagcaaacatgcgtatcgttgcaccaaaagagttacaacctgaagaagaaatcgtcaaaatggcagaaggttttgctgaaaaatcaggggcacaattgatgattaccgacgatgttgataaaggtgtagacggagcagacgttctttattctgatgtatgggtatcaatgggtgaagaagataaatttgaagaacggatcaaattgttgaagccttaccaaatcaatatggaaatggtagaaaaaacacacaatacagatcgtttgatcttcttgcactgcttaccagctttccatgatacaaacactgtttacggtgaacaaatgaaagaacgttttggcatcactgaaatggaagtaacagacgaagtcttccgcagcaaatatgctcgtcaatttgaccaagcagaaaatcgtatgcattcaatcaaagcaatcatggcggcaacattaggtaacttgtttatccctcgcgtttaa

SEQ ID NO: 199 - DNA (genomic), 471 bp, Enterococcus faecium; double-stranded, circular
  misc_feature (B) LOCATION 1...471
  hypothetical: NO
  anti-sense: NO
gcggtattcccgtttatatatttcggcgtatgcagaaaggggggtgagattatgaacacatcttctttcgagcatatcgtcagaatacagtttaatgctttgatgataactgttattaaatgcacagtaaaaagcagaaatagacagtttgcaagacgttccaagcgtgaggttttattctatgaattatcagatacgaaaaatcttgaatgtgtaactgaggataaatattcttgtgattatatttcttttgaagtcttgaatttcacaattcaaatatcaaacgagaaacttgctgttgctttatataagttatcgagtaaagagcgtgatgtaattctattacgctattttcaaagcatgagcgaccaagaaattgcagaattatatcatgtatcacgttctgctatttatcgcagaagaagtaacggattgaagaaattaaaaacattattgaaagaaaggaattga

SEQ ID NO: 200 - DNA (genomic), 441 bp, Enterococcus faecium; double-stranded, circular
  misc_feature (B) LOCATION 1...441
  hypothetical: NO
  anti-sense: NO
acgcagatgttcaatttacggcgagttacagaaggaggacagcaaatgataccgagatttcgagcgtgggataaaaaaacagaaactatacaagagatagaatcaatatctttcaaagaaaaaaagctagtgattgatcaaaaatctgtcacttggttcaactcggattatattagaaactctgacgaagttgaactcatgcaatccacaggactgaaagataagaatggtgtggagatatttgaaggggatttggtagagcatgacgataatttaaatggtgattgggaaacatttgaagcttgtgaagttgtatatgacaaagattacgctcaattttgttttaaatgggatgccggtaatttcctgacggattatcgcaatttaaatgttatcggaaatatctacgagaatagcgagttattggaggaacagcgatga

SEQ ID NO: 201 - DNA (genomic), 3288 bp, Enterococcus faecium; double-stranded, circular
  misc_feature (B) LOCATION 1...3288
  hypothetical: NO
  anti-sense: NO
acaaagatgttcaagcgagcatcttatttttttgtgcttaatttgaaaggagaacatttcatgtataaaaaacaaaaaaagaaattatgtgtattaactattttgagtttggctgttcaagcaattgttggagcaattgctcctacgattacttttgctgatgaaattactcatccacaaacagtgacggttgaattagatttagcgcatcaatatgttgttgaaggaactttcagtgacggtcgtccaatgtcagaagtcactgttccacattatgctgtgtacaacggcgtgaaacaagatattttctgtattgagccaggagtcccaattgacaatgagttcacgccgggttatgagaaaaatccattgcctgatatgccagagaaagcgaaactagtttccgttctatggaaaaaagccggtacagatgtagatactcatattgtggcacagaagatgatctggcaagaagttaatgggtatacccttcactcaatcaaacgattgaatggtagtgccgtaaatatcgcagccattgaggcaaaaatcaatcaagccattgccgattatcagaagaaaccaagcttccataatagtacggctaaaatagtattagggcaatcgactactatgacggatacgaataatctgaatttgtcagagtttgatgaagtggtggaaaataccgcaaacattgattatcgtgtgaatggcaatcagttgataatcaccccaaatgcgagttcaaaagaaagtggtgtgctgacgcttaagaaatctgctggcaccggaacacctgtcgcctataaaaaggttggccaacaaaccctgatggctggggcgattgataaaccgaacacttacacggtcaaaattgatgtagaaaccgagggttctttaaaaatcaaaaaagttgataaagaatcaggtgctattgtaccaggaacggttttccatttagactttggaaaaaatttacctgcaaaagacgtgactactgacaaagaaggcattgctacattggatgagattcctcatggtacaaaggtaaccattaccgaaaaatcagtaccggcgccttatacgattgataccacccccatgactaccaccattaaagcaggtgaaaccatttacgtgacttcaaaaaacgcacaggaaaaaggtcaaatcattctggataaaagcggagttgaaacagggagtgatctttggaatgacaattattccttagctggtaatacgtttgccattcgcaaagacagtccaaccggtgaaatcgttcaagaaatgaccacggatgaaaacggtcatgcggaaacaccaaaagagattgctaatgcgttggaattgggaacctattatgtgaccgaaactaaagctagtcatgggttcgtgaatacgttcaaacctgtaaaagtcgaattgaagtatgccaatcaaaccgtagcccttgttaccagtaacgtaaaagggcaaaatcaagaagtcactggcgaaaccactttgacgaaagaagacaaagatactggggataaagcacaaggtaaggcagtctttgaggggactgaatataccttgtttactgctaaggatggaaaagcggttaaatggagtgaagcttttaaaccagaaatggtaaagggaacgaaagcttctgatgaaacagtgactctggctttagatgaaaagaatcaagctgccgttaaacacttagccatcaacgagtactactggcaagaaaccaaagcacctgaaggatataccttggatgaaacgaagtatcctgtttctatcaaaaaagtagatgataacgaaaaaaatgccgtgattacccgagatgttacggcaaaagaacagattattcgttttgggtttgatttcttcaaatttgccggatcagccgctggcactgccgaaactggcttcaatgatctgacctttaaagtgtcgccattggaagggaccaatgaaatcacaggtgccgaagatgaagcgaccacagcttataacgagcaattagggtttgatggttatggcaagtttgaaaatcttccttatggggattatttacttgaagaagtagaagccccagaaggttttcaaaagattacgccattagaaatccgttctacttttaaggaaaacaaagaagactttgtgaagagtgagtatgtctttaccattaccgaacaagaccaaaaacaaccaattaaaacggtgaccgttccttacgagaagctgacgaacaaagcattttctgttagtttgaaccgtttaatgctctatgatttgcctgaggaagaagatagtttaacttctcttgcgacttggaaagacggaaacaaagaattaacttctctggattctaccgagctagttgataaattgagttacaatctacatgaaatcaaagaagactggtatgtggtagcgcaagccattgatgtggatgcgacaaaagctgcccaagaaaaagatgaaaaagccaaaccagtggtgattgcagaaacaagcgcaacgttggcgaacaaagagaaaacaggaacttggaaaattcagcataaattaaccgccgaacaagttttaaataaaactattgtcttattcaactatgtgtatgaaaataaggaagcttttgaagcaggcgataagccagtagcgaaggatgttagcttgaataaccaagcccaaactgtcagttgtacagtggaacaccatgtttcgatccaaacaaaggcccacctagaaaacggttctcagacctttactcacggtgatgtggtggatatgtttgatgatgtgtcgattactcatgatgtactggatggctcaaaagaagctttcgaaacaattctgtatgctttattaccggatggtacaaacaaagaaatttggaaatctggcaagattgagtatgaagtaaatgataaagaattcaccaaaactgtgcttgcgaaaaaagtagataccggaaaatatccagaaggaaccaagtttacttttgcggaaatcaattacgataaagatgggactatcaatggaaaacacaatgaagatttgaaagaaaaatctcaaaccttaacaccaaaagaagttccaaccatactaagtacgccgaaacaaccggaaacaccaactgttccaagtggctctcaagaatctagtctcacagtgaagacattccctcaaactggggagaaaaattccaatgtgttactgttcattggttttactttgatttttgcgacggcgggctattatttctggaatcgccggaactaa

SEQ ID NO: 202 - DNA (genomic), 744 bp, Enterococcus faecium; double-stranded, circular
  misc_feature (B) LOCATION 1...744
  hypothetical: NO
  anti-sense: NO
agaaagatgttacaaatctatgcccatcgcggaagcagcggcacccacccagaaaatacgcttcctgcatttgcagaagctgtacgagtaggtgcagatggtatcgaactagatgtccatctaagcaaagatggttatttgatcgttatgcacgacgaagaagtggaccggacgactaacggtaaagggctgattcgagaaaaaacattggaagaactcaaaaaattgaatgcagggggcaaattcagcaaagaatttccagcagctaaagttcctgaattgagagaagtgttaggactgctcctccaaaaaaattaccgagggatgctaatgattgaaattaaaactgatcagtatgaatatcccggtatcgaagaaaaattagccgaaacattaaaaagtagagattggccttttcaacatgcatattgcagctttcatttggattctttggaaaaaatcgcattactggaaccggagatacagctggacttattgatgagtacttctgataaaaagatccaactagcagcagaaaccccttatatagaaggagtacatccaaaaaatacttggttgttcgaacatccagtccaggcagctgattttccaaaagcaattcgtgcatggacgattaacgatgaagaagaaatggccaaatgtcaagaactcaaaatagatggaataataactgattttccggagaaagctcttcggtggaaacaatcaacgaaaagtaggtaa

SEQ ID NO: 203 - DNA (genomic), 1341 bp, Enterococcus faecium; double-stranded, circular
  misc_feature (B) LOCATION 1...1341
  hypothetical: NO
  anti-sense: NO
gagggaatcccattcatggcaaaaacaggaatgtatgtaggccttgatattggaacgacatctgttaaagttgtcgtggctgaatatatcgacagccaaatgaatattattggagtaggaaacgcaaaatcagaagggattaaccgaggcattatcgttgatatcgataaaacggtccaagcgatacaacgagcagtacgacaagcagaagaaaaagcaggtatccagatcaaaggcgtaagtgtcggtttgccagcaaacatgcttgaagtagaaaattgccagggaatgattgcagttaacggagattcaaaggaaatcaccgatgaagatgtcagaaatgtggcttcagctgcccttgttcgttcaatacctcctgaacgtcaaatcgtgtcaatattgccacaagattttactgtcgatgggttcgagggaatcaaagatcctcgtggaatgatcggcgtaagattagaaatgtacggtctgttgtttacaggacctaaaacgatcatccataacatacgtaaatgcgtggaaaatgccggattaatcgtcaacgaaatggtgattactcctttagcgctgactgaatcaattctttctgacggagaaaaagattttggtacgatcgtcattgatatgggtggcggccaaacaacaacggctgttatgcatgataagcaattgaagtttaccaatcttgaccaagaaggtggcgaatttgtcactaaagatatctctattgtattaaatacgtcatttaacaatgcagaagcgttgaaaataaactacggggatgcatacccagaacggacatcaccagatgaagaatttccagtagatgtgattggtcagtcagaaccagtgaaagtcgatgaacgctacttgtcagaaattatttcagctcgaatggaacagattttcaacaaagcaaaagatgcattggaccaaatcgaagcattagagttgccaggtggcgtcgtattgacaggcggagctgctagtcttcctggtgttgtggacttggcacaagaaatcttcggcgtaaatgtaaaattgtatgttccaaatcacatggggctgagaaacccggtatttacaaatgtaataagtatcgtggattattcagcaaacttgagtgaagtgtatcaattggcaaaaattgctgttacgggtgaaacctcagcagctcgtcaaatggtagttgaacaagaaacaacaaacacatatgagagctatgaagcacctgaagaaacaatctacgatgagccggaaccaaaagagtccggagaaaatgtaaaaaataaaatcaagggtttctttacaaatatttttgattaa

SEQ ID NO: 204 - DNA (genomic), 852 bp, Enterococcus faecium; double-stranded, circular
  misc_feature (B) LOCATION 1...852
  hypothetical: NO
  anti-sense: NO
atcacgatcccgttactgcttgtctttctattcggcatttatggattgatcgtttttcttttttggaacggtgtcacagttttacgtagagaatcgcattcattagctaatcttttaacgttgatactagccatttttcttacattgtttcttgtttttgactttttcttgttaaaatatttaccacaatggataaatgctttgtttttctgcatcccattgatcttgatctatctatttatcgtattctacaactttttgactgtctcattcttgtatcagttcaaccgccctcgatacaaccaagacttcatcgttgtgttaggcgccgggttgatcaatggagaaacagtttctcctcttcttgccaagcgaatcaataaggcgattgctttttattgggcacaaagccgtgcgacattaaatccgcctatcctattaatgtcgggtggacagggagcagacgaaaaagtaccagaagcaatggcgatgaaacaatatgccatggaacaaggaattcctgaaagagatattcttgtcgaaaccaattcgacaaccactttggagaatatgcgctattcaaaggaaatcatggatcagcaaatgaaaggtccctatcgcgcgatcttcagttccaacaattaccacattttcagagctggtctctatgcacgacaagcgaaactgaaggcaaatggcattggggcaaaaacagctttctattacttgcctaacgcgtttttaagagaatacatcgccatcttgatgatgaacaaaaaaagacatatgatcatttgcggattgcttttcgcaggttccgcattcttatcactgatcactttacttttctaa

SEQ ID NO: 205 - DNA (genomic), 243 bp, Enterococcus faecium; double-stranded, circular
  misc_feature (B) LOCATION 1...243
  hypothetical: NO
  anti-sense: NO
gcctaccccccagctcctagttacaaggacaaattcaaaaaacagctcttcatattttatgaatgttgtacttgtgattcggaggtggcaagggaacactgtttattcaaaaagaggctgggacagaagcgtttaactccaagaaataagaagaaattcacgaaaattgcttttcaaatttttgtgaatttcttcttatttccgaaggagttgcttctacttccgccgtttatacgtgtttag

SEQ ID NO: 206 - DNA (genomic), 468 bp, Enterococcus faecium; double-stranded, circular
  misc_feature (B) LOCATION 1...468
  hypothetical: NO
  anti-sense: NO
atgaactacccttatttcaaagtatcagcaacagaagatgtaaaagaaaaattcaataagtgctttgaagtaaacaagtcagtatttcaaacaaaatccaatatgttccgttatgttgtttcaaatttaccaatgttaacaaaagccaatcaaaatttccgtgatccagaaaaagaagagttagctaaaaacttagaagaagcaaaattaaaaattagcgaacttgaaacgataatagaattgcaaaaacagcaacttgaaaactttaataaaaaagaagacagtacacataaagattatagtgaacaattaaatagtatagaagagtctgtctataaactattaattaatagtggattagctagtaaagaattagaagaagagcgtgctgaaccagaacaagaaagtagtcgtttgggagagggaacaatgtttagttcaccgtcattaagatttacaacggattga

SEQ ID NO: 207 - DNA (genomic), 1500 bp, Enterococcus faecium; double-stranded, circular
  misc_feature (B) LOCATION 1...1500
  hypothetical: NO
  anti-sense: NO
aaaggagtgttatgtatggattattctagtaaagaatactttgataaaatgacggcttggtggcgtgctgctaattatctttctgttgggcaactttatcttaaagataaccccttactgagacgtacactgaaacccgaagatgtcaaaaaacatccaatcggtcattggggaacgattcctggccaaaattttatttatgtccatttgaaccgagtcatcaataaatatgatttgaacatgttttatattgaagggccaggacacggcggacaagtcatggtatcgaatgcttatttagatggaagttacacagagatctatccagaagtaacggaagatgagacaggaatgcaaaaattattcaaacgattttcatttcctggaggcattgcttctcatgcagcaccagaaacaccaggttctatccatgaaggcggagagcttggatactctctttcacatgcagtcggagctgtattagacaatcctgaagtaatctctgctgtcgtgattggtgatggtgaagcagaaaccggtcctttagctggaagctggttctcaaatgtctttatcaatccagtgatagatggagctgttttaccgatccttcatttaaatggtgcaaaaatagccaacccaacgatcttggcacgtaaatcagatggagaattagcaaattactttaacggacttggctgggaacctttctttattgaaggaaatgattcagaaaaattaaatcctgttatggctgaaaaaatggatcaagcaatcgagaaaattaaatccatccaaaaagaagctcgcctgaagacagcaacagatgtcgtgatgccaaaatggccagtattgatcgtacgcacaccaaaaggatggaccggtccaaaagaatgggacggggaaccaattgaaggaaccttccgagcacaccaagtaccgattcctgtagatcaagaacatatggatcatgcagatgctttactccgttggctgaaatcctatgaaccagaaaaattatttgatgcacaaggacgtattttagaagaaatcagagaaatcgcgcctactggtgaccaaagaatggcaaaaaatcctatcaccaatggtggaatcgatccaagaccgcttattatgccagattggaaaaaatatactttgcaatttgaaaaaccaggctccgttaaagcagaagatatgaccgaacttggtaaattcgttcgcgagatcattgagaaaaatccagaaaatttccgtatatttggaccagatgaaacaaaatcaaaccgattgaatcaagttttcaaaacgacaaatcgccaatggatggaaaaaatcgaaccagaaaatgatgaatggctttcgccatctggtcgcgtcatcgacagtcaattatcggaacaccaagatgaagggttcttagaagggtacgttctgactggacggcatggttttttgcaagttacgaatcattcttgcgagtggttgactctatgttga

SEQ ID NO: 208 - DNA (genomic), 2451 bp, Enterococcus faecium; double-stranded, circular
  misc_feature (B) LOCATION 1...2451
  hypothetical: NO
  anti-sense: NO
actatgtacccgattaagtatattgaaaataatcttgtctttaatcaagagggagaatgttttgcctactatgagttaataccttacaattactcctttttgtcacctgaacagaaatatcaagtccacgataactttcgtcaattgattgcgcaaaatcgtgaaggcaagattcatgccttacaaattgccacagaaagtagtattcgtgccacgcaagaacgatcaaaaaaggaaattaccgggcgattaacagaagtagcgaaacaacgaattgatttacagacagaggcattagtatccatgattggcgatagtcagattgattatcgcttttttattggcttcaaactgattgcgacagatgaagaggtcaatctaaagaatctcaagaaatctttcttctccggctttcaagaatttgtctatggagtgaatcatcatttgatgggcgattttgtttccttatccaatgaagaaattcgccgatataccaagcttgaaaaactaatggaaagtaaattggctagaagatttaaagtcagacgagtcacaccgagtgatctgatgtatttgattgaacatatctatggcgaaaagggtacaccatttgaagaatatgaatttcagctaccaaagaaaaagctgaagtcggaaactttggtgaaacgttacgacttattacgtcccagtcgttgtttgattgaagaaaagccccggtacttatgcatggaacatgagaatcatgaatcatatgtagcgtacttaacaattaatacaattgtgggggaaatggagtttccctcctcagaacttttctattaccagcaacaacaatttacattcccaattgacactagtatgaatgtggagattgtgacgaacaaaaaggcacttgctaccgttcgcaataagaaaaaggaattaaaagacttggacaaccatgcctatcaatctgacaatgaaacaaattccaatgtcttagatgcattggattccgtagatgaattggaaactaccttggatcagtccaaagaatccatgtacaaactgagctatgtggttcgagtaagtgccgaatcagtagatgaactaaagcgccggtgtgatgaagtgctagatttttatgatgataccaatgtaaaactagtccggccttttggcgatatgatggggctacatgaagaattcttaccttctagtaagcgatacatgaatgattatatccagtatgttacgtctgattttctcgccggacttggttttggcgccactcagatgttaggggagttggaaggcatttactttggttataacgtagatacggggcgcaatgtttacctgaaaccggcattggcctcacaaggggtcaagggttcagttaccaatgcgctagcagcggcattcctcggttcactcggtggcggaaagtcctttagtaacaatctcttagtttattacgccgtcctttttggtggacaagctgtgattgtcgatccaaaaggggaacggggtggctggaaagaaaccttgccagaaattgcggatgaaatcaatattctcaacttaactagtaagccaaaaaatcaaggattacttgatccttatgtgattatggagaaaaagaaggattctgaaagtctagcaattgatattctgacctttttaacaggaatttctagtcgagatggggagaagtttccagtgttgcgtaaggccattcggacggttacccaaagcaatcaacggggattattacaagtaattaatgagcttcgaaaagaaggctcaccagttgcggaaaatatcgcggatcacatcgagtcctttaccgattatgattttgcccatttgcttttctcagatggttcgattacccagtcgattagtttagataggcagttaaatatcattcaagtagcggatttggttttaccagatgcagaaaccacttttgaagaatataccaccatggaattgcttagtgtttccatgctaatcgtcatttccacttttgccttggactttatccatagtaatcgagaaatcttcaaaattgtagacttagatgaggcgtggagttttcttcaagtagcgcaagggaaaacattatcgaataagctcgttcgtgctgggcgggctatgaatgccggggtttactttgtcacgcaaaatagtgatgatttactggatgaacgcttgaagaataatatcgggttgaagtttgcgtttcgcagtaccgatattcatgaaatcaagaaaaccttggaattctttggcttggatcgagaagatgaaagcaatcaaaaacgcctacgagatttggaaaatggccaatgcttgatgcaggatttgtatggtcgggtaggcgtggttcaggtacatccagtctttgaagaactcttccatgcctttgatacccgtccacctgttcaagagagaatggagtga

SEQ ID NO: 209 - DNA (genomic), 183 bp, Enterococcus faecium; double-stranded, circular
  misc_feature (B) LOCATION 1...183
  hypothetical: NO
  anti-sense: NO
attttccacccccgccgtcctccaccacttaggcagcgccgccagcgaagtgtccatgaatatgctgttggaggtcaagaaagcaatccggcaggcggaaaaagaaaaggcacagaaccggcagaaaatcccgaaaaatcccgaaaaaccacttgcaaaagaaccggtgatcggttatactaa

SEQ ID NO: 210 - DNA (genomic), 1128 bp, Enterococcus faecium; double-stranded, circular
  misc_feature (B) LOCATION 1...1128
  hypothetical: NO
  anti-sense: NO
tcatcacaccccatacggcgtactacaccgagcgtgtgctgcgagataccacagaaaaaacaatcaggaattgtcttaactttgaaaggagtttacagcatgaataaaataaaagtcgcaattatcttcggcggttgctcggaggaacatgatgtgtcggtaaaatccgcaatagaaattgctgcgaacattaatactgaaaaattcgatccgcactacatcggaattacaaaaaacggcgtatggaagctatgcaagaagccatgtacggaatgggaagccgatagtctccccgccatattctccccggataggaaaacgcatggtctgcttgtcatgaaagaaagagaatacgaaactcggcgtattgacgtggctttcccggttttgcatggcaaatgcggggaggatggtgcgatacagggtctgtttgaattgtctggtatcccctatgtaggctgcgatattcaaagctccgcagcttgcatggacaaatcactggcctacattcttacaaaaaatgcgggcatcgccgtccccgaatttcaaatgattgaaaaaggtgacaaaccggaggcgaggacgcttacctaccctgtctttgtgaagccggcacggtcaggttcgtcctttggcgtaaccaaagtaaacagtacggaagaactaaacgctgcgatagaagcagcaggacaatatgatggaaaaatcttaattgagcaagcgatttcgggctgtgaggtcggctgcgcggtcatgggaaacgaggatgatttgattgtcggcgaagtggatcaaatccggttgagccacggtatcttccgcatccatcaggaaaacgagccggaaaaaggctcagagaatgcgatgattatcgttccagcagacattccggtcgaggaacgaaatcgggtgcaagaaacggcaaagaaagtatatcgggtgcttggatgcagagggcttgctcgtgttgatctttttttgcaggaggatggcggcatcgttctaaacgaggtcaataccctgcccggttttacatcgtacagccgctatccacgcatggcggctgccgcaggaatcacgcttcccgcactaattgacagcctgattacattggcgatagagaggtga

SEQ ID NO: 211 - DNA (genomic), 1143 bp, Enterococcus faecium; double-stranded, circular
  misc_feature (B) LOCATION 1...1143
  hypothetical: NO
  anti-sense: NO
aattttaacccgtttcaacgaagaaagaaggaaatgaatatgagtcaaagtgttttcttaccaaattataccattggaacagatgcgtatgaaaaagcaaatggaatcgtcaaagaatatgggacaaaagtagtgctgattggagggaagactgcactttcaaaggcagaaaacaaaataaaagtagctttgacacaggaaatagaggttgtcgccagtctctggtacgggggtaattcaacttatggaaatattgaacagttgatccagcatgaaagtgtccaaaaagcagacgtcctgtttgcagtcggtggtggccgtgcttgcgatactgtaaaagtcattggtgaaaaactagctaaaccagtcttcacctttcccactattggttcgaactgttcgcccgtcactgcggtatgtgtcatctataacgaagaaggcgtaatggacggactcttctttccttcaaaaccacctgtacacaccttcattgatacagcaattattgccgaagcacctgataaatacttatgggcaggtattggcgatgctttatccaaagaagtcgaatctactttttctgctcgtggcgatgatctaggctacacggatagattaggaatccaaatcggaaaaatgtgcattgatcgtctcttgacttatggtacgcaagcattgaaagatagtgccgacgatcgtccctcatatgcaattgaacaagtcgtttcggatatcattgttactaccggattggtttctgttttagttaacaataactataattctgctatggcacactcattctattacggtacgactgttctagaaaaaatggagggataccttcacggagcatctgtcagttatggtgtactgaccttattgatgatggatcagcagttcgatttgtttgataaaatctatgtgtttatgaaaaagaaccaacttccagtatcgttaaccgacatgaatctcaatgtcacgaccgatttagaagcaatcttagataaagccatggcaacaaatgatattaaacatgtgccttatgaaatcacccgagaaaaatttaaacaggccattcttgacgtagaaacttatcatgctacacaagaaagccagcaaggatataagaaaatcagttaa

SEQ ID NO: 212 - DNA (genomic), 1428 bp, Enterococcus faecium; double-stranded, circular
  misc_feature (B) LOCATION 1...1428
  hypothetical: NO
  anti-sense: NO
ataacaaaccccgggccagatttccaccctttttttcgggtggacggaaagaaaacagagaaacgcaaattgggaactttacggaacgtgcctttcggatgggtaatggaacgcggatactgggcagtgggtttcttacattccctggccatgtttcaaatcaatggagaaattgccttgtggactttggtgtttttgccgattttaggaatcgtcatctggtattaccagaaattcagttctcgtatttaccgaaatatgcgggaaaaattaagtcagctgaacacgaaattgaatgaatcgatttccggcatgcgtattatccagcagtttcgccaagaagctcgtttagctaaagaatttgaacaagtgaacaatgagtatttagacacgcgttatgcgatgatcaaaacgaattcgattctgttaagtccgatcatcaattttctatatgcattggcgattgcgttggtgttgactttgtttgggatcgatgcgttgcattctcccgtagaagttggactgatctatgcatttacgacctatgtccagggattttttaatccaatgtctcaaatgatggactttttgagcatcttcacagatgggatggttgctggtagtcgtatcttgaagattatggatacggaagaatatgcaccacaacaaaaccctggagcagatcaaatgattacttcaggtaagattgagtttcgcaatgtaagcttttcttatgatggagagcacaatgtattaaacaatatctcttttgttgctaatccgggagagaccgttgcattagtgggacacaccggaagcggaaaaagctcgatcatcaacgtattgatgcggttttacgaattttatgaaggtcagatattgattgatgatcatgacattcgagcatatccaatggaagagttacgtaagaaaatggggctggtcttgcaagatgctttcttgttttatggggatatcgcaggaaatattcggatgatgaatccagctatcacagacgaacagatacgccatgcggctgagtttgttcaagcaaacaaattcatcgatgaattaccaaaaggatatcactcaaaagtgatcgaacatggtgccagctattctagtggacaacgacagctgatcacttttgcgcgaacaatcgtgactgatcctaaaattctagtattggatgaagcaacagcaaatatcgatactgaaacagaaggattgatccaagaaggattggcaaaaatgcgtcaaggacggacaacgattgcgattgcccatcggctgtcaacgattcgagatgcagaattgattttagttttagacaaaggtcatatagtagaacgcgggaatcatgaaacacttctagcgcaaaatggtttgtatgcagatatgtacaaactgcaaagcagtggtctataa

SEQ ID NO: 213 - DNA (genomic), 186 bp, Enterococcus faecium; double-stranded, circular
  misc_feature (B) LOCATION 1...186
  hypothetical: NO
  anti-sense: NO
aagccggacccgagaattgattacgatcaaggaaacaaaaggccaacagactcaggaaattcaagagaacgagatcaacacccgacagcaagaagcaattccggtgtggaggccactagacagaaaacgaaagccaataagcacacgtttaagctggaccacgcggaaagccgaacgcagaactag

SEQ ID NO: 214 - DNA (genomic), 879 bp, Enterococcus faecium; double-stranded, circular
  misc_feature (B) LOCATION 1...879
  hypothetical: NO
  anti-sense: NO
atgatttgcccagctaataagcgacaagtaaatacagtcttccaagattatgcactttttcctcatatgaatgtttttgataacgtggcttttggattgaagatcaagaaaatgtccaaatcagatatcgaaaagaaggtaaaagatgctttgcgtatggtccagcttcctggatacgaaaaacgggagattagtgaaatgtctggtggtcaaagacagcgtgtagcgattgcacgagcaattgtaaatgaaccgaaagtattgctattagatgaaccgttatcggcgcttgatttgaaactacgtacagatatgcagtatgaactgcgggatctgcaacaacgattaggaatcacgtttatttttgttactcatgaccaagaagaagcgttggcaatgagtgatgagatttttgtcatgaataaagggaaaatcgtccaaagtggtacacccgtagatatttatgatgagccaatcaatcatttcgttgctgattttgttggggagagcaatatcgtggacggtgtaatgatcgaagataatctagttgagtttgttggtaagcaatttgaatgtgtcgatggcgggatgcgtctaaatgaaccagttgaagttgttttacgcccagaggatttgacgatcacgacaccagataaaggaaaactagtcgtaacggtcgatactcagctgtttcgtggtgtccattatgaaatcatctgttatgatgaacagcaaaatgaatggatggtccattcaacgaaaaaagctaaagaaggaagcaaagtaggattggcctttgagccagaagatatccatgtcatgcgtttcaacgagtctgaagaagaattcgatgcacgtcttgacagctacgaagaatag

SEQ ID NO: 215 - DNA (genomic), 246 bp, Enterococcus faecium; double-stranded, circular
  misc_feature (B) LOCATION 1...246
  hypothetical: NO
  anti-sense: NO
agaacttgcccatcaagggttgattcctggagtaaaaaaagcaagttggtaaaaggaggaaatatcatggcagtaccagcaagaaaaacatctaaggcgaagaaacggttaagaagaactcatcaaactgtagtaaaaccagaaatttcatttgacgaagcgaatggtgattatagacgtagccatcatgtatctttaaaagggtactataatggaaagaaagtaattaaaggagcttcaaaatag

SEQ ID NO: 216 - DNA (genomic), 2070 bp, Enterococcus faecium; double-stranded, circular
  misc_feature (B) LOCATION 1...2070
  hypothetical: NO
  anti-sense: NO
tccttatgcccaagcgttgatcgaaaaataaagtgtatctgtacaccaaattgctttagactctcagcaatttttccaaaacttcaaaatgaaatttatcaggaaaacatgtctagcgttttagaaaggcatgttcgaaatcggttgatttttccggcaattacgtcgatgattatctgtttgttgtattacactgacaattggggttatcgtttgcttcttgccggaatttttttatggttttcgctaaaagaaggacgttttatcgcgtacttgtgtattttgtgtagcataacggtatccatttcttataggctacaagagtattcatttttagaggaaaaaacaacatctgcgcaaattactgtatttacagatacgattcgtgcaaatggtaattttttgacaatggaaggaaggttatcagagaataaacaaaagctccagctttcttatcaagtaaacacagaagcagaattgaaaacatggcttaacttccgaggaaagggaatagaattgactgctgaaggcgagttcatctctccagcaaaaaagcggaatctttataattttgaccaagaagcttacttcaggaaccatagaatttctggacggttccaaattcaaaagattgaacagatcaccatgcaaaatcactggcgaaactggcttcagagaaaaagaggatcttttatctcctttgtccaatctgaatttccgcaaaaaacaagtgtatatattaattctttattatggggctataaagatgcaggattcagagaaccagaagaaatttttagggagagtggtttgctgcatctgttcagtctatcgggtctacacatccaattttatttagggtggctgtattatttatttcgacgtatcggatggccactacacgtcagtattattccgttgagtctactaactatctgttatgtttctattgcaggaagttctatttctgttttgcgtgctagtttgctgtttttattgcgattgctagtcaaattgctgaataagcattattccaccatggacttatttgcagttgtcttttggcttcttttactatttgatcctcgatttctttttcatgcgggtggacagcttagttttttcatgagttttttgtttatcctgatttcttttgatggagattggttgaaaaaaacggcctctcacgtcctgtttactatgatcacgatgccgttgattgtatggcatttttatgagtggcctattttaggtagtctttttacattactgattgcaccggtattcaagtttctttttcttcctggtgtgttatttctcacactcttcaatcgctggctgccggaaactttacttttgctgatagaagagggattaatcttatttgagcgaataatcgatttttcttcagggtcgtctctcattataggacgtttgccccttgtgctatctgggatgtatattttcggattactgatttgtatggataggttgaaagaacaacctgtgaaacacttgttttatgttggtcttttttcttttatttttttgactttgccatttttacgcttttcttcaacgatcgcttttatcgatgtcggtcaaggagacagtatctttttgcaaagtccttttcgaaaagaaacgattttgatcgatactggaggtcagttacactttgaaagagaaaagtgggcgcaaggtatgatacgtcctcctgctgaaagaaatatcgttccatatctaaaaggtcaggggataagtgtaatcgataaactcatcttgacacacgacgatacggatcatgtgggagaattacccacgttatctcagcattttactatcaaaaaaatttatatcggttggggcgctggacgaaatgagccattacaaaggcatttatctgaagctcaaaaaaatggtactgagatcattgaaatcaaacatggggacaggatcagcggttattatgatctttatgtattgactccttttgaaaagggagagggaagaaatgcagattcgattggtttatggttgaaaataacattagccctttttattttttag

SEQ ID NO: 217 - DNA (genomic), 294 bp, Enterococcus faecium; double-stranded, circular
  misc_feature (B) LOCATION 1...294
  hypothetical: NO
  anti-sense: NO
ggtcaaggcccttgccaccggcgacgaccgtatccgcgaaaaaatggatttggatgtgcaggtttccaagctgaaaatgctcaaagccaaccacacctcccaacagtacgaaatgcaggacaaagcgctgaaatactacccgcagaaaatcgcggaaaccaagctgttaatcgaagcgctgacggcagatttgccaaccgtgcaggcccacccggtcaaggacgatgcgttttccatgactgtcatggggcagacctacacggagcgcaaggcggcgggcgaagcggtgattaa

SEQ ID NO: 218 - DNA (genomic), 207 bp, Enterococcus faecium; double-stranded, circular
  misc_feature (B) LOCATION 1...207
  hypothetical: NO
  anti-sense: NO
ttttctttaccgggacatacagctcgccggggccggtcagccacgttgggatttatgtgggaggcgggcggtttattcactgcggcgacccgatttcctacgccaatacgggaagcccctattggtctgcccatctgtacgggtatggcagaataccctgaaacacttttttcaggcatttttgccagaaacggaggtatgatttga

SEQ ID NO: 219 - DNA (genomic), 1143 bp, Enterococcus faecium; double-stranded, circular
  misc_feature (B) LOCATION 1...1143
  hypothetical: NO
  anti-sense: NO
tattttgctttgggtggttttggaagcgcatttataaacgttgggatcttgaccttactttctgtgcttgtggcttaccggcaaaaggtgattttaaatggccccttattcgcttcgattttaacagttaccggtttttctttttttggcaaaaacctttataattcaatctcgatcattttaggtgtatacctgtatgctgtatttgtcaataaacctttttctcagtatattatgataggactgttcggcagcgcattgtcgccggtcgttagttacattacttttggtatgcgctttcctttgctagtaggaattctactgggaaatttggctggtatagcaattggtcttcttcttccgccgttagctgctcaaactttagttttccatcgcgggttcacgctttataatattggatttacctcaggcttgattgccatggcttttactgctgttttgcgattgttcagctactcaatcgtcgagaatacattggtttccaatgaataccattcccctctcgtctggatcattttcggcttttttttgctgacagtcggttttggtttctattataattcctttcgactttcgggtattcgaaagattttcgattcatctggtaaactgacaactgatttcattgctaattctggtatcggtgctactttgatcaacatggggctagttggtctaatgctttcttcttatgttttgctggttggtggtaagttaaatggtcctgtcatcggtgctattttatctgcggttggtttcagtgcttttggttgtcatttaaaaaacagttttccgatactagtcggaatttttcttgcttctttgtttgggacgtttcatgagatcaccagcaccggcatgctcgttgccgctgtgtttggaacaggcctcgcgcccataagcggtttttacggcagtttttacggtgtaatagctggtatgttacatattgctcttgtccataacgtcagcactttgcacggaggactcaatttatataacagtggtttttcaactggattcgttgcaggtatccttgtaccgatactagataactttactgctgtcagaaaggaaaaaaagacacttggaaaaagaattatcaaaaagaatcatcgatga

SEQ ID NO: 220 - DNA (genomic), 567 bp, Enterococcus faecium; double-stranded, circular
  misc_feature (B) LOCATION 1...567
  hypothetical: NO
  anti-sense: NO
gaccatttaccagaagacgatcctgaaaactatccaggaggagaaaatgaacgttatttagaaatctggaacttagtattttcagaattcaaccataagcctgataacacatttgaaccacttcctcataaaaacattgatacggggatgggattggaacgcatggtctcaatcgttcaagatgcgtcaacgaactttgagacagacttgtttatgcctattatccacgccgtagaaaagctaagcaaacaagtaaaatatggtgaaaacccagtaacagatatttcttacaaagtaatcgcagatcatattcgcgccctttcatttgctattggcgacggtgcattgccatcgaatgaagggagagggtatgtcttacgccgtttgcttcgtcgtgctgtcatgcatgggaaaaaattaggtattgaacaagcattcttatatcgtttagtccctgttgttggggaaatcatggtaagttattatcctgaagtacttcaacaaaaagaatttattgaaaaagttatccgtacagaagaagaacgtttcaatgcaaacaatcaatga

SEQ ID NO: 221 - DNA (genomic), 945 bp, Enterococcus faecium; double-stranded, circular
  misc_feature (B) LOCATION 1...945
  hypothetical: NO
  anti-sense: NO
cgtctttcgttgcaacagcagatgcttcggagaatcaaacagactggagaagatgaacgagtggcttttgaaaccatcggagaaaaattacggcaagcacgcctgaataaaaaaatatctttagatgaattacagcagattacaaaaattcaaaaacgttatttggaagcaatcgacaatgatgattttgaccaattgcctggtaaattttacgtgcgggcatttattcggcaatacgctgaagctgtaggagaagatggagaccatttagtcgatgtttttgatgggaaaagcaaattgacaggatcggtccctgaacgtccgcagcctgaaacagtaagtacttctagaaaagcaatgcatcaggaagaatcgcatccaagtcgcttttggacaagtcttcctgtcattttattaggattggttgctttggcgattgtcgttgtcgtgggctatatgacttggcaagatcgtcaagctgatccaataatcggagacacagcttcttcgcttaaagtagaaggatcagtcgaggagtcctcttcctcagagcaaagcacgcagaccaaagagtcttctacagtagaatcaacaacaaaatcaagtgaagaaaagaaaatggcaatagctacaggagaagattctggcagtgccatcgcagtaaatatcacagacgctaccaagcctgtaacccttgaatttactgctgtcaatcgtgtatggttaggtgtgctagtagacaatgcctatgtttatcaagggacactggcagcaaatgaaacacagagtaccgtgttaccggaaacagcaacaaatgcgaccatcacgattggtgcagcaagcaatgcaacgatcaaagcgaatggagaatccgtaccagttaatccaggggaaaacaatcagagtccaaaacatgtgaaccttactcttcaatacgcagaatga

SEQ ID NO: 222 - DNA (genomic), 321 bp, Enterococcus faecium; double-stranded, circular
  misc_feature (B) LOCATION 1...321
  hypothetical: NO
  anti-sense: NO
aactccttaccgtcctcaccggtggcgttgtccagaacggtagcctggccgtccggggtcaaagggatcggatcgcggggcgtggtgtccgtttcttcgtccggggctgcgcttgccgaagcggagggctttgcgctgcccgtgccggcagccggttttgtggcagtcgttgttgccggattggtggtcggtgtagtcgggggtgtggttgcgctggtggccggtgtcgttggcgcaggcgtggtggatgtaaccggcgcggtggtcgccgggggctgtgtctggccggtggagggcttctgcttgttatcctccgcctga

SEQ ID NO: 223 - DNA (genomic), 1146 bp, Enterococcus faecium; double-stranded, circular
  misc_feature (B) LOCATION 1...1146
  hypothetical: NO
  anti-sense: NO
agcttattaccccgtttgtcgaaaacattactttcacccatcaatgattacagaaggagaataagcatgtacgatcaattacaagcaattgaagaccgttatgaagagcttggagaacttttaagtgacccagaagtgatttctgatacaaagcgttttatgcagctttcaaaagaagaagcaaacacgcgcgaaacagtcgaagtttatcgtcgttataaagaagtagtacaaggaatcaccgatacagaagaactgcttggtgaaaaactggatgatgaaatggctgaactagcaaaagaagaattatctgaattaaaaaaagaaaaagaagtcttagaagaaaaaatcaagatcttgcttttaccaaaagatccaaatgacgataaaaatatcatcatggaaatccgtggagcagcaggcggagacgaagcagcattattcgctggcgatcttttcaatatgtaccaaaagtatgctgaagcacaaggctggaaaacagaagtgatggaagctaacgttaccggaatcggtggatataaagaagtgatcatgatgatcaccggagacaacgtatattcgaaattaaaatatgaaagtggtgcgcaccgcgtccagcgtgttccttcaactgaatcgcaagggcgtatccatacttccaccgcaacagttgtcgtgatgccagaagctgaagaagtagagatcgatattgaagacaaagatatccgtacagatatctatcatgcttcaggtgctggcggacagcacgtcaataaaacagcatctgctgtacgtttgactcacttaccaacagggatcgttgttgctatgcaagatgaacgttctcaaatcaagaaccgtgaaaaagcaatgaaaatcttgcgtgctcgtgtgtacgataagatccagcaagaagcacaaagcgagtatgatgccaatcgaaaatcagcagtcggaactggggatcgttcagaacggatccggacgtataatttcccgcaaaatcgtgtgactgatcatcgtatcggattaactatccaaaaattagatcagattttagcagggaaattagatgagatcgttgcaggcttgatcctttttgattcccctccctccaccgggaaccagtgccacgggggggaatga

SEQ ID NO: 224 - DNA (genomic), 1206 bp, Enterococcus faecium; double-stranded, circular
  misc_feature (B) LOCATION 1...1206
  hypothetical: NO
  anti-sense: NO
atgatgttacctcatatgatcccttatgcagagccgttttatttttttcttttagccattgcgcttgtaccgatcgttctatctttattgatatgggaaaaaagattaccagtttatcaatcagcagtgacacttttctttttatttgtcagctttggaggtaattattggcaacagggagcggcgctgattgggtatgttttgtggcagacgatacttgtatggggctattttgtttatcggcaaaggaaaaatcagacaggatggttttttgccgccgttattttagcgataattccactgtttttaacgaaagtgactcctttttttgaacatggaaaagcatcgttacttggttttttaggaatctcttatttaacctttaaatctgtacaaatgatcatggaaataagagatggcatgatcaaaacatataagccatttcgttatatccagtttctgctgttctttccaacaatctcttctggaccaatcgatcgctataggagatttgaaaaagatcagctccatccgcctgttcgtgataaatatgttgatcttttgggaaaaggcgtccaaaatatttttgtcggttttttatataaattcattatcggttattattttggtcaagtactgcttcctgtagtgggacgcattgccttacagcatggtggtatttcatgggcattagtaggttatatgtacgtgtacagtatgtatttgttttttgattttgctggctatagcttatttgcagtcggtacaagctacatgatggggtatcagacaccaatcaatttcaataaaccttttttatcatggaatatcaaagaattctggaatcgttggcatatgacgctgtccttttggttccgtgattatgtatatatgcgattgatgttcttcatgatgaagaaaaaattttttaaaagcaagatcgtaatgtcaaatatcggttattttgctttgtttcttctaatgggtatatggcatggattgacgtggtactacatcgtatatggactgtatcatgcttgtctgatctgtctgacagatgcatggatccgatttaagaagaagcataaagagcagttgccttctaacaaatttacgcatggcttagccgtatttttgacatttcaagcagtatgttttagcttcctgattttttcaggatttttagataaacttttttttagctaa

SEQ ID NO: 225 - DNA (genomic), 285 bp, Enterococcus faecium; double-stranded, circular
  misc_feature (B) LOCATION 1...285
  hypothetical: NO
  anti-sense: NO
ttgcttgctttatcaatagttccggcgcatccatcttcagcaggaatcgtcttttattttgcttcgtcaatcatatctggtatccttattgcactcatccaaaaatgggagtggatcaaatggaatccgatcagtatgttgaatctgcaaaaccaaattggaaacgaagagatcatgaagcaattgactcatctttctactaatcaaatgctattcggtaatttagcttacatcgttttgttcttagcattaggatatctcgtatttaagcgaaaaaatgtatga

SEQ ID NO: 226 - DNA (genomic), 825 bp, Enterococcus faecium; double-stranded, circular
  misc_feature (B) LOCATION 1...825
  hypothetical: NO
  anti-sense: NO
atgcagctaccaatcgttgggatcctaacgaaatatttatcagcgacaatggtacagatacgacagacacaagcgacagtacagatacatctaccacaagtgatagctcagattcatcaacttcaagcgacagtacagatactacctctaccacaagtgatagcacggacacatcagcttcaagtgacagtacagatactacctctaccacaagtgacagcacggacacgtcagcttcaagcgacagtacagatactacctctaccacaagtgatagcacggatacatcagcttcaagcgacagtacagatactacctctaccacaagtgatagcacggacacatcagcttcaagtgacagtacagatactacctctaccacaagtgacagcacggacacgtcagcttcaagcgacagtacagatactacctctaccacaagtgatagcacggacacatcagcttcaagtgacagtacagatactacctctaccacaagtgatagcacggacacgtcagcttcaagcgacagtacggatacatctaccacaacaagtgatagcacggacacgtcagcttcaagtgacagtacagatactacctctaccacaagtgatagctcagattcatctaccactacaagtgatagcacggacacgtcagcttcaagtgacagtacagatacatcctctaccacaagtgatagctcagattcatcaacttcaagcgatagtacagacacgtcgtctaccacaagcgatacacgtcatgcaagtgtctccttctcaaaaacaagttcggataacaggacgaactttaacttaa

SEQ ID NO: 227 - DNA (genomic), 990 bp, Enterococcus faecium; double-stranded, circular
  misc_feature (B) LOCATION 1...990
  hypothetical: NO
  anti-sense: NO
gagtacatacctatgtttaaaggcaaagcacgcgcatataccaacattgctctaatcaaatattggggtaagaaaaatgaagaactcatccttccaatgaacaacagcctttcgttaacattggatgcattttatacagagacagaagtcatcttttctgatagctatatggtagatgaattttatctagatggcaccttgcaagacgaaaaagcaacaaaaaaagtcagtcagtttcttgacctttttcgtaaagaagccggcctctcactaaaagcttcagtaatcagtcagaatttcgttcctaccgcagctggattagcctcctctgccagcgggctagctgctttagcaggcgcttgcaatactgctcttaagcttggattagatgatctctctctttcaagatttgctcgacgcgggtctggttcagcttgccgaagtattttcggtggtttcgtcgaatgggaaaaaggccatgacgacttaagttcttacgctaagccagtcccttccgattctttcgaagacgatttagcaatggttttcgttttgatcaacgaccagaaaaaagaagtgtccagcagaaatgggatgcgtcggacagtcgaaacatccagtttttatcaaggctggttagattccgttgaaggggatctatatcaattgaaacaagcaatcaaaacaaaagatttccaacttctcggagaaacgatggaaagaaacggactaaaaatgcatggaacgactttagctgcccagcctccattcacttactggtctcctgacagcttaaaagcgatggatgcggtgcgacaattgagaaagcaaggcattccatgctactttacgatggatgctggccctaatgtcaaagttttagtggaaaacagccatttatctgaggtacaagaaacatttaccaaattatttagcaaagaacaagtaattactgcacatgctggtccaggaattgcgattattgaataa

SEQ ID NO: 228 - DNA (genomic), 384 bp, Enterococcus faecium; double-stranded, circular
  misc_feature (B) LOCATION 1...384
  hypothetical: NO
  anti-sense: NO
atggaaataccagttgtttttatcgcgatcgcaatcgcagctttgattttactgatgttgctgatcgtctttgtagcgaagtaccagacagcaaaaccggatgaagcgttgatcatcagtggaagttatttaggaagcaaaaatgtgcacattgatgaaagcaataacaaaatcaaaattgtgcgtggaggtggcgcattcttcttgccagtttttcaacgttcgaatcggatcagtctattatcgagtaaattggacgtctccacccctgaaatgtatacggaacaaggcgtaccggtgatgtgtgatggtacttcgatcatcaaaatcggttcctctgttaaagaaaatgtttccgcagccgcaccgtttttaggcccctaa

SEQ ID NO: 229 - DNA (genomic), 186 bp, Enterococcus faecium; double-stranded, circular
  misc_feature (B) LOCATION 1...186
  hypothetical: NO
  anti-sense: NO
gcctcgatacctgatgcagcgcattccatgctttttctcattggaatggcaacagtttttttgacaaattttataaggtgcagaacttctttccgtatgctattccgattgtccttgacaatgagcctcctcggatgtgacgatcttcggcaggagctaacagttaaagttagactgcctcgctag

SEQ ID NO: 230 - DNA (genomic), 186 bp, Enterococcus faecium; double-stranded, circular; identical to SEQ ID NO: 229
  misc_feature (B) LOCATION 1...186
  hypothetical: NO
  anti-sense: NO

SEQ ID NO: 231 - DNA (genomic), 246 bp, Enterococcus faecium; double-stranded, circular
  misc_feature (B) LOCATION 1...246
  hypothetical: NO
  anti-sense: NO
agaaacgtaccaaaaaatctgcagtggatgatagttcagctgaaaaaagactatagttctgatcatgctttctttatcacgccaccagcagtcgatgagacaaaacaaaaatatcggaataacaagttgatcaaagaatatatctctgttctcacagaagtagcaaaacgccatgattgtgaagtatcgatttttatacggaatttcttgaacaaatggattcgaagaatttttataatgggctaa

SEQ ID NO: 232 - DNA (genomic), 636 bp, Enterococcus faecium; double-stranded, circular
  misc_feature (B) LOCATION 1...636
  hypothetical: NO
  anti-sense: NO
gaggaagtacccatagaaaccagagattatattacaactcaccaaaaattaatagaaagtggactaagccattttgaaaaagaaggatttcagcaaactaagataaggcaactgtgcttgaccgcaggcgtaactacgggtgctttttataaacattttacttctaaggaagcgttatttgaagaaattattcagccgcatattaatgcgcttattaatatgtataatgaagagtttaccaaatacctcttaaacttagaaaatatagatatagagaaaagttggagagagaacttcaatgaattagatccatttattaattatatttttgagaataaacgtatattcgatttggttttattccaatcagctggaaccaaatatcaagatattgttgaaaaaattacatcatttgtgacaaaaaagacagtctgttgtctagataagttaaagactatcggaatgatcaatcaaaatttagtctttaatgaagaagaaatccacttctacatttactcattctacgctacattctatgatatattgaagcatagctattcaaaagaaaagactatgctattaaccagaagattgtatcaattttctgttcctgggtggattgaattactgagttaa

SEQ ID NO: 233 - DNA (genomic), 393 bp, Enterococcus faecium; double-stranded, circular
  misc_feature (B) LOCATION 1...393
  hypothetical: NO
  anti-sense: NO
aacagatcgtttaggaggaaacagatgtttacgaatgaaataaaaatcatgctttatgtggacgatgtagaaaaaaatgcaacgttttggagagcagttggctttgcggaaaaagatcgtcaagaaatggatgggacgcttataattgaagtaggagttgaggacagtcaaacctcatttctgttatatgatcgagcatttgttgagtcccattcacctggcacagctactagtgccccatctttgatgttttacagtaaagatatctttggactatataaaaaaatgcagacgcaatcagtcacattaggtgatatggtacagcttggagaagaatatgtctttaactttgctgatcccgatggcaactactttgcggttacaggtaaataa

SEQ ID NO: 234 - DNA (genomic), 462 bp, Enterococcus faecium; double-stranded, circular
  misc_feature (B) LOCATION 1...462
  hypothetical: NO
  anti-sense: NO
aaatacccaccccctatcggctttttatggttagatgcagatgaatccggattgactgctgtatcttttcagcccatttcagaaagcgaatcagcgaatctgcgaattttaacgcgcacacaagaacagtttgaagaatattttgcgggaaaaagaaaagaatttgatgttcctttatctataaagagaggtacgccttttcagcaaaatgtctggaaagctttgtcgaccattccttatggagaaatccgaacgtataaagaagtatccgttgctgttgaaagtccgaaagctgtgcgaacgattgggcacgcaaatcgaaccaatccattgccaatcgttattccttgtcatcgagtgatcgggcaaaatggaaaactgacaggatatatgggaaacgcaatagatggggttgaaatcaaacgccaattgttgttgttagaaggatatctgcaaaattaa

SEQ ID NO: 235 - DNA (genomic), 735 bp, Enterococcus faecium; double-stranded, circular
  misc_feature (B) LOCATION 1...735
  hypothetical: NO
  anti-sense: NO
aaagacccaccattcaacaatgtgaacctaagaaaagctatttcttattctatcgatcgtgaagctttagtaaaacaagtactaggtgacggatcagttgtctctacaggattgatcccatcagatatggtaaaaagtccaacaacgaacgaagactttgcaaaagaagctggaaaattagtttcttatgacaaagataaagcaaaagaatattgggaaaaagcgaaaaaagaattgggcgttgattctttagaatttgatttgatggcttctgatgatgattcatcgaaaaaagtaatcgaatatgttcaaaactcaatccaagaaaacttggatggcgtaacagtcaaaccaacacctgttccattctctgtacgtcttgaccgctcaacttcgggtgattttgacgcagtactaggcggatgggctgctgactatgcagacccaagcagctttactgatttgtttgtcacaggtaattcatacaaccgtggtcgctggagcaatgcagaatatgacgaagcagttaaagcagcttcatcaacagacgctggcgatgaacaagcccgttgggatgatttccaaaaagcaatcaagatcatctctgatgatatgggtgtcgttccggtgtaccaaaaagcagaaggtcacctagtgaatgaaaaaatcaaaggtatcgttcaccatgcggcaggcgcttcatgggattacaaatggacatacgttgaagaataa

SEQ ID NO: 236 - DNA (genomic), 231 bp, Enterococcus faecium; double-stranded, circular
  misc_feature (B) LOCATION 1...231
  hypothetical: NO
  anti-sense: NO
gggtttgcacctggtttatcaattttatttacagcgacgatgattggaacgcctgcagctttggcatggttgattgcttcaactgtttgtggcatgacgccatcatctgcagcaacaactaagatcgtgatatctgtgatacttgctccacgtgcacgcatacttgtaaaggccgcatgtcctggtgtatccaagaaagtgattggtttaccatcaatatcgatctggtag

SEQ ID NO: 237 - DNA (genomic), 252 bp, Enterococcus faecium; double-stranded, circular
  misc_feature (B) LOCATION 1...252
  hypothetical: NO
  anti-sense: NO
aatgttgcaccaggaaatttcaaccattccttggaaaaacaatattttggaatattccaattggggcagacatcaggaaattgcacccttatttcagcagaaaatccaaaaattttggttaaatggaagagtccaagttttgaatatttttgggtaatttcgaagtttaaaacaccagtttggggacaattaggtacgggatttctatcgaaatgctcgaatcaatatcgaaggcattcgtnttcaatctga

SEQ ID NO: 238 - DNA (genomic), 369 bp, Enterococcus faecium; double-stranded, circular
  misc_feature (B) LOCATION 1...369
  hypothetical: NO
  anti-sense: NO
ctgcctgcacccatcccatctggtcgcgggctttcatcccctcgtccacgccgttctgtttctttaattccgccacgatccggtctgcctgttcctgcgcctgccggtcgatctcccgcaggtggggttccagccgcccggtcagcagcatcgaggtgtatgtccccttgtggtgttcctgaagaaaggtctgccgcagcctgccgtacttgcccagcggcatttcctccatttcgtcctccccgtccatcaccaagtcgggaatcaggtagtcgcccgtcctcttgtatgccagttctgccattttgtatgctcctttcttcgctttcgcgttttaatgtgttaaactgttccttgactttagtataa

SEQ ID NO: 239 - DNA (genomic), 1047 bp, Enterococcus faecium; double-stranded, circular
  misc_feature (B) LOCATION 1...1047
  hypothetical: NO
  anti-sense: NO
aaggaggcaccactcatgcttacaatcgcttatcttggcaatggaaagagtacaaatcgctatcatttgcctttttcaagaaaacttacgaacaaaatcaatatcaaaaaaattttttccccatctgaaccagtgtggaaaacattcgaagacatcgaatatactgatcagctgtctgatctttgggatgatcctgagatccaattagttgtcatcactacacctagtcaatttcattatgaatatggaaaaatggcactcgaacatggtaagaatgtactagtagagaaaccttttgcagaaacgtcaaaggaagcagaagagttatttgcattagcaaaagaaaaaggtctatttatccaatgttaccaaaacagacggttcgattctgacttcttgacagtccaaaaagtaatcgaaagcggaaaattaggggatattttagaagtagaaatgcattatgattatttcagaccggaagtaccagaaaatacgcatgaattttctactgcgaacagctatttatatggacatgcttgtcatacagtagatcaagttctttcttatttcggcgaaccagatgatatcagctatgatgtacgtcaacttttagggaaaggacgaatgaatgattacttcgatctggattttttctatggaaatatgaaaatttcgataaaatccagttatttccgcatcaaagaacgtccaagtttcgtcgtttacggaaaaaaagggatgttcgtgaaacaaacaaaagatcgacaagaagaacatctgaaaatgttttacatgcctgatcatgaagactttggtatcgatttgcccgaacattatggtgtattgacctatatagatgaacaagggagttatcatgaagaaaaagtaatttccgaggttggtgattacagccgtgtctacgaagggatttacgagacattagttaatggcgcagaaaaagtcatcaaagatgaagaaacaatcttacaaatgaaaattttggaagaaggaatcaaaagcattcaagaatcagaaggaaaaatatga

SEQ ID NO: 240 - DNA (genomic), 795 bp, Enterococcus faecium; double-stranded, circular
  misc_feature (B) LOCATION 1...795
  hypothetical: NO
  anti-sense: NO
cggaatccgtttatccacgttttagagaagaagacggaccaaatttgctccgtcttcttctcttgctgttctgcttcattgcctataaacctttatgaaagaagagataacatgcctactatccatattgccggtgattctactgcggcagaaaaagatgaaaacaagcgtcccgagacaggttggggagaaaaaatctctgcttatttttcacccgagatccagatcaataaccaagcaaagaatggacgcagcaccaaatcatttatccaggaaggaaggttagcccgtctagcttcacagtttcagccgaatgatttcttatttgtacaatttggacataacgaccagaaaatccaagaagaaagaggtacgcttcccttcggtagctatttaaaaaatctgcagatattttttgaatgcgcaaaaaaagcgaacgtccaaatggtcttactgacatctgtgacgcgacgagattacttagaaaacggaacattgaatccagatatacttggagactatccaaaagcgatgcgtgcatttgctgagaaacaccatattcctcttttagatgtgttctcaagatcacaagaattgttccagaccttctcaaaagaagagacaaaaaaattctacctgcatcttatacctgatacttgtaaaaattacccagaaggactaaaagacaatacccactttagtccagaaggcgctgataaagttgcccgaataattgttgaattgataaaagaatcccgtctgcctcttgctaattatttacaaaaaggagtttga

SEQ ID NO: 241 - DNA (genomic), 546 bp, Enterococcus faecium; double-stranded, circular
  misc_feature (B) LOCATION 1...546
  hypothetical: NO
  anti-sense: NO
atgacgcaacctgccattcgctatcgtttaatcaagaaagaaaaacatactggcgcgcgtttaggggaattgatcacgccacacggaactttccccacaccaatgttcatgccagtaggaacattagctacagtaaaaacaatgtccccagaagagttgaaagaaatgggtgctggcgttattttaagtaatacatatcatttatggctacgccctggtgaagacttagtagaagaagctggcggactgcataaatttatgaactgggatcaaccgattttaacagattcaggcggctttcaagttttttcattaagtgatatgcggaatatcgaagaagaaggcgtgcatttcaaaaatcacttgaacggttcgcgtatgtttttatcaccagaaaaagcaatcaacatccaaaataaattgggctctgatatcatgatgagttttgacgaatgtccaccattcgatgaaagttacgactacgtgaaaaaaatcagtagaacgtacgtctcgatgggcagaacgaggattgaaagctcatgctaa

SEQ ID NO: 242 - DNA (genomic), 687 bp, Enterococcus faecium; double-stranded, circular
  misc_feature (B) LOCATION 1...687
  hypothetical: NO
  anti-sense: NO
gtgtttaaaccattaatcgattcatattcagcggttctgaaaaagttcaaaggaaaagacataagcgcaaccatcaatgaggaagtgaacattgatcgactaaagacgatgtatgacggctacgatggtgatcgagtcattgaaattcgttttattgatcctagacgtttcaccgtacagcaacgaaacttcatctatgcgctgataggcgatatttttatcgatacaggcatgccaacggacttctggaaggaattcttctactttcgttttgaaggtgtcacagggcgcaaaataagcctgaaagacgaatcgaatacaactgtgagtgatgccaatgtcttagcaaatatcatcttagatttcatctttgaacatcatattcctttcaaagaaggctatgagattttacctgcgaatcaagaatattacttctacaaatgcatcacaaaaagagtctgctgcatctgtggcaaaacaggagctgacatcgatcactttgacaaagcgctaggaagacgaaagcgcaaagaagttgatcatgcagagtacacatttgcagcactctgcagaatccatcacacagagaagcacaaaataggtgtgattaatttcaaaaataaatatcaaatcaaagggatcaaattaaaccagaaaacaatcaaaaagttaaatattggagggtaa

SEQ ID NO: 243 - DNA (genomic), 693 bp, Enterococcus faecium; double-stranded, circular
  misc_feature (B) LOCATION 1...693
  hypothetical: NO
  anti-sense: NO
gtgtttaaaccattaatcgattcatattcagcagttctgaaaaagttcaaaggaaaagacataggtgcaacgatcaatgaagaagtgaacattgatcgactaaagacgatgtatgacggctacgatggcgatcgagtcattgaaattcgttttattgatcctagacgtttcactgtacagcaacgaaacttcatctatgcgctgataggcgatattttcatcgatacaggcatgccaacggacttctggaaggaattcttctacttccgtttcgaaggtgtcacagggcgcaaaataagcctcaaagatgaatcgagcacaaccgtaagtgatgccaatatcttagcgaatatcatcctagatttcatctttgagcatgatattccgtttaaaaatggatatgaaattttgccccaaaacgaacagtatttcttttacaaatgcctcacgaacagggtgtgctgtagttgcggaaagaaaaatgctgatatacatcacgtagactctgtcggcatgggaaataaccgaaaaaaaataaacaattctggtaggcgctttatggctctgtgcagagaatgccatacgaaaattcatgtcgaaggttttactacatttacaactaaaagaaagcttacggcagttgttctcaaagacagtgatttaaaaagattggggttgaatatcattgaatga

SEQ ID NO: 244 - DNA (genomic), 588 bp, Enterococcus faecium; double-stranded, circular
  misc_feature (B) LOCATION 1...588
  hypothetical: NO
  anti-sense: NO
tcgcataaacccgctttatggtatgataagcagagaaacaaaacaaggaggaacaacagattgatagttggtattactggccttatcggagtgctgacaggtgctgtagttgtctatatcggcatgatactgcaaatgcgtcacttggaaaataaagaacagcgtagacgtgaattggaattgaaagtcaaagaaatcgagacgctgaatcaattaaataaaaagatcaacgagatcttgcaaaaacggacaacgctgatggaagaatatgtcagctttgatgcatttgatgattgttatatcacgattgacgattttgcgtatctccaatcattttcagcgcaaaatagtttttatctgccaaattatattttagacgagctatttaagaatatctcccatcgaaaagtgattttatctccagatgaaacaatgaagattggtggatatgcttataaaggcggacgcgtgattttagagaattttacggatagtctgactgaaatgatcaatgaaaaaaaagctcagttgaagactatgacgcgccagccgattggtttcttctcgaaagatgatgtttggagctga

SEQ ID NO: 245 - DNA (genomic), 381 bp, Enterococcus faecium; double-stranded, circular
  misc_feature (B) LOCATION 1...381
  hypothetical: NO
  anti-sense: NO
aacgtcaaaccgtatccaaagaaccgatttatatctgcctattgtgttatacgagaagacggcactaaagaatgtctgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgnttctcgtaacatcgctcataaagtacgtgtcaaagacccgaaaatgaaaatctgtgatgactttaaggctgtttatcaagctaactcaaaagaagaagcgaaataccttcttatccggcatgattga

SEQ ID NO: 246 - DNA (genomic), 672 bp, Enterococcus faecium; double-stranded, circular
  misc_feature (B) LOCATION 1...672
  hypothetical: NO
  anti-sense: NO
aacgtcaaaccgtatccaaaaaagcgatttatattgccattggtatacgaggaggacggcactatagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 247 - DNA (genomic), 540 bp, Enterococcus faecium; double-stranded, circular
  misc_feature (B) LOCATION 1...540
  hypothetical: NO
  anti-sense: NO
ggaggaaaaccggtgagaaaaagaggatttgaagttatttctaaatataaagatcaaaatatcaatctaccgcagcgcgctacacatcatgctgctggctatgattttgaagcagcagaagaggtcgtgattccaagtatctggaaagcaggctggaaaaaggggttggaaacagtcgcagatggattgaaaaaagatgtatcagaaaatgaaaaacaattgaaaccaaccctcgtgcctactggaatcaaagcttacatgggagaagatgaatttttgcagcttgctaaccgttcaagcaatccgttgaagcggtttttagtgttgacaaacggagtaggtgtgattgacagtgattattacaataatgaggcaaatgaaggccatatcatgttccaattcaccaactttggtttcaaggatgtagtgatcaaaaaaggcgagcgtatcggccaagggatctttttgccgtttttaaaagcagatcaagatcaaacgactgctcaacgtcaaggcggatttggttcttccagtaaataa

SEQ ID NO: 248 - DNA (genomic), 1896 bp, Enterococcus faecium; double-stranded, circular
  misc_feature (B) LOCATION 1...1896
  hypothetical: NO
  anti-sense: NO
atggagaaaccgttttctaagaactatacttatcttgtaagaaggattgctacggcattaattaacaagggggaagtaaaaatggactattcacaattagcgaaagatattgtccgatttgtcggaggcgaagaaaatgtcagcaatgtttaccattgtgcaacaaggttacgctttaccctaaaagataataagaaggcagataaggagaaggtagagcaactagaaggtgtgatcactgtagtcgaagctggaggaatgtttcaagtcgtagtaggaaatgcagtaaatgaagtgtatgacgtattatccaaacaaatgaaactagaagatgatgcatctagtggaaagagaggaactgagaaaaaaggcattttaaactcttttatagacatgatcgccgctgtttttgccccgactttaggcgtcttggcaggaagtggtttgatcaaaggagtactcgccttatgtacgagtttgaatttattaactactgaatcaggaacttatatcattttgaatgcagcagctgatgcatttttctatttcttgcctatatttttggcatatactgctgcaaaaaagttcaatacagatcgtttcatcgctatggttattgcagcagctctcgtttatcctacgattgtcagtgcatatagtgatagcataaccttgcgatttctagggatgcccgtgattctagcaaggtatacaagtacggttattccagcaattttagctgtatgggttctttcttatattgagcctaagattcgcaaaagcttgcacgaaagtattcgaaatttattgacaccattcatttgtatcatcgtgatggtcccaattattttattagttgtaggtccaattgcagattatgcaagtcagctgattgcagctggatatttagctgtttataactttagccctgttttatctggtgctgttatcggcggattttggcaagtgttagtgatttttgggttacattggggacttgtaccagtaatgaccaacaatctttctttctacggtcgtgatacgctaggtccagcatgtatgactgccgtagctgcgcaagcaggagcagtacttggggtatttttgaaaacgaaaaataagaaagtaaaaagtttatctttatctgcatttatcacagcattatttggaatcactgaacctgctgtttatggtgtgactcttaaatataaacgaccattttacattgcttgtatatgtggagctatatttggtggagtagctggtgccgcaggagccggtgctttggcagttgctacaagaagtattttgtctttcccgatttatattggtgaaggatttgtttggctagttgctagttatttcttagcgatgatcagttcctgtatgctaacttttcttttcggctacaaggatgaaatcgaagaagaatcctcaaaggatatagtgttaagtactcctgcagcaggtgaaataattgatttatctgaagtaaacgatccaacatttgctagtggatctttaggagaagggtttgcgatcattccaacggacggaaaaatctacagttctgtaaacggggaagtttcaacagtttttccaacgaaacatgcaattggggtagtcagtgaagaaggagcagagatactgatccatatcggtattgatacagtgaatttaaatggcaaatactttcaaagtgcagtatctgatggaaaaaaagtacgtaaaggcgatttattgatggaagtagatttgcaagaattaatcaaagagggatatgatccgaccacaatggttattgttacaaatagtagtagattcaaaaatatcattactagtcataagaaaaataatcaaacaagaaaactagcaagtttagggggatcgatatga

SEQ ID NO: 249 - DNA (genomic), 279 bp, Enterococcus faecium; double-stranded, circular
  misc_feature (B) LOCATION 1...279
  hypothetical: NO
  anti-sense: NO
cgccatgaaccactgcccaagaccccaccgactagagggccaacagccattccgcagccaagtgctgcttcatacatcatgattgctttttctgtgttaccaactaaaatactgacgatcgttgctaaagcagtagagacaaataaagcattcccgacaccccagccggcacgtaacccaatcagcattccgatattcccagataatccgccaagaccagcgaatacaacgatgataaacaatcctgtcatcaatgttttttcaaaccgatccgactag

SEQ ID NO: 250 - DNA (genomic), 1140 bp, Enterococcus faecium; double-stranded, circular
  misc_feature (B) LOCATION 1...1140
  hypothetical: NO
  anti-sense: NO
tcgttagaacctctaaaagtactatttttcaataatgcaatcaatcatggtgtattgacacctttaggaatcgaattctcacaaacagtcgggtactcttccttatttttgatggaggcaaatcctggacctggtttagggatcttactttctatcctttgttttgcagaaaaacaggaaaaagtaaatgcgagtggagcattgatgatccatgcgattggcgggattcacgaaatctattttccatttgtcttgctgcgaccgtatctatttttagctgtaatggctggtggggcaagcggcacgttgatatttcaatggttagatacgggattagctgcacctgtatcgcctgggtcactactcgtgatttttgccaatgcgccttatccacaactagctggggtaagtatagggatagcaatcagtacatttgtgaccttcatttgtgcagcgatactattgaaattaccaaataaagaaaaagagaacaaaacggtcaaagaaaggggagaaatcttggaaccatctatcattcattccgtcatttttgcttgcgactcaggtatgggatcaagtgctatgggagccgccctgctgaaaaagaaattagcagcagaaaaaatcgatctttctgtcggatacagctctatctatgaattgaataaccaagtaaatcagctggttatcgtgcaacatgaactagcgggtcttgcaagagaaaaagtacctcaaagtcaaatctatgtactggatcactttttggaaacagatatcttgctgtcacgaataaaagaagcgatccaatttccaaagcgggaagaaaaaaaagagatagcagatatcacagaacaaaaaacgtcgcctgctaatattgtatttttgtataaaaacaacagacgcggctcacaaactatgggcatgacgattttaagtcaattagcaaaaaaagcgaaaaaacagtttgttatctcaaaagaatcaatagaaaaaatcaaaatccaagaagaaacgatttatatcgcacaaagagaactagctgtaactgaacagctagaagaaaagatccctcggctagttctagttgaacattgggtagctacgaatgaatacgaaaaactcgtgaagggagaaatataa

SEQ ID NO: 251 - DNA (genomic), 699 bp, Enterococcus faecium; double-stranded, circular
  misc_feature (B) LOCATION 1...699
  hypothetical: NO
  anti-sense: NO
ataatggaaccagaacaattacgagcaatcgtaaaagaaaacaatagtttagaaacaaaattaaccaaaagaaatcaacagtacatttttgatttgaaaaaatctttagaagcagcgaatttgtctgaagaagaaaaagtaaaagcccttcatgacattctgcctactttagttgcagaacaaaaaggcggaagaacagcccgtcaattgtttgggacagtctctgaaagaacggaagcaatcatcaataagccagcagaagtaaaaaattcatccacccctttattgatgtggttagataatacgttgctgttgcttggtctattaagtatcatgattgcgattaccggattgttttcacgtggaacaacgccagcttatggcttttctacactcgttctaggttctgcaatcggtggctgggtcttttatatgatgtacaaatacatctatcaatatgaatatcccggagcagatcgaagcaagaaaccaggaatgggtaagacattgcttatcctaggtggaacgacacttctttgggtcgtactgttttctgcgacaacactattgacaccagttatcaatccagtattagatccagtagtagttatcattatcggggcaactgctttagcaatccgttactacttgaagaaaaaatacgggattattggaagtttatccgtcccaagaagataa

SEQ ID NO: 252 - DNA (genomic), 234 bp, Enterococcus faecium; double-stranded, circular
  misc_feature (B) LOCATION 1...234
  hypothetical: NO
  anti-sense: NO
atggcgcgaccagttttagatgcgatggatatggatactttgacaaaaggaaggtatgtacagctgttagctcgtggttattcacctaaagatgtattcaaagccctatctaaaggaacagatatggaaaaagaaagattacgaaaagaattcgactattggagagagcataacggaataaaagatttaaaaccagcacgtccagttattagacgaaaaaaattgaagaagtaa

SEQ ID NO: 253 - DNA (genomic), 219 bp, Enterococcus faecium; double-stranded, circular
  misc_feature (B) LOCATION 1...219
  hypothetical: NO
  anti-sense: NO
caaaagccgttgaattgcttagaaagattttacagaaagggggtatgtgttattgataatgctgtaaaaacaattcaaaagaaaaataacaagtgtggcattggcaacagaggaaagacaaagattgttgtaaaagagcatttctccgaaaagggaaagacaatggaagaacttctaactgatgtcatgttggaaaaagcaaagcagacaatcgcataa

SEQ ID NO: 254 - DNA (genomic), 588 bp, Enterococcus faecium; double-stranded, circular
  misc_feature (B) LOCATION 1...588
  hypothetical: NO
  anti-sense: NO
tttattagaccttcacacaccatgagtaaattacaaaaaatgatttatatttcgctacttgttgcacaaggagtgatcattggtttattggcaaatatgatcccttatcctttttcttttgcgcctggtgcaatactaggcttagccaatctaatcacgatcgttgccatttttaccatgaaaaaacgagacagcttcttactactttggctacgactattcctgactactttgctaggcggaacgatttccacattcctttatagtatgagtggtgctttgcttagttattttggaatgttattggtcaagcaattaggaccaaaacgtgtcagtatcatcggaattagtgcggccggcggtttcatgcataatgtcggacagcttttgatggcttctttcattgcacaatcatggacagtcatgttgtacttgccagtcctttcagttttagggattttatcagggattgcaatcgggatcgcagcgaattatcttttacgacatgtgcagacacttcaacgattccaaaaagattatgagcagggaaccaaacaaaaatggagcccaatgtttaccaaaaaataa

SEQ ID NO: 255 - DNA (genomic), 336 bp, Enterococcus faecium; double-stranded, circular
  misc_feature (B) LOCATION 1...336
  hypothetical: NO
  anti-sense: NO
tcaggcagacctggttatcgatgcgacgataggaattttttcgggaaaaccgggttccccattttaaaaccaggcggcaggtatgttgcattaaatgacctcccagatctagatttgcggcaaaaaaaggaaggcttttatgaatcgtttgttccaagaaaggaatatctagatgcagaagcctttgctggcataatcaaagcctaccaaaaaggagcctttcatgtttttatttcaatgaatctgtctgcttcacttaagcatgtcatccaagcacatcaggtagttgaaggacatcctcctgctgggaaaatcatcctgtcattcgaaaaataa

SEQ ID NO: 256 - DNA (genomic), 1728 bp, Enterococcus faecium; double-stranded, circular
  misc_feature (B) LOCATION 1...1728
  hypothetical: NO
  anti-sense: NO
acccgaagacccgttcaaagagttgatgaattcatgaatgattacattgagaaagtcctatcaggtaagctgattgcacccaagaaaattatccaagcgtgtgagcgtcatataagcgatttggagcgttctaagtcagatagcttcccttatgtgttcgatgaagaacaagccaccaaagcgattaaattcattgagttgctaccatctacggacggtaaagcaatcaagatgttaggatttcaaaaattcattctaggcagtctttatggctggcgtactaaagaagggaattacaggcgattcaatcgagcgtttaccagtatgagccgtaagaatgggaaaacgtatatcgcaagtggcatggctgccaatgcgttgattatggaacaagaaccagcagaagcaaggcaagtattgtttgtaagtaacgctttgaaacaagctaaattgggctatgatatgctgtctaattcacttagaaacgtggtcaagtctagtaagtttttaagaccacaactgaaaattatgaactctaagattcagcacttgccctctaattcgttcgctatggcactggctagtgaaaccagcacgctagatgggtttgcaccaacaaccgcaattcttgacgagtggcacgaagcaaaaactcgtaaaacgtacaacgtcattaagtcaggaatgacccaacaaaagaacggcttattgtgtgttattagtaccgctgggcttgatttaaacgttcctatgtacgaggaatacttattgttagatcgtgtgctaaaaggcgaagaacaagccgacaggtactttatagcgatatgggaattggacgatcccgaagaaattcacgatcaagagaaatggatcaaagccaatccgatttttgaaagtgaagaaatcaaaaaagtaatgattccaaccattcaagatgatgtgaaccttgctttgaaacaaaataaccttaattctgtattggtgaaaaacttcaatttatggagacaagcgagtgaggacagctatatgattgctgaagactggcaggcaaccgaagtagaaccacaagatattacaggcaagcccgtttatatcggagtggatttatctaaaacagatgatttaactagcgtttcatggatcgtaccgctagataacggcgaactttattgtgattcacatagctttgtagccaccaaatatgggcttcaagacaaagaaaagcgcgacggtttgccttatcgagaactagaaaaagctggtgagtgttccattactcaattagaaagtggaatcgtggactatgaccaagtatttcagtttattcaagatttgattcaagaaaatgatttggaatgtatggggatttgttatgacccgtataacgctaattcgcttatcagtaaagctgaaaaagccaactacccaatgttagaagtaagacaaggaacgattactctaaacgttccgacccgaacttttagagaacaagtttatgaaggcaacgttattcacaataaaaatacgattctcacccatgcagtgaacaacgctattttaaaaacggataacaacggcattcagattaataaatcaaagaacagtaacaaaattgatccaatagctgcattaatcaatgcctatgtgtttgcaatggattacttcaccacaacggaaggagcgaaagcagacaatgaattttatacaagtgaagaattttctttctaa

SEQ ID NO: 257 - DNA (genomic), 660 bp, Enterococcus faecium; double-stranded, circular
  misc_feature (B) LOCATION 1...660
  hypothetical: NO
  anti-sense: NO
tcaagtacgttcgttttggcatttatcagaagccgtatcacgtatataatagtttccgttttttctgtcacaagcaaaacgttatcctccttttggaaatcaaggtatgatgagaaaaaagggggattttatatgacaaaaaaagcagttttcgcaggcggatgcttttggtgtatggtcaaaccatttgaagagcagccagggatcatttctgtgacatccggttatactggcgggcatgtaccaaatccaacttatgaacaagtaacaacaggcacaacagggcatacagaagcagtagagatcgaatatgatccagaagttatttcttatgatcagttggtggaaatctattggcagcaaaccgatccgactgacgcattaggacagttcgctgatcgcggtgattcttatcgtccagtgatctactataatgatgaagaagaacgaaatattgcagagcgttcaaaacaagcattgcaagacagcgggcgattcgataagccaatcgtgacaaaaatcgaaccaagaagcgaattttatcctgcagaagattaccatcaggattattacaagaaaaacaagctccattacaatctttatcgagaaggttctggacgtgcaggtttctttcgtcgacattggggcgtcaagaaataa

SEQ ID NO: 258 - DNA (genomic), 969 bp, Enterococcus faecium; double-stranded, circular
  misc_feature (B) LOCATION 1...969
  hypothetical: NO
  anti-sense: NO
cgctcaacgtttatccgaaaacctaaaaatcatgcaaaaggagctacaaaagatatggcaacaattaaggtaagccgaaccacttcttgtagtcgtgcaattaattatgcagaaccacgagcaaccattaaaacaggaataaactgtgacgtcgattatgccaaaagtgaaatgaaacaaattcgcatgctgtatggaaaagacgaccgtgtacaggcacacttattgattcaatcttttcgaccaggagaaattaccgctgaaaaagctaatcaactaggggcagagtatgcaaaaaaaatagcccccgatcaccaaatagctatttacacacatacagacaaagaccatattcataatcacattgtcattaactccgttaatctggagactggaaaaaaatttcaagctcatggtcaagcatttctaaacaaatgttatgacctaaatgacgagatttgtcttgcacataacttaccaatcactgagcgaggaaagaagccagaaaaacgaaccatgtctgaaataaaattaaaagaaaaaaatgaacctgtttggaaagacgaaattcggattgcgatcgatcaaacaatgaaaaacaaaaaaaccagaacctatgaccaattttgtaattccctcaaaacattggggattcattgcttcaatcgcgggaaaaatttcacttacgaattgatccacaaaaagaaaaaagtacgatccaacagactaggaaaggactacgaaaaggagacgattttacatgagctggacagacgagaacgaacctataaccaacagcgaaccaacgagctacgaagagctcgagctagcattcgcgaaactgcagaagaagtacgaagagaacaacgaactcttacgcctgaacaaccggaaattagaccggctcgaagaaaccatgaacaacacgttgaaagaggaacagaccaccaacaagaattatcgctctaa

SEQ ID NO: 259 - DNA (genomic), 1227 bp, Enterococcus faecium; double-stranded, circular
  misc_feature (B) LOCATION 1...1227
  hypothetical: NO
  anti-sense: NO
ggaattttgcctacaaaactttcaaatgggaaatataaaactaatctgaggtatccaaaaaaattcagagaaatcactggaattacatcagaaaagtatcaaaaagtatttccaactaggcaattggctattaaagccgaaaatgcaatgaaaaggaaaattgaaacagttttaagagaggagaatgcaaattcactagaattaaaaggaaaaataaaatttaaggaattctatgaatcaaaatggcttcctagatatgaactaggtcagactactagatcaaaaagagctccaagttacgtaacaattagtaatactaaagatatattccgattgcacatccttccaatgtttggtgagtatgcaatgaactatctaaattcaaatactgagataatatcagatgaattaacaaaaaaatcgaaagaatacgcaaatataaaaattatcaaaggatatgtccgttctatgtttgatattgcagaaatactaaattatattgaatttaaccgaactaccaaaattattcaatgtatcactgtacctaaaaaaattgctttagaagaaagaaggatacgggaaggtaatcaagcattatcgtcagaagagcttattgcttggatagaagcagtaaacactgacttgaataatcacttgcttactcttcatgactatactcttttcatgcttaccctatatcttggtgatagaaaaagtgagacgtatgctttgcaatggaaatatatcgactttgagaaacaaacggttcgccttaaacatgctttggataaatatcaaaaaaagaaatttacaaaaggtcgaaaggataccgtaattcaagtacccgaaattgtaatggcattactaagcaaatggaaatcagtgcaagctgagcaattgttgagattaaaaattaatcaaacaccagatcagtatctctttacctatactaaaccatccggagaagtaaattgccctgttcacgctgattacctaaactatcgaatcaattcaattaaaagacgacatcctgaattggctcatttatctccacataagcttcgtcatacctatgcaactatagctagacaaggcggagcaaatatgaatcaaatatctaatgctttaacacactcagatatttctactacaaagatatacgtaaacacaccagatgtagttgataagactgttttcgaagcatttcaaaaaggattaaagaactag

SEQ ID NO: 260 - DNA (genomic), 1050 bp, Enterococcus faecium; double-stranded, circular
  misc_feature (B) LOCATION 1...1050
  hypothetical: NO
  anti-sense: NO
atcgctttgccccgacgacacagatcgccggggcttttttcatttagacaggaggctttgaaaatgccggaaacattgaatctgaattactactacgggaatgaagccgaccagtacagcttttaccgtatccccaaaaccctgctgaccgaccgccgctataagggcgtgtcactggaagcaaaggtactgtatggcttactgcttgaccgcatggggctgtcggcccggaacggctggctggacaataatgggcgggtattcctttacttcacgcaggaggaagccatgaccatgctgggctgcggcaaagacaaggtgacaaaactgttccgcgaattagaggggattggcctgatggaacggaaaaaacaggggcagggacatcccgcccggatatacgttaaaaattttatcttggaaccggaacccaccgcgccggttcagactgcggaaaatcagcagtcaagaccgcttcccagtgccgccgtcaagactgctgaaaaaccgcagtctgcaccacggaaaaccagcggtcaagagtgcggaatttccgcccctaataatactgatataaataaaactgaaaaaagcgatactgatctatccatcctaccccctaccccctcggcagtttcttctcctgctggtaaacgcgctccgcgcaggatgggattggatgagatggaaagctaccgtgagctgatcatggagaatattgactacgacattctcttagaacgttatccctacgaaaaggacttgctggacggctatgtggagttaatgctggaggtctgctgctccacacgggaatctgtccgtatctgcgggcaggaagtacccaccgaagttatcaaaagccggttcctgaagctgaacagcgaacatatcggctatgtcatggacagcctgaaaagcaatactgccaaaatcggcaacatcaaggcatatacgctggcggcactttacaatgcccctgtcacgatggggcaatattacacatcccttgtcagccacgatatggcgcatgggctgctgagtggttaa

SEQ ID NO: 261 - DNA (genomic), 1346 bp, Enterococcus faecium; double-stranded, circular
  misc_feature (B) LOCATION 1...1346
  hypothetical: NO
  anti-sense: NO
cggaaacgtttcaaaaaataggaggaacatcgatgaaaaagagaatgttagcaattgcagcaattttagcattaacagctggaggacttgcaggatgtggcagtaaggagaaaagttcaggtagcagtgatccaggagaaattaagatttgggttcagttttctgatgaaacgcctgaaggaaaagcttgggcagagattgtgaacaattttaatgatgaatacgagggtgaatataaagctgttactgagtatattcctcgtagcggaagcggcggtggatatgaggataaagtaaatgctgcaattacaaccaatacccttcctgatgttattacgttagatggaccgaatactgcagcttatgctcattcaggagtcattgctccattagatgattatttgaaagatgcggacatggatgatgtattagacagcattattcagcaaggaacctacgatggcaaaatgtatgcgtttggtttctcagagtccagtgtgggtgtctattacaataagtcgctgttcaaagatgctggaattacagaagatcaattgccgacgttagaagatccttggacttggacggaatttcaagcaatttgccaaaagctgactgataaatacaaaacgcctgcaattgatatgcaaatggcgtcgggagacgaaatgctgacctacgcatatacaccatttatatggtcgaatggcggcgatgtcgttaatgctgatggaaccaaagccgaagactattttaacggtaaaaaatccgttgaagcgttggaatttattcaagaattggttgaaaaagtttacaccacaatcagtcctattgaaaaaggatttgaaactggcaaatatgccatgatgctgagcggttcttggacaatggcagatttagagggaaactatcaagagattgattatggtattttgccttaccccgtttcagatgcaactggggagttagtttcaccaaccggaagctggcagttagcaatgactgagaaaacagagaaaaaggatgcttctgcggcctttattaagtttgcaaccagtacagaatctagtcgtattatgagtttagggaacagtgttctacctatcagaaattcaacagttgatttaattaaagatgaagtgtcggaaggaatgcaggtattaattaagcaaaaccaaatttctggacatgcccgcccagtggttgtagcttatccgcaagtatctagagcattccaacaagcagttcaagatattagctacttcgaggaaaacccagatgtacaaaaagtagcagatagtcgcgctgctgaaatgcaacaggcaattgatacttcactaaaatag

SEQ ID NO: 262 - DNA (genomic), 696 bp, Enterococcus faecium; double-stranded, circular
  misc_feature (B) LOCATION 1...696
  hypothetical: NO
  anti-sense: NO
tcgtcgttgccggaaatatcaaacaaacataagttagaagagttactaaacgaattacaacagatccccgaagaaatttggggattctaccagtttcggcgagatttattttggaaaaagattcctttgtccaagcagaaaattcttatacaacaatcaatcgattgtggtatcgaaacggcatgtagcatcaaaaaaaagtacccttttgccgatgtaggagaaatttgtgaacaaatggctgttccaatcgtttcctgtgaatcagagcaaataaacgaacgaatcacttttgcaacttatgcagaagatgaagggattcgattgatgacggagccgttagaaaaattaaaatgttcaggactagcttcgatctctaaagaaacagcgcaagctttgattattggacatgaactatttcaccacatcgaagcttctgttaagggaatttatacgcaaagcgaaaaaattgtgctgtggcggttgcctttttatacacatcaatcaaacattcgtgcattgagcgagatagcagcgatgagtttttcaaaagagatgaatcaaagcgatttttcgccttatgtattagaggcagtcttactttggccatataatgaaattcgtagccaagggatcttagaagaaataaaaaaaatagaaaaaagatgtacggagtatgatttagattacaaataa

SEQ ID NO: 263 - DNA (genomic), 192 bp, Enterococcus faecium; double-stranded, circular
  misc_feature (B) LOCATION 1...192
  hypothetical: NO
  anti-sense: NO
cttggtctgcccattggatctgttgcgaaaattgctggaaatgtctcaacgcctgtgtattttcttgtttcaattgaggaactaccaaatgacgaagccgatttctctggatatctaacaattggtttgtctgatcctcaaagtaaacaagctgcgattccgctgcataagtatataggtcttctttgctaa

SEQ ID NO: 264 - DNA (genomic), 264 bp, Enterococcus faecium; double-stranded, circular
  misc_feature (B) LOCATION 1...264
  hypothetical: NO
  anti-sense: NO
agaggtctgccatttcaatccttcgaatctcgatcatttcactattttccagaattttctttatatatgattcaattaaatccgaggtattctgatgtgccatcttattcattccctttgactaatattgaccttaattataacgaatttgataatagaaagaaagaagaacgctttttgttaaataaatcctttagaatcaacaaaaaaaaatacggaatatactattccgtatcgacgcgcccaagaggagtcgaaccccta

SEQ ID NO: 265 - DNA (genomic), 1917 bp, Enterococcus faecium; double-stranded, circular
  misc_feature (B) LOCATION 1...1917
  hypothetical: NO
  anti-sense: NO
agccttatgcctaaaaataaaaatgaaacattgtgtgtagaagatttaagacacgctgaatattacgaaatgcaaaacacctttgatgatttatatgccaaaagtaagaatggagatattttcactcatcttatggatattatcctatcgagagaaaatatattactggcatatcgaaatatcaaagcaaatgcaggcagtaaaacagcaggaacagacggtacaataattaaagatattggcaaattgccagcagaaacagttgtcaaaaaagtaagatacattgttgcaggcagtccacatgggtatcgacctaagccagtgaggcgaaaagaaataccaaaaccaaatggtaaaaccagacctctaggtattccttgtatgtgggacaggcttatacaacaatgtataaaacaagtattagaaccaatctgcgaagctaaatttagtgaaaacagctatggttttagacctaataggtcagttgaaaatgcaataaaagcaacctataaccgcctacaaatcagccagctacattatgtgattgaatttgatattaagggtttctttgacaacgtgaaccattccaagctgataaaacagatatgggctatgggaatacgggacaagcacttgatattcattttaaaaaggatattaaaagctccaatcaaaatgactaacggtacaataacatatccagagaaaggaactccgcaagggggaataatatccccactactagcaaacattgttcttaatgagttagaccattgggtagaaagccaatggcaggaaaatcctgttacaaaaaactatgtggttcatatcaataaaagcggtagcccatgtaaaagcaacgcttacaaagaaatgaagaaaacaaagttaaaggaaatgtatatggttcgttatgcagatgattttagagttttctgccgctacaaggaaagtgctgaaaaagccaaaatagcaatcactcaatggattgaacaacgattaaaattggaagtatcacaagaaaaaacaagaattgtaaatgttagaaaaagatactccgactttcttggtttcaagattaaaatgataccgagaagaaagaagttagttgttaaatcacatataagtgataaacaattcaaaaaccaaaaagacaagctggtatcacaggcaaagaaaattgcttctccctcaaaagggaaaacggaattagaagaaacaagactttataattcaatggtattaggtatgcaaaattattatcagattgcaacgaatgtaaatctggattgtatgaaactgaatagagctgtaatggctatcttcactaacagattaggtacaaacaaaaggggcagattgagaaaaacaggcagacaacttacgacaaaggaggcaacaagatatggtaaatctaaaatgcttcggtatgttgctggcgagggcgaacctattttccctgttggatatatccaacacagaaaaccaatggcaaaggtgtatttagcgaattgctacactctagagggaagaaaatttatccacaccaatctaagtgttgataaattactgatgtaccagttaatgaaattatctttggaaaatcgcacaatagaatacgcagacaatcgaatttcgctattttctgctcaacatggaaaatgtgctataactctggaagaatttcaacaagctaatgaaatacattgtcatcatattgtaccaactggagctggtggaaatgacgattataaaaatcttattttggtaaaagaggcggtacaccgtctaatacacgctaaaacagaagaaacaatacaaaaatatatagctctattgaagctaaataaagtccagctcataagactaaataaatatagagtattagctggcaatcaagaattaaacttgatatag

SEQ ID NO: 266 - DNA (genomic), 342 bp, Enterococcus faecium; double-stranded, circular
  misc_feature (B) LOCATION 1...342
  hypothetical: NO
  anti-sense: NO
gtgattatgccggctttttatgaggtgaaaatgatgtatagaaatcccaaaaatataaaacaagagataaagctatttttcttctatttagtcgatttaggaatagtagccggaagcgtgatggcaagtgtttactttgcaaaattaatgccaatttcaccaatgatgaaatttgcactgtacttattagcatttgtagtgggtgtttggatgtgcgttagaacgcctaatcaccctaaagagcgaaatattttaatgctgtattatctctttaaaatggatagaaacagataccacgaagtagagtttaaaagaaatagtagggggaaaattgaattatga

SEQ ID NO: 267 - DNA (genomic), 447 bp, Enterococcus faecium; double-stranded, circular
  misc_feature (B) LOCATION 1...447
  hypothetical: NO
  anti-sense: NO
aggaatatgccgattgggaaggtgcttatattatgtgaaagattggtcagacaaacatttgctattgttgattttactgaagtagacgaagaaaatgcccgctttgaattatttgctcgctatgcatctattttgcggacgctgatcaagcagttagaattacgtctgcaaattgcttatgatcttccttatgaaaggctaatggcggatatcgtgaaagaaatcatccaggaacaattgctgaatacgatcaaatatgatttagtcgaatacgagaaagaaaagcagtatgatatcattttgactagccaattgaaagaattaccgtcacagaagtccgctaaagtttttgtattcactancaacgaatataatnatgatttcccctatntgaaacaatttttaaaagaatgttatntagaanaaattgaatttaaggatgaataa

SEQ ID NO: 268 - DNA (genomic), 225 bp, Enterococcus faecium; double-stranded, circular
  misc_feature (B) LOCATION 1...225
  hypothetical: NO
  anti-sense: NO
aatcgtatgccggcaggttgcgggaaagggggacggatggataaccgcaaactgaccgtatgttacgggcatggcaattacaagcaggctccgacgcagattgttttacaaggaaaatggctggaacaggccggattttctgtcggcgacaaaatcactgtgaaatgccagcaagggcagcttaccatcacaaagaacgaaacagggaacgattcagagaaataa

SEQ ID NO: 269 - DNA (genomic), 372 bp, Enterococcus faecium; double-stranded, circular
  misc_feature (B) LOCATION 1...372
  hypothetical: NO
  anti-sense: NO
acaatcatgccggaagacagcctgaaatttctgggtaggcacatccgagccgaaagggttcgatgtaacttgacccaacaggaactggcggatcaatctggcttggcggtcaaaacggttcaggacatcgaaaagggaagaaaaaatccgtcttatgaaacactttcccggttaattgaacgactgggaatttctccgaatgtcctgtttcaagcttcaaactctattgaggatgaagaactccagcgtttcatgggaaaatttcagtcatgcaaccgtgacaatcagcagattctgctgaacacactggacttcctgacagagcagctacttgaccttcaacgaaaacccgaatcaaacagttccgagtga

SEQ ID NO: 270 - DNA (genomic), 195 bp, Enterococcus faecium; double-stranded, circular
  misc_feature (B) LOCATION 1...195
  hypothetical: NO
  anti-sense: NO
tcgcgaatgccacttaccggtaaaaaaatgctcaaactagccaagaaaaatggttggaaagtggtgaggataactggcagccatcatattgtagccaaagaaggattcccacccgttcctattcctgttcatagtaatcaggatttaaaaaaagggacagagcagaagttactaaaggacttagggctgaaatag

SEQ ID NO: 271 - DNA (genomic), 927 bp, Enterococcus faecium; double-stranded, circular
  misc_feature (B) LOCATION 1...927
  hypothetical: NO
  anti-sense: NO
agagacgctttctataactcagtcaccgagttgattggcaaaacgccaatcgtcaaattaaataaaatcgtaccagaagattcagcagatgtttttgtaaagcttgagttttttaatccaggaggaagtgtaaaagatcgtattgctttaagtatgatagaaaaagcagaacacgatggtctactgaaaccaggtgatactatcattgaacctacttctggaaatacaggaatcggattgtcgatggtaggagttgcaaaaggatataaagtaatcatcgtgatgcctgagacgatgagtatcgaaagacgtttattgatgaaagggtacggcgcagagttgattttgactcctggtgcggatggtatttctggatcaatcagagaagcagaacgtttggcaaaagaaaacggctactttttaccattacaatttgaaaatgaagcaaatcctcttgtgcatgagaagacgactggtcctgagatacatcaagcatttggagtaaatggcttggacgcgtttgttgcaggtatcggtacaggaggaacgatcactggcgctggccgagaattaaaacgtgtgtatccgaaaatcgaattaatcggggtagaaccagcagaatctgctattttagaagggaaagaagcgggacctcacaaaatccaaggaatcggtacaggttttgttcctaaaacactggatacttctgtgtatgataaagtcctttctattagtggagacgaagcgatggaaacagctagagaagttgggcgaaaagaaaggattttagtaggcatctcatctggcgctgcaattgctgccgcgctaaaagtcgcaaaagaattaggaaaaggcaagaaggtattagctgtggttcccgacaatggtgaacgttatttatctacagccctttaccaagagatataa

SEQ ID NO: 272 - DNA (genomic), 195 bp, Enterococcus faecium; double-stranded, circular
  misc_feature (B) LOCATION 1...195
  hypothetical: NO
  anti-sense: NO
gcaataccgccaatgatcgctcctcggcgtccgccaactgcgttgccaaatatccctgctgtccctccggcaaagaaattggttagcataccaggtaaaatcatcgctaagccgaacatgggcaaagtaaacatggcaataatcgtaccaatcgttgtcgtaatgaaacctaaaatgacagcatttgggctataa

SEQ ID NO: 273 - DNA (genomic), 213 bp, Enterococcus faecium; double-stranded, circular
  misc_feature (B) LOCATION 1...213
  hypothetical: NO
  anti-sense: NO
cgcggtgcgccaggaattgcagacagtcaaggtacagcttgcacaggcccaggacacgccgcagaaaaccgtcttgcagggcatggtggacggtctgcaaagcaaagtccggcaggcgcaggaaaagctggacagcctgcgggaaaaaatcatgcagtgcgccgccaacgcggtagagagtttcaagcgcgtgggcgtgactgcgctggataa

SEQ ID NO: 274 - DNA (genomic), 222 bp, Enterococcus faecium; double-stranded, circular
  misc_feature (B) LOCATION 1...222
  hypothetical: NO
  anti-sense: NO
ctgacagcgtttacgatcgtcgcaaagttgtcatccgtcaaaatcatatctgcggcactttgcgccacatctgttcctgtgatccccatggcacacccaacgttacttgctttcaacgctggtgcatcattcacaccatccccagtcatcgctacgactgcacccgtacgttgccaagatttgacgatccggatcttgtcttctggcgttacccgagcatag

SEQ ID NO: 275 - DNA (genomic), 777 bp, Enterococcus faecium; double-stranded, circular
  misc_feature (B) LOCATION 1...777
  hypothetical: NO
  anti-sense: NO
tggcaccagcccacaaaaaaattctgctcccggtattggtttgaaaacgatgcgtcaacgtgttcaagaacaaaagggacaagtccatattttccaagaaaaccagcaatttcagttaacgatcattttaccaagggagggacaccaatgataacagtagtcattattgatgatgatccatttgtgacgaaatcgttacaaaccattttagaaagcacgaaagagatccgtgtgttaggcattggtcattgtgccaaggatgcgctagtcttatacgaaacccatcgtcccgatgttttgctgacggacatccgcatgcctaaacaaacgggcatcgatgctgccaaagaaattttggctaaatttcccaaagccatccttttgcttttgacgacattcaaagatgaagaatacatccgcgaagcattttccatcggtgtcaaagggtatttaatcaaacagaacttgcaagcgattattccttctgtcaaatccgcttataatggacaggccgtatttggtaatgaaatcatcgagactttcactcaaatgatgaagaataaaccgacgattgatagtcatgcttatgcttcttttagtgaacgtgagcttgcaatcatcaaagaagtagctgccgggaaaaacaataaagaaattgcagatgccttgtacttgagtgacggcactgttcgcaattacatcagccaattactagaaaagctagatttacgggatcgcacgcaattggctatctatttttatcagcatttgcaataa

SEQ ID NO: 276 - DNA (genomic), 2091 bp, Enterococcus faecium; double-stranded, circular
  misc_feature (B) LOCATION 1...2091
  hypothetical: NO
  anti-sense: NO
agcaaacagccgaatccaagaagctgtaatcagtggagaaaaatcctcgtttacggtgattatgacgcagatgggatcaccagtgcaacggtaatgaaagaaacactggaattacttggtgcagaagtagaagtattcctgccaaatcgatttgagcatgggtatggaccaaaccaatcggtataccaagaaaagatcgaagaaggaatccagttgatcatcactgtagataacggggtagcaagaaatgatgcggtagcatacgctcagcaagctggtgtagacgtgatcattacagatcatcacgaactacctgagaatttaccagacgcttatgcgattgttcaccctcgtcatccagcggggcactatccatttccagatttggcaggagtcggagtagcattcaaagtagcttctgcattattggaagaaccgcctgcagaatttttggatttagtagcgataggaacgatcgccgatttagtttcattgactgatgagaatcgaatccttgtttcattaggaatcgatgccattcatcattcagaacggataggacttcaggcgctatttgaagaaagcggcgtaaaaatgagggacgcagacgaaacaacgatcggtttttcgattgctcccagactaaatgcaatcggtcggatgggcgatccacgtcctgccgtctcgttacttgcgacgtttgatgaagaggaagcatccgttcaagcaaaaaaattgaatgagatcaatgaagaaagaaaagcaatcgtagagcagataacacaagaagcattagcgatggtcaataaggagaatcatatccatctattggtaaaccgaggatggcatgaaggcgttttgggcattgttgctgggaaaataatgaatgaaacgggtaaaccaacgcttgtccttactttaaaagaagatggatcagctaaaggatctggacgtagtattgaagccttgaatctttttgaaatgcttgaccagatgcgagatttatttacttacttcggaggacatcatgcagcagtcggtttaacgatgccaagtgaaaatgtcactatactacaggagaagatgaaccaatatatagtcgatcatcaaattgacttgatgagagggcctgagttgagaattgatgaagtattgctgccaaatgaagtaacagtagagcgaattgatgagctgaaactattggcgccatttggtacggataatcctttgcctcagtttttatttcgacaagtccaagcagaaaatatcaaaagaatcggagcaaaccaacagcatctgaaatttgtcctttccgatgcatcgagtcagcttgatgcggtcgcttttggttttggtactcaagaagaagaactgctgaataatcaggtagatgtggtaggaaagctttcgatcaatgaatggaacgggtgtaagaaaccgcagctgatggtatctgatttttctgtggttggtctgcaagtatttgattggcgggcaaaacgtttccgtgaacagagccgaacgtcggaaggtagcctttatttagcatttgattcttcgacgttgaaattcgtgcctgagattatccaggaagctgcgattgttttcgaaggactagattctgtaaaggcaataattgaaaaaagaaaaccaaactctctagttgttatggattgtccagatgatttagcggatctgaaagaagtttttcggtcttattcattcaatcgtgtttatctgatggggatttcacctgatgaggcctatttgaatggggtaggcacaagagaacagtacgcaaaattgtttaaattgatccattctcaagaacgaattgatatacgtcataaaataaaagcaatagctcaatatttgcgtatccctgaaaaattattaatttttatgatacaggtgttttttgaattgaaatttgttacaatagagaacggtgttttacaaaaagtcgctagcccagaaagtcatcctttgactgagagcagattataccagcgacggctcaataaaatcaaagttgaggaatttttgcttttgagcgatattcctaccataaagaaatggttaacaacctag

SEQ ID NO: 277 - DNA (genomic), 222 bp, Enterococcus faecium; double-stranded, circular
  misc_feature (B) LOCATION 1...222
  hypothetical: NO
  anti-sense: NO
acgagtaagccgacaagcaccgctccaataccagttcataatatctcatttgttggtctgccaccattctttttcaaaatcagtgggtggatcccccagccaactgccgggatcaatgcaatcaataaacccatttttattcacccttatccttttccaccttggaaagaaggatataaagtcatcccaccatctgcaaatagtgtaatacctgtaacataa

SEQ ID NO: 278 - DNA (genomic), 294 bp, Enterococcus faecium; double-stranded, circular
  misc_feature (B) LOCATION 1...294
  hypothetical: NO
  anti-sense: NO
agaaacaagccgtttctggtgtgtttgacagtgacaaagaaactgatacggaggttgaagaagatgaatctcaaagaacagatgatgaaccagtatcagaagaaggatagcgaaaaaatcaaagatgctattgctgaagctatgaagattggcaggaacgaagtcctgtacggcaaagacgttatcacagatgatattcgcaaagagtttcaagatggcggctttactgttgaggattacgaggataagcatacgattgatgcgaaaattgagttagtcagattttcttggtag

SEQ ID NO: 279 - DNA (genomic), 285 bp, Enterococcus faecium; double-stranded, circular
  misc_feature (B) LOCATION 1...285
  hypothetical: NO
  anti-sense: NO
caattggagccgttgatagtgataaaaggtgcgaaaaaaatcattcgaaacaaaacgattcttcatttggatcgtttcactgcggatgctggggatcttgtgactgttgttggagaaagtggagcaggtaaaagtacgttattgaatatattaggattgaatgatcagttcagttcaggacaattctatttgttcgatcaagagacgaaacaattaactgggagagagaagcgcttgataaaaagaaataccaatattctgttctttttcaagattttgggttga

SEQ ID NO: 280 - DNA (genomic), 561 bp, Enterococcus faecium; double-stranded, circular
  misc_feature (B) LOCATION 1...561
  hypothetical: NO
  anti-sense: NO
aatgaggagccttcaatggaatcttttgaaaaaaactggtatgtcttgcatacatattcaggatatgaaaacaaagtaaaagcaaatatcgaatctcgtgcgcaaagtatgaaaatggccgactttattttccgtgtcgttgttcctgaagaaaaagaaactgaagtcaaaaatgggaaagaaaaagaaatcgttcataaaacattcccaggatacgtacttgttgaaatgatcatgacagacgcttcatggtatgttgtccgcaacacacctggtgtgacaggattcgttggttcacacggagccggaagcaaaccagcaccattacttccagaagaagtcaatcatatcttgcgttctatcggtatgagcctgcgacaaaatgatctagaagtagaagttggcgaagtcgtgaaaatcatcgaaggcgcatttgctggattagaaggacaagtaacagaagttgacggagaaaaagaaaaattgaaagtcaacatcgatatgtttggacgtgaaaccagtacagaacttgatttcgatcaagtagataaaatcgattaa

SEQ ID NO: 281 - DNA (genomic), 666 bp, Enterococcus faecium; double-stranded, circular
  misc_feature (B) LOCATION 1...666
  hypothetical: NO
  anti-sense: NO
cggctctggccgattanaaatgtcttggatattagtgcacctgtgatgattggtccaagtagctctcacactgccggagctgctagaatcgggaaaatcatacgtagtatatttggcgaacagcctgattctgtagatatttatctatatgaatcatttgcaaaaacctatcgggggcacggaacagatattgcattagttggcggcctgttagggatggaacccgatgatgaacgtttagctgattctttgaaattggcatatgaagccggtatggaagtcttgtttgttcctaagagtgaaaaagccgaacatccaaactctgtaaagatgcttctaaaaaaaggaacacgaaagctttcagtcactggcatttcgatcggcggtggcaatatccagatttctgaattgaatggattcaaaatttctttaagcatgggtactcctaccttgatcgttgtccaccaagatgttccaggtatgattgctaaagtgactagtatactttctgagaccaatacgaatatcggcactatgacagtgacacgggaatcaaaaggtgaaaatgccattatgataattgaagtagatgatcctcaagtagaagaaacggtaaaaagactcaaacagctgccaaatatcgacagcgtaaattatttcgattaa

SEQ ID NO: 282 - DNA (genomic), 774 bp, Enterococcus faecium; double-stranded, circular
  misc_feature (B) LOCATION 1...774
  hypothetical: NO
  anti-sense: NO
aaaatctggcctcccaggaggaaaaagatacccccaaaccaagttcgttttgaaaatgttcaatccggctacccaccagataacttgctaatgactgattttaacttggatgttcaacctggtgagatgttcgctatcgtaggtccgactggtgcagggaagacgacactgatcaaccttcttgaacggttctacgatgtttctggaggtagtattcgttacgatggtgtagatacccgtgatctttcacgtgatgaattgcgcgcacagttttcaatggtactgcaagatacttggctgtttacaggaagtatctatgacaatatcaaatatgggaacgacgatgcaacagacgaacaaatcattgaggctgctaaagctgctcacgtagacgattttgttcgtaaattgccagaaggatataacactgtattaaacgaggatgcaagcaatatttcgcaagggcagcgtcagctaatcacaattgcgcgggcattcttagcaaatccagatgtcctgatccttgatgaagcaacatctagtgtagatacacgaacagaaatactgattcaaaaagcgatgaaccgcctattggaaaaccggacaagtttcgttgttgctcaccgcttgtctacaatacgcgatgcagacaacattattgtgatgaatcatggttcgatcgtagaaacaggaaaccacgatacattgatggaaaaagacggattctatgcagatctttataacagtcagttttctgaagaagaagcttcatag

SEQ ID NO: 283 - DNA (genomic), 1092 bp, Enterococcus faecium; double-stranded, circular
  misc_feature (B) LOCATION 1...1092
  hypothetical: NO
  anti-sense: NO
ggcccatggcccaatacagaaatatatcgaaaaatagatacaatcatacttcatatgcccgattatataaaagattttgttcaagatcgtgaggataaagatcaatcacctcgaactactttagaatatctaaaaaattataagctcttttatgaatggcttctgagtgagtctatcgttcccgatacttcaatcacctcgataagacagttaactgcctatgatctaaacttgtacaaatctcatttgaaacgtcgcacaaaggaaaatgtaaaaaaagagacaacaaaaactaagctcaaagataataataacttaggtctatctacttctactatcaatagaaatatcacagcattaaaggttctatttaaatatctttcgaaaagttccaataatcctttaggaaaaccatacttagaaaataatcctatggatcaagtagcaactatcacagataaaactacgttagctgcccgtgcaaacgcaatcgagaaaaaattatttctagacgaagatacacaaaattatctagattatattgccaatgaatataaaaaaactttgagcaaacgagctttgatctattatcaacgagatgtagaaagagacctggcgatcaatgcattgattttaggatctggattaagactctccgaggttgtaaatattaatttagaggacctatctttagaaaagaataatgtggtagtaactagaaaaggaaataagagagacgcagtaaatatagcagcatttgcaatggaatatttagctaattatctagctattcggaaagaacgatacaaagtaacagaaaacgaaaaagctttatttctagcaatttatcaaggagaagccaagcgtatatccggtattgcaatcgaacggatggtagcaaaatattcaaaaggattcagagtccaagtcagtccacataaattacgtcatactttggctactagactctatcaacagacaaattcattggtattaactgcccaacaattgggacatacaagtacaaatacaacaactttatatactcatatagacaatgcagctacaattgatgctttgaacgctttgtaa

SEQ ID NO: 284 - DNA (genomic), 408 bp, Enterococcus faecium; double-stranded, circular
  misc_feature (B) LOCATION 1...408
  hypothetical: NO
  anti-sense: NO
caactacggccactcaatcacagtaaaaaaaacggaggtagcgaaatgaacgaagattactcaaaaattgaactaaacgatggaacaattttgaatttagaacctaaactgaatatcaagaaattattgatgatcaatagagattttaacacagacgagtttgcaaaaatgactgtgggaaaaggatccatggatatttctgttattcaaggtgcaaaggctgtgtatattgcttaccgccaagcgaacatgactgattatatttcattcgatgaatttatcgataaatgggattttgatatggctactgccagctatatttatcaattgatgatgttcaaacaagcacgcgatgcttatcaaaaagaatttgaaaaagcaaataaggaaaaaaagcttcaaaagtaa

SEQ ID NO: 285 - DNA (genomic), 201 bp, Enterococcus faecium; double-stranded, circular
  misc_feature (B) LOCATION 1...201
  hypothetical: NO
  anti-sense: NO
gaaatagctttcttgatattatcaaacacattacgtcctacttctactgcgctgacaatagaagcaaagttatcatccgtcaataccatcgctgctgcatcttttgccacatctgtacccgttcccatagcaattccgatgtctgcttgtttcaatgctggtgcgtcatttacaccatcacctgtcatagctgagatatga

SEQ ID NO: 286 - DNA (genomic), 552 bp, Enterococcus faecium; double-stranded, circular
  misc_feature (B) LOCATION 1...552
  hypothetical: NO
  anti-sense: NO
cagcgtaggccgaaaacacaaggagcgggtgccgtgtttattacaatgtgggcacaagataggaatggtctgatcggcaaaaatggattgctaccgtggcgattgccaaatgacatgcgtttttttcgtgaacatacaatggatcgaatcttagtgatgggaagaaagacctatgaaggaatgggcgatctctcacttccttatcgccatatcatcgtgttgacaacgcaaccgaactttcgcacgaaagaaaatgcagaagtgatgcattcaatcgatgaacttttggcgtatagtcaaacaatctcagaagatatctatgtttcgggtggcagtcggatttttcaagaacttcttccttacaccggtcgaatctggcggacattgattgatagcacgtttgaaggagatacgtatattggggatatcgatttttcagacttcgctcttatagaggaatacgagggaataacggatcaggcaaatttatatgcccatcgttttcaaaaatgggaaagagtaagaaataaggttgtttcaaaagaagaataa

SEQ ID NO: 287 - DNA (genomic), 393 bp, Enterococcus faecium; double-stranded, circular
  misc_feature (B) LOCATION 1...393
  hypothetical: NO
  anti-sense: NO
tttaaaaggcccttccggaaaaccttccctaccccaaaacggatttcccccgggcaaacagacggtgaaacagttttggcccagggcgcgggtgtgcagaatattgagattaccggaaaaaatatcaaatcctttgagcgcgtggcccggaaatacggcgtggatttcgctttgaaaaaagacccagcacagggaaaatactttgtctttttcaaagcacgggacgcggatgcactcaatgccgccttttacgagtatgccggaaagagcctgaaccgctccgcgcaaaagaagccgtcgctgttaggccagctctcgcatttcaaggagatcgcaaagaatcttacacgggacaccgctaaaaaccgggagaaagggggcgttgaactttga

SEQ ID NO: 288 - DNA (genomic), 207 bp, Enterococcus faecium; double-stranded, circular
  misc_feature (B) LOCATION 1...207
  hypothetical: NO
  anti-sense: NO
atgacagctttcgggaaaagcttcaaaaaccttctgacctatgaagaaggcatcaccaacgcaatgatctatccttattccaatggaaaaatagaagcgaagaatacccacataaagacaatgaaacgagtatcctacggatttaaatcatttgagaacatgagaattagaatctttttgatcaatcaattaatcaatgtaagataa

SEQ ID NO: 289 - DNA (genomic), 192 bp, Enterococcus faecium; double-stranded, circular
  misc_feature (B) LOCATION 1...192
  hypothetical: NO
  anti-sense: NO
atgcaagcttttgaacaccgtttataccaagaggtcgtgagcctgccgtttaactctgagtcacaaggagcaatttcaaaaaatagcttctcatgtttgttgaatattgtgacttgtgaccgaggagttggcaggagaacaccgtttattcgaaaaaaggactgtgacaatgtatcgactcccaaaagttag

SEQ ID NO: 290 - DNA (genomic), 3591 bp, Enterococcus faecium; double-stranded, circular
  misc_feature (B) LOCATION 1...3591
  hypothetical: NO
  anti-sense: NO
gggaaagctttgtatttgaaacgaattgaaatagccggttttaaatcatttgcagacaagacagtcattgattttgaaaatagcgtcacagcagtggttggaccaaatggcagcggaaaaagcaatattacagaggctatccgctgggtattaggagaacaatctgctaaaagtctgcgaggcggaaaaatgccggatatcatctttgccggttccgatacccgtaagcagctgaatattgcagaagtcacagtgattttagacaatagtgatcattatctgccattggagtacaatgagatcagtgtaacccgccgttatcgacggactggggaaagcgagtttttcatcaataaacaaagctgcagattaaaagatatccaagaattgttcttagattctggattaggaaaagaatcgttctcaatcatttctcaaggaaaagtagaagcgattttcagtagtaaaccggaagaccgtcgtgggatctttgaagaaacagctggtgtcttgaaatacaagcagcggaaaaagaaagcagaacagaagctttttgaaacagaagacaacctcagccgcgtccaagacatcatccacgaattggaagaacagttaactcctttggccgcccagagtgaggcagcaaaggagtttttacggctaaaagaaacactgactcaaaccgatgtctctttgatggttgctgaaatcaagacagcaaaaaaagattgggacaacaaacaagcacagcttgcgaaattcaatctagaattaggcaaactatctgagtcgatccaagaacaagaatccattttggcgaagcagcgtaaagaaaatgcgcaagccgatcgtctgatcgaaaaaaatcagcaagtattattagatctttcggaaaaactgaagcagacagaaggacaaaaagatgttttgcaggagcggacaaagcatacacaaaaaagctcgcaagaatatcaaacttcattagcagaagcacaaaaaaaggttaaacattttgaaaagcttcaagaaagcttgatgaaagcagcagcagaaaaagaaacagagatccaaaaagctgaagcaaatctcataaaaacacagcaagaattagaaaaataccaaaaatcaacgaaagaattattggcagaattaagagatcaatatgttgatttgatgcaagaacaagcagctgtaggaaacgaactgaagtatctagaacgtcaatatatacaagaaacagcaaaaagcaagcagacgttagccaagcaatcggaagtagaagcatcagtagaccgattgatgttacaaaaagaagaattgacacaaaagcaggcgcagctaaaatcatctttaactgaaacaaaagagaagttagaaatgatccaacaaaacgggaaaaagttccaagaagcattagcaaaagaacagcctaaaatgtatcaattaatgaatcaagtccagcagctacgtgctcgtaagaaaagccttcaagaaatccaagaaaactattttggtttttaccaaggggttcgattggtcttgcagcataaacagcagctttcgggtattgtcggagcagtggctgaactgatcgatgttcctgcagatttcacgttagctatcgaagcagctttaggtggggcagcccagcatgtcatcgttgaaaatgaaaaagatgctcggcaagccatcacgtatttgaaacagcaaagaagaggaagagcaacattccttccactgacgacaatcaaaccaagacaattaccggctcatatattgacacaagcagcagctgtagaagggtttatagggattgccagtgaacaagtcagttatcccgatcaaatccaaactgtggttcaaaacctgctaggaacgatccttttagccaaagacttaactagtgccaatgcaatcgcgcaaacgatccgctatcaatatcgagtggtttccttagaaggtgatgtgatgaatgccggaggatccatgacaggtggagcgaataaacgaggaaaccaaggcagtttgtttgtacaaaatcaagaattgaaacagttgactagtgaatttgaagaagcagataaacaactccaagcacaagaaaaaaaagttcaggagctgcaacaagaaacagctcgtttagccgaagaacaagaagttttgcgtacacgaggcgaacaattacgttttgaagaacaagaagcgacaaatcagctacaaaacatcataaatgaacttgaacgttttgaaaaagaaaagcaaatctcaacttttgagacacgtgaactgcagcagtttatcgaagattacgaaaagcaaacgaacgaattgaaagacaaacaaacagatcttgaatcgcaacgacaaaaaatcgacgaagaaatcaaatcgttaagtcaagaaagcgaccagatggaagccagaagagcacaagtacaaagtcaaaaagcacaagaacaagcagatcttgctgtcttgaaagagcagtttaatcatctgcagatccagctccgcggtgcccgagtccaaaaagcagaggcaaccgaacgtcaagaagcgatagaaaagcagttggcgacattgacagcagacttttctgatcatgaagtcacagaagaaagtttggaaaaacaaattaacgaattatctgctcagcgagaaacattaaaagccgagttggcaaaagccaaagagcagcgagatagaaggcaaaaggagatcgataagcttgaagcagtcttggcagagcgtaatcgtgagcaaaaagcacgactgtcggaacaatccaaattagaagtccaaaaagaccgagctgaaatgattttagataatcatttgacctatctgcagtcagaatatcagctgacatttgagaaagcttcccaagactatcaagaaacaaccgatatcgaagacagtagaacaaaggtttcatccttaaaagaacagattgaaaaactgggaccagtaaacttaaattcaatcgaacaatacgaacaagtcagtgaaagacatacattcttagcaacacagcgagatgatctgttagcagcgaaaaaccaattgtttgaaacgatggatgagatggatgatgaagtgcggacaagattcaaagaagtatttgaagctatccgtcaagaattcaaaattgtctttccaaatatgtttggcggcggtaaagctgaattagtactgacggaaccaactgatttgctgaaaacaggtattgagattgaagtacaacctcctggcaaaaaactgcaaagtctaagtttgctttctggaggagaacgagcacttacagccatcgcgttgctcttttccattatccgtgtctgtcctgttccgttttgtatcttagatgaggtagaagcagcgttagatgaagccaacgtgaaacgttttggtcgttacttgagcgatttccaagatgacacacaatttatcgtagtcacacaccgcaaaggaacgatggtcgcagcagatgtactgtacggagtgacgatgcaggaatccggtgtatcaaaaatcgtttctgtacggatggaagatatcaatgaagaggcgaaaatcaacgaaacgaaagtgtag

SEQ ID NO: 291 - DNA (genomic), 480 bp, Enterococcus faecium; double-stranded, circular
  misc_feature (B) LOCATION 1...480
  hypothetical: NO
  anti-sense: NO
tcagttcagttcaggacaattctatttgttcgatcaagagacgaaacaattaactgggagagagaagcgcttgataaaaagaaataccaatattctgttctttttcaagattttgggttgatggaatatgaaacaatcgattttaatttagatattggattgaagttttcgaatttaaatgtttcagataagcgaacagcaaagtatgaggcattgaaaaaagtaaatataaacaagaagctaagtacgcctatctacacattatctggtggtgagaagcaaagaatcgcctgtgcgagagtcttattgaagaatagcaaaatcattttagccgatgaaccgactgggtcattggataaaagaaataaggataaagtagttgaaatcttatcgcaacaagcttcccaaggtacgttagttatcgtagtcacgcatgatccatatctgaccaaaataggaaacaagaagatcatgctttaa

SEQ ID NO: 292 - DNA (genomic), 513 bp, Enterococcus faecium; double-stranded, circular
  misc_feature (B) LOCATION 1...513
  hypothetical: NO
  anti-sense: NO
attgatcagtttgaaagtaggtcagatgcgacgatcctagctttttctattgcaaaagacgcaggaaaaacaacgatcctgaatcctgcaccagctcgtgaaacgattcctactgaactacttgaaaagacagatatcattataccaaatgaaacagaaacagaaatcattacaggaatcagagtgacagatcataacagtttggtcgcagcagccgaaaaactccatgaattaggtattggaacagtaatcattacactaggcagtgccggcgctttctatcatacagaaaaagaacacggtatcgtccctgcttttaaagtggatgccgttgacacaacagccgcaggtgatacatttattggcgcattaagcagcacacttcagccagaccttagtaacttgaaagaagcgatcctttatggaaatctagcctcttctgttgctgtgcagtcttatggtgcgcaaccttctatcccttaccgcgaagctttagaacaatcagcagtctaa

SEQ ID NO: 293 - DNA (genomic), 213 bp, Enterococcus faecium; double-stranded, circular
  misc_feature (B) LOCATION 1...213
  hypothetical: NO
  anti-sense: NO
ctaacggctttttattatgatccagaggagatgccagatatggaaaacgaagaagcaattgttagagctatcgcaagcttaaatcagattctgcaaaacgaaaaagtgctaagagtctcagttgaaattgatagtgaatgggaagacggtattaaatcgtttgatatcagtgtgaaatatttgccttcaggcgatattaacggagccaaataa

SEQ ID NO: 294 - DNA (genomic), 678 bp, Enterococcus faecium; double-stranded, circular
  misc_feature (B) LOCATION 1...678
  hypothetical: NO
  anti-sense: NO
acggtgcagttctccgaaaggtcgatttccccataccagcggttttcgttttgcttcaagctgtccgtcacatcccgccattgcccgtttttctcgattttcacctgcaccagcgcaaagccgttcccggcttcatcggtaatgcgaaactcggcggcagcactgccggttgcccagccggagggcggtgtaattttgatggagagattggatgcagggattggcgcgggggctttgccggtgcatccggccaggtcggttctgcagatcgggcagtcggcgttgaccgcaccaagttcacagcggttttcgcagacgcagaccgggacgggcgtgggggcttccacaatacagtctgccaggttcaacaggcaggcggggcagtcggcgttgaccgcgccgggttcacagtgggcggcgcagatacagaccagtttggcaggcggttccggctctttgccggtacagccggttacatcctgcgtacagatgggacaatccgtgtcaggtgcgtctgccgcacaccgcgtttcacaagtacagacgggttccggctccgcgccaatgcaggcggctgcctcctgcacacagatggggcagtctgcgttgagggtgtccgccgtgcagcgaatatcgcagaaacaggcaattccgatctggcctcttcacaacgagttg

SEQ ID NO: 295 - DNA (genomic), 189 bp, Enterococcus faecium; double-stranded, circular
  misc_feature (B) LOCATION 1...189
  hypothetical: NO
  anti-sense: NO
gcgccgcagtttctggacacggacttatgtgcagttcatgctgaaaaacgaaatctatgtaggaagcatggtgcagggcaggcagtacacaccctcttaccgcagcaaaaagcgggaaccgatacccaaaaaggactggatcgttgttcccaatatgcacgaacctattgtatcacgggaactgtttga

SEQ ID NO: 296 - DNA (genomic), 867 bp, Enterococcus faecium; double-stranded, circular
  misc_feature (B) LOCATION 1...867
  hypothetical: NO
  anti-sense: NO
atgaaaaagttaagagttattgcaacaatacctatgatttttagttttgcgctattattatctgcatgtggcaaagaagaagctggtgctaagtcaaatgaagcacataatatctcattcatagatagtgcagaacaaaaagactcacgttgttggttggtagtcgaaacaagtagtaaaaataaaacgcctattgataaaaatgaatatgtaaaagcggtgatccaaactaaagatggcaaagcaaaagtatttaaaacggatatggaacagcttacattggaaaaagtttctaaaatgagtgatgaagaaataatagaacaagcattgaacgctgataaacaaaagtttaatgataagaaaaaaagcgatattgatagctataatgccactttagattctgtaaaaacagaattagaaaatgaggaaaaacaagagtttcaaaatgaccaaaaaattgctgattttcaagatagtatacctaaaatacaggcggatatagaagagatcgatggtgttcaatattcagagccggagtggaaaatggtatcagcaacaattaaaatggataatgaaaacaaatcaccttcaatggaaaccgttaaattatcttataaatatttagatagtccaatttggaatttaaatagttttggtgaagtttcgtctgaaggagaattatcttatgaatctactagtatggatttgaagttatcaattccagttgccacaacgaaagttttagataatttttattcaggatattctaatgatgaattggatcaacttttgcttactaaagtagcttctaaagataacaaagttcaattagatagtaaaggtaaaaacgtaagtatagttgagtag

SEQ ID NO: 297 - DNA (genomic), 255 bp, Enterococcus faecium; double-stranded, circular
  misc_feature (B) LOCATION 1...255
  hypothetical: NO
  anti-sense: NO
ctggtttttacatatgcatctaagctttgcggaaagattggggttgttgcactgttatcaaaatatatcataagaaacccctcttttttgaaattcttttctattataacggttgtccaaggtgctttccaagagcaggtgaaattttcacttgtttcaattttcaaatatacaaaaaaagacaaggacaagacaataatccgtcttgctcttgctggtttactaacttttttgctttatactaagtctggatga

SEQ ID NO: 298 - DNA (genomic), 1335 bp, Enterococcus faecium; double-stranded, circular
  misc_feature (B) LOCATION 1...1335
  hypothetical: NO
  anti-sense: NO
cttgcttttacttttttagttacactgttatttaggaaaagtttcataattcaaaggagaaaaaagatgaaagcaaagaatttattatttagcgttattcttttaggaaatttagcagttgccaacacaacagtgctagctgaagaatcgacagaaactgtcgcaactcagacatcgagttcttcagaaacaggaattgaaaacgatacagagagtactttgcagtcagctactgtctcagaaaatacaatttcaaccgaagaaccaacaactgaaacaacagaacaaacacaaaccgaagacagtacatcagcagaagctcagaacaatccagagaatgcagaagaaatcacgaaccaattgacagatgggcaaacattgacacatacccatcaagcagatttgtctgaattcgaaaactatactggctatgctttttatgctcgctcatctgctaattctcaacaagcgttcattgatagtattgcctcaactgcacaaagtttggcaagtgccaatgacttatatgcatcagtcatgattgctcaagccatcgttgaaagtggctgggggaacagtactttggcttctgcccctaattacaatctatttgggattaaaggaagctataatggccaatctgttacgatgcctacttcggaatatgtgaatgggcaatggattacggtgaatgccgcttttagaaaatatccttcgtacaaagaatcattgcaagataacgtaacggtattgaagacgacttcttttcagccaggcgtttactactattccggtgcatggaaaagcaatacgaactcttacaaagatgctacggcttggctaacaggtcgttatgccactgcgcctaattatggttctacattgaacaatgtaatcgaaacctataatctgacacagtatgatacagcaccaacttcaacttctccgatgtatcgtctgtataaccgtcatacaggagaacatttatatacattgaatgccggagaaaaaaattatctgccaactgtaggctgggaatatgaagggattgcttggcaagcaccaaacagcggacaacctgtctaccgtttatacaatccttacagtggagaccatcattacacaatggcacaatctgagatcaactctttaacaaaaatcggttggcgttatgaaggtctaagtttttattctggtggttccaagccaatttatcgactatttaatccaaatgaaaaaactggtacccatcactataccttgagtgctaaggaaagagattggctaacaccgatgggctggagatatgaaggaataggattttatggttattaa

SEQ ID NO: 299 - DNA (genomic), 210 bp, Enterococcus faecium; double-stranded, circular
  misc_feature (B) LOCATION 1...210
  hypothetical: NO
  anti-sense: NO
gttcgaaagtttaaaggaaactttcaagaactgaattacattacaaaggagatgaattttatgacgtttacaaaaaaaaatatgcaataccgcgtagcctttgatacaacttctaaccgttttatggcgattgatgcacaaaacgaaaataacgttgcgtttggtattacaattgaacaagcagtccgagcattaaatgaatctagatag

SEQ ID NO: 300 - DNA (genomic), 1890 bp, Enterococcus faecium; double-stranded, circular
  misc_feature (B) LOCATION 1...1890
  hypothetical: NO
  anti-sense: NO
aaaacgtttaccctaacattacaagttttagaaaggaatacctttatggctttttttaataacatatataataaaaaagaatctttttatttacgtataaagtggagcacaatcattatattatcattgttatttttaacaggaattgcttatttcttttattttattttttctcctgcggacagcaatcaaatgaaagaaataaaagattcgtgggttttctatacaaaagatgatcctgattttaagtttgacagcaagtacactcgtacgattcctaccgtggataaagacgaaacattcattatggaaacgacacttgaaaaaccgttggacgaagcaaatttactaatcaaaggaaaccatcaatggattactgtatatctaggcgaaaagattttataccaacggaaagattatcaggaagaaagcaatcccggactctcattggctgtgatagatttaccagcaaattatatcggaaaaaaattgacccttacagtctcatctccttatcagaactatgctggactgccaccgaaagtttatctaggaacaactggaccattgattagttttatttattcacaatcagtgccgcaagtattgacgatgataatcgctgtttttatcgctatagggacctttttctatacgatctacttgatgtataaacaaaaacgtcttgaatactcacttattctcttaagttgctttgctttggcattaggatttgaagctgtatcagaagatattttaagtggtattctttttgaaccattcgttcattcttttttatctcatttatttattatcttaacgtcagctttcatcatctgctactattggagccgaatgttttactataaaaaatggtacggaattttttgtacgttccaacttttgatttttatcggcgttctgctttatgcaacttttactcctgcagaacttcctgaattaatgccgattgctaatattgctagtgttataagcactttagtcacttcacttgcatgcattggcgaagcatataagaataaccgtttttatgtagcttgtacaccttggatcgtcttggtagccattatccattgcttgatttacatccaaacggcattaggtatctatcaaacaacgatcaattggtctacgattttatatattatcattctaatcgttattatcagctacaatctaatcgatcacatcttaaataccgacaaagatcggagacaagtagatttcttaaaaatcaaaaatgatttgttggagcaacattatgagcagcttcgacagcatatccaagaagtaaatacacttcgcctggaatttgtccaagagatggagaatctgcaagatttaatgcatacggaccaaacaaaagctaaaaactatgtggaaaagatattagaagaagcaaaaaatttcgaaatgctgtgttctttttgcaaccaccaggtgacaaatcttatcttagcgcgttaccagaagttagctgccaaacggaatattcagataaccttccaagcagatcttcccgaagaacttcctatcaacgatgacgatctggctcaacttttgatccacgctttagagcattcctttagagaaactcatgccatcgaaaatccactgtatcgaaaaatttatttgtcgatacacgaacaagaggaacatttcgtcatttgttgcgaacatagtgcacattacgatacaaacctatttagtcgaggcatcacagaagaattagatgatcaggaacgttttgacttaatgatgatgaaagacgtagcggatcgttacacaggaacactaacgcaggaaaaagatactttcattgatcggatcactgttcaactctctcgaaattacccgaatcctgtataa

SEQ ID NO: 301 - DNA (genomic), 1482 bp, Enterococcus faecium; double-stranded, circular
  misc_feature (B) LOCATION 1...1482
  hypothetical: NO
  anti-sense: NO
gatatgaagttggattaccttatagaagaggaagatagagaaaaactgctgctagctagatatttagaatttgagaaaaagaattatgtagtgctgcctaagttatatgaaacattaggtttgtctaaatttaaaacaagaaattatatcatagaattaaataaagaatttactgaattcaaaacaaagccagagatccaaatttcagaagaagcagagatccatgtcgaacgtctgaatttgacggatatcaaaaatttaagaagaatctactttcaacgatcaaaaattgctcgactgttaacggagatcgtggattcaaaagtaacgatcgaaaaatttgcagagaatcattttttaagcatatcaagagcctatgtaaaaagaagagaattagtctcttttcttgaacagcatcaaataaagttaaagaaaaacatattagttggggaagaaataaacatacggaacgtattatttggggtatatttcggggtctttaatggtttttctatgccatttagagaaagcgtcatgaatgaagcaaagagtatcgtgcaatattttgaatatctgttcaatttaaaactgtctgcaacaaaacgaatcaaattcaatttgctaaccactattagtttgttgagggcctatgggaatcaaccaatcggaaaacgtttcttttcagatgaatactttaagagctcagaaggaatgaagatcatcaaggatttatcacatatttcttttcttcatatccctaaagagcagatcattgatgagatttcttatatcatgttgtttttgatcacggaagaagaatttgaattagatggcgcatttggacttgcggaagctcattttcatgatatccacatgattagtcaaaaaatgtcagtggaattgattgatcaattaccattttcgattgaaatctctgaagaagaaagactatatatacgaaaagaacttcgtatgggtatgatgcatgtcaatcgaaaaaattggatattcgactttgagatgactagctttacgtctaaaaagcagctacagtttttcttcgagacgtatccaatattcagtacagcaatccaaaaggtcatacaagagaataaacgctatttcttgggaaaagatgaacgtttcatgattcgcttattttatgattatctctttttattggtcggtatttgtccggtatcatattttgaagcaccgattcatgtctgtattgatttttcgcaaggatctgcttataccgattacattatttctcaagtgaaaggatttaaaaattacaatattgtgattgagagtcgaatcacttctcgtacgaatatttatttatctgattgtttacttgaaaaatttaataaagaacagataatttggaaaaatccaccgactccagatgactgggaatattttggaaataccatcatcagagaaaaaaatagacatttaactgaaaaaatcagctag

SEQ ID NO: 302 - DNA (genomic), 549 bp, Enterococcus faecium; double-stranded, circular
  misc_feature (B) LOCATION 1...549
  hypothetical: NO
  anti-sense: NO
aaaatgaagttgtcagaaaaagaattaaaagaccaattgactgaaatagttaatgacatattggctgaggcacacttgaaaaaaggtgatctttttgttttaggatgcagcacaagcgaagtcgttggaggacatattggaaaaaattccagtgcggaagttggtcaatggatcatccgtacgttaaaagagttgttggatcctaaagaaattgcgctagctgtccaaggttgtgaacatttgaaccgagcattagtagtagaacgaacagtggcagaagcaaaaaatttcgaaattgtctctgttgttcctgcactacatgctggaggtgcttgttctgttgctgcttttgaccagttcaatgatcctgtcgaagtggaacacgtagttggacaagccggtatcgatatcggtgacacatcaatcggtatgcatatcaagcatgtccaagtacctgtcagacctcgtttgaaaacccttggacaagctcacgtgacagcccttcgctctcgtcctaaatatatcggtggtcctagagcgaattattga

SEQ ID NO: 303 - DNA (genomic), 657 bp, Enterococcus faecium; double-stranded, circular
  misc_feature (B) LOCATION 1...657
  hypothetical: NO
  anti-sense: NO
cggtcgaagttcgggcagagggttcaatttggtggtcgttcatatgggggcagttattttggcagtcgttcttacggcagagattcttatgggtattatggtccaggtacaggtccttctagttatgagcaaacgggatttcttgcattagctgttttgtcagtaggaggggtttctgctttttctatcgtcaagaataaaagacaaaagaaaaggctgaaagcggagatattgtcccgcatgtcaggaacggctaaagaaaagaaagcacagtttctggaaatccaaaagatattcatgaagatccaatccgcttgggaagaagaaactcctgaaaaagccagaagctgttatacagacaagctgtttgccgaacatcagaaagttctgcaaaaaaacaaagcagacggtgtaagaaatcatactaaaaaaataactattcaggaagtaggaaattatcgacagatccacgaaaatagttttgccatccgaattgatttcagatgctgtgattattcagtcgatcgaaaagatgggcgattgatctcaggaagtaagacacaacgacagtatttttctcagatatggtattttgatttttctgagaaagaaaaaagatggcaagccgattttattcagccgattatgctggattga

SEQ ID NO: 304 - DNA (genomic), 333 bp, Enterococcus faecium; double-stranded, circular
  misc_feature (B) LOCATION 1...333
  hypothetical: NO
  anti-sense: NO
tcaaagaagttccataaggccgcagatcattttttccttggaaatatcctctcgattgcactaagaattgggatagcaatcaaagatgggcataaacttctgatagctagtatcccattattaacgttagcaatcggactgattccggctagtaaaggagcaaataaatacatcagtgcagcagaggcgataccgatgacaaacatgatattgatcgtacttctaaaaatcagccgacaagcagcgttatctccttcttttgtggctacagctactttttttgcaatcgcatttggaaatccgactgtaccaagcatcaggaacaatccataa

SEQ ID NO: 305 - DNA (genomic), 3666 bp, Enterococcus faecium; double-stranded, circular
  misc_feature (B) LOCATION 1...3666
  hypothetical: NO
  anti-sense: NO
ttctttattacatttctttctaaaggaagtgtgataatgaaaaaactaaaactgattagcattgctctattcagcctaatcactatgtcaacggctcgccaatcaattgtttcggctgaaggaacgtctacgaaagcagtagtagaagagtctggcgataaaaaagttgctatagacgacaaagtgaaaaacgaagcggaaaaagcgactgtggttcaaggggcagacggcttgatgtatgtggtcgttgatgaaaatgatcctgaaaaattgctagaagctgaatctcctttgaaaaatcaacaagaaaataccggcgctgttgaagtcggtgttgatgaaaagagacaagaaaaggctgataaagctaacgaaaaagtgaaaaactttgacgatattgattacaacgatattagttcgttgcagtcagcgttgaatgatccgaaattcccttttttatcggaagatgaattaaatgaaaaattgcaaaagacaaagaatacatttgagtctgaagcgctaatgaaaaagacaaggggatatttcagtcaaaggattttagagttaagcaataatttaaatgacgtaccgaaaagagcgaaagtgagtcggcatgctttagttagtaaccgtgcttcacaagtaagtgaaacacgaataaaccctccaaatggttatccgtgggtgatttatttaattaggagcaatggttatagttatacagaaaattatgctattagaagaactattgatgggaaagaagctttttgtttacaggccggtgtacaagcgacgaatacatacactggttcaacaagtggttatctttctaattcgcaaagagaaatgattagttcgattttatcagcatataaagaattaggcggttgggctaataatgatgccggaaaacaaagatggatagcaactcaaatgcttgtttgggaaaacagtaatgaaaagcctaaaagtataactgttacgccaaattggaaaaacggagctactaagtggaaaaatgatttagtggctcgtgcaaatgctattagagtaagaacaaaatgggattctacgtctaagacggttgatgagggagataaagcaacctttaaagtaactaatacttatggagatcataatttgcatgtgaaatctgtatctggtggcggcaaagctaccataagcaatggtactttaactgttgatactacaggagccactggaaacaaaatcactgtagatatgattaaaggttctcacccttcagacgcgcaccctacaacggtatggagtaatggttcttatcaaaagcttgttaccggttctttttacattagtacttctgttacggtaaatgttaagagaaaaggaactgttgaagttttaaaagttgattcagaaacaaaaaaaccattatcaggagcaacatttagatttagctactcaggtaaaacaaaagatgttactactgattcgaatggtaaagcaaaattaactgaaaggttgaaagctggaactgtagtaaaagttaaggagataaaagctcctaatggctaccaactagattcaagcgaattttcaattacagttaaagaaaatcaaaatgttactaccacaagaaccaataagaaatccacaggttctgtagaaattgaaaagataggcgatttagatggattaggactaccgaatgtagtattcacgatttataattccgataacaaagttgtaaaagataacttaaaaacagatagtaatgggaaaataaaagtcgatgaactgcaatttggtaaatattatgcagtagaaaaacaaggtgttactggttatgatcccgatggtaaaaaatacaattttgaaataagtcaagatactccttttacaaaaccggctaaagtgaaagtaacaaatatttatgaagtatccataagcgaaaaagtatcggacatgaatgaaagtcaggtattaaaaaataattggtctgctgatccaaacgattatcttcaatatgacattacaactggaaatctaaaaaaatcgggagaaagaaacgtccaaagtttcattatcgaagggttttacgacaataagaatgtagatgtgtcaaaaagtgaagtatatgttggatcaacaaatgtaacaaactcttttgacattaataacgatactaacaatggaaaagtaattgctaaggcaaagacaagcgtattaacgaataatgatttttataataagtcctataatttacggatcactatgaaaattaaaaaatctactcttgaaaacactgaaaagcaaaaaaatttaacgattgttaaaaatagtaaagttactgtcggttcaaaaatctctaaatctgctagctctaatgatgtagaaaccgttttatattcaagaaaagttactatcaatcatattgatgaaaaagacaaacaccttttgaaacaagatattgattataaatacgatggggaaacgtatgaatataaacctagaaccgatttatttgataaagatggaaacaattataaatctgatgtaatccataaagggaaaattgatggaaaagatatagttttaaacactccctatcatattccggtactttctgtgaatgtggatcggattcaaattgatacggctagagctgttaaaaatggctatttacctacaaaaatagaactaagtaaaaaagaagaatatgaaaaagaattagaaaaaattgtattcaaagttaaaattacagatatagataacaataaagttgtttatgatgaaaactttaaatacaaagaatttaatagtcatatgtcgcttgatttacctacagaatatttaacaaagaataaaaaaatcaattatagtgttgatattcttttagtggataatccagataaaaacaagttcgaaactgaaactaaagatttaagaacgatcggttatacttcttctgaaaaagttttaacaaacaaagatatgacaaataaccaagtcaactattcagcagtagttagaacagtgaaagaaagagagaataataatccggtcaaagagttcaatgagagtatcaattataaatttactgatagcactaaaacaaaaacaggatatggtatatcagttgatttagagccaacatatagaaatgaaattgggaaacaaatagatatgaaagtctatagttatccgatgaatgaattgattgacagcaaaattgacgaaatctatcaaagtgggggaaaagaaacagaagttaagatggatcgcttaaagaatgatggtaaagttgagtcgggtattagtactcaaaatctttcattccaatttccacatatgaatatcgaaagaaaaactggaaatatatatgctgacagtcaaagaaatgatgaatctattaagtatgaattgatcgatggcggtagaaaattatatgtgcctatttggtgtgatttgggaaattattctattgctatcaaaagtagtaactttggtggtaactatatctcgttggatatgaaccagaacatagatgtttatgcttatatgtatgcaacgatagatagtgaaacaaaaaaagatgatgaattactgcttgaacctgtttatccagagtctactctaccagatggttggagcaaaaatgagattgattggctgaataaataa

SEQ ID NO: 306 - DNA (genomic), 537 bp, Enterococcus faecium; double-stranded, circular
  misc_feature (B) LOCATION 1...537
  hypothetical: NO
  anti-sense: NO
agaaagaagttgaaaacgatgcctgattacaaaaaaataacttttataagttctataacgttgattatatttttaattcttattcttctcgtcgtcttggttccccgaatttttggtttgactccttatattattgaggacaaagaaatgagtccatattatgcacaaggaaatctgatatatgtacgaccgaaaaatacaaatgagattttagtcggagatattattacatattatgaaaattcaggaaaaaaaatctcgacgcgtcgcgtaatagccgttgaaaacaaccacgaagatttttatacaaaagctgatacaaagacttatattgagcctggagtagtaaaaaagagaaatattatcggtagtcccatctttcagattccatatattggactagtcctttcaaaaacggcatttgcatggattcaggggttattctttacgattgctttttgcctaacaggaatcacagcatggaataccttcgtagagttgaaaaagaagcggagacgaacacagaaatttttgtaa

SEQ ID NO: 307 - DNA (genomic), 1566 bp, Enterococcus faecium; double-stranded, circular
  misc_feature (B) LOCATION 1...1566
  hypothetical: NO
  anti-sense: NO
gctattattacagaagataatgatgaaatgaaaacaattggtatttacctgatcagtctggctttgctaggattagccgcaggtgtaacgaacacgattttctctgcaaaagtagctcaaggcgtaagtgcagatatccgagaagaagcatttcgaaagatccagacattttcatttggaaatatcgaacagttctctgctggaaatcttgttgttcgtctaacaaatgatatcacgcaaatccaaaatttagtgatgatttctttgcaatcactttttcgaattccattcttatttattggtgccttcattttagctatgatcacgatgccgcaattatggtggatcatcgtagcgcttatcgttacggtatttctgattacggcactttcatttacaaggatgggcaagcacttcatgatcattcaaaaactgattgatcgtgtgaatagcattgcaaaagaaaacttactagggattcgtgtagtgaaatcttttgtacaagaagaaaaccaattgaagtcattcagcaaagtaagtgaggacttaacaaaacacaacatcatagtcggtacattattttctgtgatgatcccgtccttcatgctggctgccaatttggctgtggttggggcgatcttttttgtgagcgatcttgttaaagatgatcctacgttaattggtggaattgcttcattcatgaactacttgatgcagattatgatggcaatcattattggcggaatgatgatgatgatgacttcaagagcagccgtatcgctgaagcggattgcggaaattttagatgctgaaccagatcttacttatttagacgttccagaacaagagttgacgggttctgtcacttttgaccatgtttcttttcgttatcctggtgaggatacagatacgcttaaagatatcagcttttctatcaaacctggagaaatggttggtatcgtcggggcgactggtgccgggaagtcaacactagcacaattgatccctcgtctatttgatccgacagaaggcaaagttgaagtaggtggtgtagatcttcgtcaagtaaatgaaaagagtttaagacaaacggtttcctttgttttgcaaaaagcaattttattctcaggaacgattgctcaaaacttgcgccaagggaaaaagaatgcaacagaaaaagagatggaacatgcttcttctattgctcaagcaaaagaattcatcgaaaagttatctgatcgttacgaagcaccaatagaagaacgtagcagtaacttttctggtggtcaaaagcaacgtttatccattactcgtggcgttatcggtaatccaaagatcttgatcctagatgacagtacgagtgcactggatgctcgctctgaaaagctggtccgagaagcactcgatcgagatttgaagggaacaacgacgattgtcatcgcacaaaaaattgcttctgttgtcaaagcagaccgcatcttagtattggatgaaggcagattagtcggcgaaggaacccatgaggaattggtagctggcaaaccgtgtctatcaggaaatctttga

SEQ ID NO: 308 - DNA (genomic), 1347 bp, Enterococcus faecium; double-stranded, circular
  misc_feature (B) LOCATION 1...1347
  hypothetical: NO
  anti-sense: NO
gcattcattacattgaacgaagaaaaagcattggaacaggcaaaagctttagatgaaaaagggattgatgaaagcaacgtccttgctggtattccaattggtatcaaggataatatcgtaacaaaagatatcttgacaaccgctgcatctaagatcctttacaattttgaaccaatttatgatgcaacggtcatggataaaatctatcaagcagatatgatccctgttggtaagctaaacatggatgaatttgctatgggtggaagtacagaaacttcttatttcaagaaaacaaaaaatgcttgggacccaacaaaagtacctggtggctcttctggtggttctgcagcagcagttgcagctggacaaattccagtttctttaggtagtgatactgggggaagtatccgccaaccagcagcttttaacggcatcgtagggatgaaacctacttatggccgtgtctcacgttttggtttgattgcctttgcttcatctcttgaccaaatcggaccaatgacccgtacggtgaaagataatgcattagcattgacagctatcagcggttatgacgaaaaagacggtacttcttcaggcgtttcagttcctgattttgcagagggactgacaggcgacatcaaaggaatgaagattgctttacctaaagaatacttaggcgaaggtgtggcccctggcgtaaaagaagctgtattgaaagcagcagaaacattccgttcattaggtgctgttgtggaagaagtcagcttgcctcattcaaaatacggtgtggctgtttattatatcattgcctcatcagaagcaagttccaatttgcaacgattcgatggtatccgctacggttatcgctctgaaaatgtgaaatcattagatgatgtatatgtcaactcacgttcagaaggattcggtgaagaagtaaaacgccgtatcatgttaggtacattctccttaagcgcgggttattatgacgcttacttcaaaaaagcaggacaagtccgtacattgatcaaacgagattttgaaaaagtctttgcagattatgacttgatcatcgggccatcttcaccaacagttgcattcggaatcggtgagaacattaacgatccaatcacaatgtacatgagtgacatcttaacgatccctgtcaacttggctggacttccaggtatgtctgtaccggcaggtttatcagaaggattaccagttggattgcagatcatcggtaattattttgatgaaaaaacgatgtatcaagcggcatatgcgtttgaacaagcaacagaattccataaacaacaaccagctattttaggagggaaagacgaatga

SEQ ID NO: 309 - DNA (genomic), 195 bp, Enterococcus faecium; double-stranded, circular
  misc_feature (B) LOCATION 1...195
  hypothetical: NO
  anti-sense: NO
gggttcattacgctaccaggtacagttgggcgtttacgcatccaacgagagcgtccagctttaccgatgttgattaattcgtgttgttcgttacctacagaaccgattgtagcacggcatgcagctaagatcatacgaacttcaccagagttcaagcggatcaatacgtatttgccttctttaccaagtacttga

SEQ ID NO: 310 - DNA (genomic), 732 bp, Enterococcus faecium; double-stranded, circular
  misc_feature (B) LOCATION 1...732
  hypothetical: NO
  anti-sense: NO
attgacattacctctgaagagatctatcaacgtttgccagaggaaatccctggtacatctttgccggatggtgagtcgatcacagaaatctttgagcaaatcaaaaaagacggttatgaaaaggtacttgcggtaacaatttccagtggattgagcgggacatataatgtggttcgtttaattgcacaacagcaagaagaattggaagcatatgtactagatacgaaaaatattggtattggtgcaggtttttctgcgatccaagcagcaaaatggctggaagaaggagtagaatgggatcaactgatcagtaatctgaatgagttagtcgaaagaacaaaagttttctttaatgttgcgacattggaatatcttcaaaaaggtggacggatcggtttagttgcttctattgtaggaaccgctttaaagcttaacccaatcatctcatgtaatgaagaagggatttattacacagtaggaaaagctaggggacgtaaaaaaagtttggataaaacggttgcttacgtcaaagaaaaaatcggtaatgcaaaggtcttcaacttagctgttgcccatggggatgcgaaagaagaagcaattgaaatggaagcgagacttaaaagagagttcccacaagcaaaccaaatctactttggccagatttctccggcattagtagtccacactggtccgggattattgggtgtcggtgtacaagttttagaaggataa

SEQ ID NO: 311 - DNA (genomic), 324 bp, Enterococcus faecium; double-stranded, circular
  misc_feature (B) LOCATION 1...324
  hypothetical: NO
  anti-sense: NO
ccagtaattaccactcgattcatttgtttgctctccttttcttatccgtgcatgaccaatccgccatcgacattgatgacttgtccggtgatatatggattttgtgctaagaaaactgctgtttgtgcaatatcttctacttgtccgaaacgctgcatcggaatttgcttttccgcttgttccttgactttgtctgctaaaacttccgtcatatcagttgtgatgaatcctggcgcaatggcattacatgtaatgcctctagttgcagcttctcgtgccacagattttgttaatcctactacgccagctttactagctgcataa

SEQ ID NO: 312 - DNA (genomic), 816 bp, Enterococcus faecium; double-stranded, circular
  misc_feature (B) LOCATION 1...816
  hypothetical: NO
  anti-sense: NO
ggggggaagtttcctatgatccttcataaatataatggctgcggaaatgattttatcttattagattacgcagaagacacagattatagtcaattagccgcttctttatgcacaaaagaaaaatatgatatagacggattgatcgccgtaaaaatcgatccgttggaaatgatctattacaacaaagatggcagccgcgcgccgatgtgcggaaatggcattcgctgttttgctcgatacgtaaatgatcagaacatgatgaatgaacaggaattcaacgtagagacattagcaggcacaagaaaaattacggtgttggatccctcacctttttattgcagcgtagatatgggagtgccagatgattctccggaaaaaatcaaagctaatcaaacttatccaataaaaaaccaggaaatagagatcaatggtgaaaaagtaacgatcactagtttatttttaggaacgattcataccgttgtttttgttgaaaatgcgcgtgaggaagtctggagaaaaagaggtgaactgatctgtcatcatcctttgttcaaagaaaaaaccaatgtcaactttgtagaagtagtcaatgaacaagaattgatcgtccgtacctatgaaagaggagtaggttggacacttgcttgcggtacaggttgctgtgcctcttatgtggttgctaaggaaactgggaaaatttcagcagatcaggtagttgttcacttggaacaaggagacttgatgatctctggtgaggatgcgatacaaatggctggcccagcagttcatgaatggacaagaatattggaggaatga

SEQ ID NO: 313 - DNA (genomic), 858 bp, Enterococcus faecium; double-stranded, circular
  misc_feature (B) LOCATION 1...858
  hypothetical: NO
  anti-sense: NO
tacctgattacggggattttctgtggtatgatagagaatatatgttcgaggaggatgtttatgttaaccgttacgagaatcagtaaaggcaaaggccctttctatcgcgtagatttatctgaaggagaagctttacaagtatctgaagatgtattagtacgctatcgattattaaaaggacgggaattagacgaagaaactatccaagagatcaagaagagtagcggagctgatttcggttttcacctagcaatgaattacttaagttatcagttgcgatcggaaaaagaaatccgaacatacttaaaagaaaaggaaatccttcaagaagatcgaaataaaatcgtagcccgcttaaaagaattggaccttgtcgatgatttggtctatggggaaagttatgtgcgcacgaatatgcgcttaagtgacaaaggaccaaagaaattagcgcagcagatgcagcaaaaaggtttgaaacctgaaatcattgaacaagcgctcagccaatatacatttgaagaccaagttcaaaatgcacatcagacagccgaaaaagcgtttggaaaaaatcacggaaaaagccaaaaagaattattgagaaaaatccaacaaacattgatgacgaaaggcttttctcaagaagtgatccaacaagcgatagctgatcttccgcaagaagcagatcaagaaatagaatatgattatttagtcaaacaaggagataaactatggcgaagaaatttaaggtttgaacctaaaaaaagaaatctaaaagtaaagcaaagcttatatcaaaaaggatttgatttggatatgatccagcgattcattacggaaaaggaagaggaaagtgaataa

SEQ ID NO: 314 - DNA (genomic), 1377 bp, Enterococcus faecium; double-stranded, circular
  misc_feature (B) LOCATION 1...1377
  hypothetical: NO
  anti-sense: NO
atggagattacgaagaagacatccaaaaataatagaaaagaggttctttcattgaaaatggtaaatgttgttggagcagggcttgccggaagtgaagctgcttggcagatcgcacaagcaggagtccctgtccgtttatatgaaatgcgtccagtcaaatcgactgaggcgcatcacacaagtaattttgctgaactagtatgttccaattcattaagaggaaacagtttggctaatgcagtagggttattgaaagaagaaatgcgccgattgaattcggtagtaatcacttcggcagatgaaacagcagtgccagctggtggtgccttagctgttgaccgcgattctttttctgaaacaattacccgaaaagtcaaagagcatccattagtaacagtgataaacgaagaaattactgaaataccggaaggaatcaccgtagtagcaacaggacctttgacttctcatccattagcagaaagcatcaaagcattcaatggttcagatggtttttatttctatgatgcagctgcaccaatcgtagacaaagctacgatcgatatggataaagtatatttgaagtcccgctatgacaaaggagaagcagcttacttgaactgtccgatgacagaagaggaattcaaagctttccatgaggcactaatcaatgccgaagtggcagaacttaaatcttttgagaaagaaaaatattttgaaggatgtatgccaattgaagtaatggcacagcgaggattcaaaacgatgcttttcggacctatgaaaccagttggattggaagatcctaaaactggcaaacgtccttatgctgttatccagctgcgtcaagacaatgctgcagcttctttatacaacatcgtgggctttcagactcacttgaaatggggcgagcaaaaacgtgttttccggatgattcctgggttagaaaatgctgaattcgttcgctatggtgtgatgcaccgaaacagctttatgaattcgccagaattgctgaaaccgacttaccaatcaacgaaacgcgaagatctgttctttgcaggtcagatgactggtgtagaaggctatgttgaaagtgcagcgagcggactacttgctggaatcaacgccgcacgcttagcaaaagaaatggaaccagtcgagtttccacaagaaacagctattggaagtatggcttactacattactcatgcggaaggaaaacatttccaaccgatgaatgccaactatggtctgtttcctgaactgccagagcgcattcgagacaaaaaagcaagatatgaagcaattgcacaacgagctttaaaagctaatgaggcaataaaaacagaattagaaaaaactgcaatcccaaatgagtaa

SEQ ID NO: 315 - DNA (genomic), 343 bp, Enterococcus faecium; double-stranded, circular
  misc_feature (B) LOCATION 1...343
  hypothetical: NO
  anti-sense: NO
aataatgttacaacgatcctgcgaaatgttagggaactatctatttctatcggcagatatcctttgaatattgcgcggtgttctctattacggttaagggagcggcgggatattttatatttttccatagttgctcgccgagactcttcacgggagaacctatttttctatttcgccttgttctgcnccncagtatttgagcacaatattctattccctttattgaagacaacaaagggtgttccactttttgtggctcaaatattcatatataatacgacaccgctctcgtacgaagttgtaagaactcgcaatatcttcgcggcaggatctttggggagac

SEQ ID NO: 316 - DNA (genomic), 2190 bp, Enterococcus faecium; double-stranded, circular
  misc_feature (B) LOCATION 1...2190
  hypothetical: NO
  anti-sense: NO
actgacgttacgaaagtcagaggccgaactaatcttgatacaaagggaggaaaaagaatgaatatcgcgttagtcggaaatccaaacagcgggaaaactagcttgttcaatctcttgactggttcgaatcaatatgtagggaattggccgggcgtaacagtagaaaaaaaagaaggatcgttgaaaaaaaatccgaacattcatattcaggacctacccggcatctattctttgtctccttatacaccagaagaagtgattgcaagagattatttggttcaggaacagcctgaactgatcatcaacattattgatgctaccaatttagaacgaaatctttatttaactacgcagttattggatttagacattcctatgatcattggtctgaatatgatggatgtcatcaaaaaagaaggaaaaaaaatcaatctagaaaagctttcctatggtcttggtgtaccagttttaccaatcagcgtattgaaaaagcaaggaatcgaaaaactaatcgaaaagattcaggagtctgcaaaaaagcggccttctattcctgttccctgtacatatgatccacgtttagaagcagctttacatgaaattgaagatgtactaggagaacaaagcggcaagaaacgctggtatgcaatgaaatattttgaacgagatcagaaggtaagagaggattacgagatagcagtttctcagcaaaaagagatcgagcaactgatccagttaacagagaaactattggacgacgatagtgagacgattctggtcaatgaacgttatgaatttattacccaactatgtacactctgtgttgtgtcaaatgattctttccaattatcgatgagtgacaaaatcgatcagattgcaacgaatcgttggttagccttgccgatcttcgcatttgtgatgtggctgatctattatctggctattcaaacagtaggaacaatggggacagattggatcaatgacacattgtttggtacatggttaccagaacatgttggcagattgttagctgaatggcaagtagcgggatggatgcaggagctgatcttgaacggcatcatcgcaggcgtgggagcagtgttaggatttctaccgcaattgattatattgtttttatgcttgagctttctggaagactgcggatatatggcgaggatcgcttttgtcatggatcgacttttcaggaaattcggtctttcaggaaaatccttcattcctatgctgattgctacaggatgtggagtgccaggcgtcatggccagtcgcacgattgaaaacgagcaagatcgtcgtttgacgatcatggtcacaaccttcatgccttgttctgcaaagttgccgattattgccttagtagcaggggccttttttcctcatcaatcttgggtagctccttctgcctattttcttggtatgactgcaattattttctctggaatcagcttgaaaaaaacacgtttgtttgctggagatacagctccttttatcatggaattgcccgcatatcattttcctcaatggtcagcggtcctaagacaaacctatgaccgcagcaagtcttttgttaaaaaagcaggaacgattatctttgtttctagtatcgtgatctggttcagctcttcttataatttttatgctcaacctgtttctgaagaccaaagtatcttagcctttttcgggcgaatcctggcagttgtttttcagccgcttggttggggaaactggcaaggaacagtcgcagcgattacaggattggtcgctaaagaaaatattattggcacatttggtattttgtttggtcatgcggaagtatccgaaaatggcagagaaatctggcaagtgctacaacacacatatactcccgcagcagcttattcattgttagccttcaatttactttgtgcgccttgttttgcggcaattggggctatccatcgggaaatgaatgccaagaaatggacttggatcgccataggctatcaatgcggtttagcttatttagttagttttgtgatttatcagttgggacacttattggagggtggacaggtagcgttagggacgtatcttgctattttactgatgataggactcgtttatgttttgttccgtcagccaaaatccaagaaccagttttatactatattgtcattagaaggagaggaatag

SEQ ID NO: 317 - DNA (genomic), 744 bp, Enterococcus faecium; double-stranded, circular
  misc_feature (B) LOCATION 1...744
  hypothetical: NO
  anti-sense: NO
aaaagggttacatttttatatgaagctgtatttttatataacattactggaggagatattgtggatacactggaacaaatcaaaggcggagtcgtcgtttcttgtcaagctttggaaaacgagccgctacacagttcttttattatggggagaatggctttggctgcaaaagaaggcggagcagttggtattcgatcaaatacgacagaagatatcaatgaaatcaagcgaatcgttgatttaccggtaatagggattatcaaaagagattacgatgggtcagaagtgtttattactgcgacagaaaaagaagtggaagaacttttggagacgcaagcagaaatcattgcactggatgcaacttctcgtaaacgtccgacagaaaaaacaactgctgaacttgtccaaatgattcacgaacacggtcggttagctatggcagatatttcgacttttgaggaagcgcttcaagcgcaagaagatggttttgatcttttgtctacgactttagcaggctatacagaatattcacgaaagacgcagacacctgattttgatttattgaatcaaatcatagaacaagtcgatatcccagtaattatggaaggacatactgactctcctgaacaagtagagaaagcatatgaattaggtgctttttcagtcgtagttggatctattatcacccgtccgcaattgatcactaaaagatatgtcgaagccgcaagtaaagcaaataactaa

SEQ ID NO: 318 - DNA (genomic), 648 bp, Enterococcus faecium; double-stranded, circular
  misc_feature (B) LOCATION 1...648
  hypothetical: NO
  anti-sense: NO
ctttattctacagaagggacttccttttttgtatggattttttcatttacacaaaatattttatactctcttttatttgttgttccatggcattgtttagatttaaaagaaagtcctttagtgactatgctgcaagtgatccattgccaaggcggagcagcaattgtcaatctaatgattttggttgcttctttgtcctcagcaaatagtgcagtctacagtactagcaggattttatatcaaacagcaaaagaaaaaagtttgccccattggttttgtgcgctttctaagaaaggcgtacctttacacggtattttaattacaggaatgttattttttgccggtctttgtctacatttttttgtagctgatagtcgattgttttttcagcttttggcaggcatgacaacgagttgttttctatttgtgtggtcttcgatcttgtgtgcacatgttcaatttattaaagaaaagaaacggaacactacacaaagatataaagatcttgctttgttggtgttttttacttcaattgctttcagcttgttattcgaaagcacgacacgctttattccttttttattggttatctggtttgtattcttaaattttgtatataaaagaataagcaatagaaatatcagttag

SEQ ID NO: 319 - DNA (genomic), 183 bp, Enterococcus faecium; double-stranded, circular
  misc_feature (B) LOCATION 1...183
  hypothetical: NO
  anti-sense: NO
ctttattctacagaagggacttccttttttgtatggattttttcatttacacaaaatattttatactctctgaacatattaagaagctcaggattttgtccttttttaacggcaaatgcatattttccgccagattcttttttgatcggtgtttccaattcttgtccttgtttgatcgcataa

SEQ ID NO: 320 - DNA (genomic), 306 bp, Enterococcus faecium; double-stranded, circular
  misc_feature (B) LOCATION 1...306
  hypothetical: NO
  anti-sense: NO
ctttattctacagaagggacttccttttttgtatggattttttcatttacacaaaatattttatactctcttttatttgttgttccatggcattgtttagatttaaaagaaagtcctttagtgactatgctgcaagtgatccattgccaaggcggagcagcaattgtcaatctaatgattttggttgcttctttgtcctcagcaaatagtgcagtctacagtactagcaggattttatatcaaacagcaaaagaaaaaagtttgccccattggttttgtgcgctttctaagaaaggcgtaccttag

SEQ ID NO: 321 - DNA (genomic), 183 bp, Enterococcus faecium; double-stranded, circular
  misc_feature (B) LOCATION 1...183
  hypothetical: NO
  anti-sense: NO
gttcatgagtttggtgatccctggctcccgaaacgatcaataatcctctttcgcgaatttgctatcggtatgggtccgaaaatttatgggcatcaagcaaaagacgggacaacatatacgcttcgcctattacctattggcggttatgttcgaatggcacgcaatggggatgatgaaacataa

SEQ ID NO: 322 - DNA (genomic), 246 bp, Enterococcus faecium; double-stranded, circular
  misc_feature (B) LOCATION 1...246
  hypothetical: NO
  anti-sense: NO
ccgtggactactatcttcgttataaccttagctatcgtgaagttcaagaaatcttatatgatcgtggcattaacgtttctcatgcgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaa

SEQ ID NO: 323 - DNA (genomic), 477 bp, Enterococcus faecium; double-stranded, circular
  misc_feature (B) LOCATION 1...477
  hypothetical: NO
  anti-sense: NO
gaaaggactacgaaaaggagacgattttacatgagctggacagacgagaacgaacctataaccaacagcgaaccaacgagctacgaagagctcgagctagcattcgcgaaactgcagaagaagtacgaagagaacaacgaactcttacgcctgaacaaccggaaattagaccggctcgaagaaaccatgaacaacacgttgaaagaggaacagaccaccaacaagaattatcgctctaaaacgttaaaagacatagaaaacgaaataaagaaacaacgtgcttttctcgttccttatacgcaagaaaggatacaaactacgattgatttacaagttaaaaaactccatcaagagctattagaccagcgaaataaggaacagaaaaaggtgcttattcaacgatcattggattttcttgcccccttatgttgcttagtcctgacactgttcgcattttggttagtatggggaggctaa

SEQ ID NO: 324 - DNA (genomic), 411 bp, Enterococcus faecium; double-stranded, circular
  misc_feature (B) LOCATION 1...411
  hypothetical: NO
  anti-sense: NO
ccccccgctaccttcaattttgcagataaaacgctttgggagaaaatttcaaagacaacaggccatcctatcatgcccgattataaacaaaaagctggctattccttttgctctgacaaatttcaattgggaaagttcacgaaactagcaggtgaagaagtttcaactgttcggatcaaagaatgcccgcttcaaatagaaacattggttcaacgaatttcaactagacaagactttgctattgtagaacgtgagatcgtagctatttttgtagaagaagggattttacatgatccaactcatatcaatgtggataaatggcaacctcttatctataaattcagagaatatacaactgccaaccagtcgttaactttgaattttagattccaagaattcaaagagtcataa

SEQ ID NO: 325 - DNA (genomic), 516 bp, Enterococcus faecium; double-stranded, circular
  misc_feature (B) LOCATION 1...516
  hypothetical: NO
  anti-sense: NO
tgcaaagctaccagaaaatgctgcgagggaaagaaaaacaatcctaaagcaatgaaagattatcgtaaattaaaaaaatactggcgaacgatcttgaagaaagaaacaaaaatcaactatacttctcttcgacaatttccgcttttccaacggaaatacgtgaccgaatcagacgtcctagactatctgctctcaatcgataagcacttacgtgaaagttatgaagtctatcaggaattgttggctgctttggaaacaaaagattttactgccttcttcgagttgatcgacacattaccagtatcattggataaaggatttaaaaaagcgattctttcgttaaacaaatataaaaaaggcatcatcaatgctttgaaatatccctattctaatggcaaattggaagggaaaaacaatttaatcaaggtcattaaacgcatcgcgtttggctttcggacgtttcgacatctgcgtatgcgagtcttgatccaacaaaatctctgtgagattatttaa

SEQ ID NO: 326 - DNA (genomic), 330 bp, Enterococcus faecium; double-stranded, circular
  misc_feature (B) LOCATION 1...330
  hypothetical: NO
  anti-sense: NO
ggcagagctactcgcacatattcgttcgcatgggacttttgcatcgatactcttgatcgtattgacagcggtgatgtgtgctgttccaggtattcctacttcagtagttggagtcattgcggtttgagctttggaccactgacaggtgcgatcatcaacattttgggtaatgctcttggtaacatcactgcaattttccttatgcatcgcttaaaattttttggtaacgcaggcccaaacgattcattgggtgcaagcattccgacaaatgaaacatccaaanataggtgtaatgttaggntatatgataccgtttatccattcttttag

SEQ ID NO: 327 - DNA (genomic), 1641 bp, Enterococcus faecium; double-stranded, circular
  misc_feature (B) LOCATION 1...1641
  hypothetical: NO
  anti-sense: NO
atactggctacgattttaacacgtatgatcgatgtacgaatccgcaatgatgattttgattatgtgaagcaacaagggatatttatgatcgttattactgtaatcggtattattttgaatatcttgttaggttattttggttcgaggattacgactaatatcgtagcagatattcgagatgatttgttcgaaaagatccaaagttattcgcatcaggaatacgaaaatctaggcgtatcttcattgatcactcgtacaacaaacgatgcttatcagatcatgttgttcctgcaaaatattttacgtatcggttttatggcaccaatgatgttcattgtcagtttgtacatggtcatgcgtacaagtgtgacactcagtttgtatgtagtaggtgcattacctttactattattggcagtcgtagcgattgctaaggtgtctgaaccgttatctaaaaagcaacaaaaaaacttagataaaatcaacagtatcttgcgggaaaatctttcaggattgcgtgtgattcgtgcattcgtcaatgaaaagtttgaagaaaaacgttttgctgtagtcaatgagaattatgcttctagttcaaaaagcttattccgtttgatggctgttgcacaaccgggtttttatttcttatttaatatcgtaatggtattgatcatctggagcggggcagtgcaaatcgatgcaggcgagcttcgtgtaggagatttgattgcgtttatcgagtatatattccatgccttgttctcattcatgttatttgctagtgtgttcatgatgtatccaagagcagctgtttcagctggacgtatccaagaagccctagatgccaaaccttcgattgtagaagatccaaatggtatatctgatacaaaaactaaagggtatatcgaatttcaaaatgtaacatttgcttatccaggccattcgcaagagccagtgatacgaaatgtcagttttacagcctctccaggagagaccgttgcttttattggaagtaccggtagcggaaaatctacgttgatccaattgatccctcgcttttatgatgtgagtgaaggaaagatcttgatcgatggagtagacgtgagagattatcggctaagcaagttgcgagataagattgggtttattccgcaaaaagcgctgctatttactggaacgattgcagataatttgcgatacgggaaagaagatgctacgcaagaagaaatggaacgtgcagctgagattgctcaagcttcagaattcatttctcgaaaaccagatggatttaatgaacatttatcagaaggtggttccaatttttcaggtggacaaaaacaacgattggcaatagccagagccatcatacgccgtccggaaatctatatttttgatgacagcttttctgcattagattatcaaacggatgcgaagttacgtgctcgtctgaaaaaagaaacgacagaatctactgtattgatcgtagcacaacgtgtgggaacgatcatgcatgcagataagatcatcgtattaaatgaaggagaagtcgtcggtatggggacgcatcgggagttgttggaaaaatgcccgatttattatgatattgccgcttctcaattatcaaaggaggaattagcatga

SEQ ID NO: 328 - DNA (genomic), 246 bp, Enterococcus faecium; double-stranded, circular
  misc_feature (B) LOCATION 1...246
  hypothetical: NO
  anti-sense: NO
ccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaa

SEQ ID NO: 329 - DNA (genomic), 246 bp, Enterococcus faecium; double-stranded, circular
  misc_feature (B) LOCATION 1...246
  hypothetical: NO
  anti-sense: NO
ccgtgggctactatcttcgttataaccttagctatcgtgaagttcgagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcaatgcagatggtttaa

SEQ ID NO: 330 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 331 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 332 - DNA (genomic), 246 bp, Enterococcus faecium; double-stranded, circular
  misc_feature (B) LOCATION 1...246
  hypothetical: NO
  anti-sense: NO
ccgtgggctactatcttcgttataaccttagctatcgtgaagttcaagaaatcttatatgatcgtggcattaacgtttctcatgcgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaa

SEQ ID NO: 333 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 334 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 335 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 336 - DNA (genomic), 246 bp, Enterococcus faecium; double-stranded, circular; identical to SEQ ID NO: 328
  misc_feature (B) LOCATION 1...246
  hypothetical: NO
  anti-sense: NO

SEQ ID NO: 337 - DNA (genomic), 201 bp, Enterococcus faecium; double-stranded, circular
  misc_feature (B) LOCATION 1...201
  hypothetical: NO
  anti-sense: NO
tttatttatacaaagtcacacttttttaaacatctgttcttcgatacatttctatttcttttaaacatcgataccaatattttgaacttaagagtgcataccaaatggattcatttactcttcgtcagttacgaagataatcaaaatctccaacttccctacttatttcgttttgagaattatcgaagcaatcttacataa

SEQ ID NO: 338 - DNA (genomic), 954 bp, Enterococcus faecium; double-stranded, circular
  misc_feature (B) LOCATION 1...954
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaaaattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 339 - DNA (genomic), 954 bp, Enterococcus faecium; double-stranded, circular
  misc_feature (B) LOCATION 1...954
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaaaattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctttaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 340 - DNA (genomic), 954 bp, Enterococcus faecium; double-stranded, circular
  misc_feature (B) LOCATION 1...954
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 341 - DNA (genomic), 768 bp, Enterococcus faecium; double-stranded, circular
  misc_feature (B) LOCATION 1...768
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgcctaaggtacgcctttcttag

SEQ ID NO: 342 - DNA (genomic), 954 bp, Enterococcus faecium; double-stranded, circular
  misc_feature (B) LOCATION 1...954
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 343 - DNA (genomic), 954 bp, Enterococcus faecium; double-stranded, circular; identical to SEQ ID NO: 340
  misc_feature (B) LOCATION 1...954
  hypothetical: NO
  anti-sense: NO

SEQ ID NO: 344 - DNA (genomic), 954 bp, Enterococcus faecium; double-stranded, circular; identical to SEQ ID NO: 340
  misc_feature (B) LOCATION 1...954
  hypothetical: NO
  anti-sense: NO

SEQ ID NO: 345 - DNA (genomic), 954 bp, Enterococcus faecium; double-stranded, circular
  misc_feature (B) LOCATION 1...954
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaaaattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 346 - DNA (genomic), 402 bp, Enterococcus faecium; double-stranded, circular
  misc_feature (B) LOCATION 1...402
  hypothetical: NO
  anti-sense: NO
atgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaaaacgggagaattcaatgttttacatttaccgatgcaagggaaacgaaaaccaaatggttattag

SEQ ID NO: 347 - DNA (genomic), 1254 bp, Enterococcus faecium; double-stranded, circular
  misc_feature (B) LOCATION 1...1254
  hypothetical: NO
  anti-sense: NO
gaaaattataccaaatttcaaagaagaaagaggatgggaatgaaaggcaaactaaaacgagaaatcaatctgtttggcgcattagctaccgttatgggaaccgtgatcggtgcaggcgtcttcttcaaaactgctgctgttactgctagtactcagtctacaagtttgacattgctagcttggcttttgggtggtttcttaacgatctgtgctggattgacagtggctgaattagctacagcaatcccggaaactggtggagctgtaaaatatattgaagctgcgtatggaaaattgcccagctttttattaggatgggcgcaaagcttgatttactttcctgctaatattgctgcattatcgattatctttgcgacacaattgacgaacttattacaattatctaccgattatcttttgttgattgcagtgatcaccgctgtttctgtgacagggttgaatttgttagggacaaaagtcggtgcttctgtacaatcagtgacgttgattgttaaattaataccaattgctgtgattgtcatatggggattattgaccccaggacaaggaactgtccagttatttccaatcgaagctggaaaagatgttacttttgtcgaaggattgagcagtgcgttgttagcaacgttgtttgcttatgacggctggttaggtgtcggtgcaatggcacgggaaatgaaacggccggaaaaagatttgcctaaagcaattattcttggtttgagttttgtaacagtcgtttatctattgatcaattttgtttttttgaaaactttgccgattgatcatcttgccggtaatttgaatgcagcttctgaagcatcagacgtcatttttggaggaatcggtggaaagctggtcactattgggatcttgatctcggtatacggtgcattgaacggttatacactaactgggatccgcgtgccttatgcgatggctttagaagacgatctacctttcagtaaacagctgacaaatctttcaaagaagtttacggttccttatgtccctgcggttttccagttagcagtagcttgtattatgatgagccttggttctttcgactttttaacacacatgttgatttttgtgatgtggctattcactttactgatttgtatcggtgtctctattttaacaaaaaaagcgccggaattgccacgtccatatcaagtaccactttatccaatcgctccgattattgcgattctcggtgctattttcatttga

SEQ ID NO: 348 - DNA (genomic), 777 bp, Enterococcus faecium; double-stranded, circular
  misc_feature (B) LOCATION 1...777
  hypothetical: NO
  anti-sense: NO
ggaaattataccaaagaaaggaatgaaaaaatgaacacaccacaaattttcaatttcgaacaaaacgaagttcggacgtttctagaaaatgacattccgtatttcgtagcaaatgatgtcgctaaaacattaggatacaaaaacccgagcgatgctactaataaacattgtaaaaaagccgtaaaaacatggggtagcgattcgctaggtcgtcgccaatctttcaaagttattccagaatcagatgtttaccgcttgattatcaaatcgaacttaccaagcgctgaaaaatttgaggcttgggtaatggaagaagtccttccaacaatcagaaaaacaggtagctattcaaatgtacctcaaagttttgcacaagcattgcgtttagcagcagatttagaagaaaagaaccaattactcgaacaacaaattgccgagtacgaaccaaagattagctacttagatacgattctttcatcgacagatacggtagcgacttctcaaattgcagctgattacggaatgtcggcaattgctctaaacaaattgcttaacgagttaggtgttcaacataaagttagcggacaatggatactttaccgaaaacatatgaaccaaggatacacaaaatcgcacacaagtgagataccgaaagccgatggcggcactaaagttgtaatgaataccaaatggacacagaaagggcgagtgtttatttacaacttattaatcgcagagggctattaccctcaaatggatttagaggaaattggttag

SEQ ID NO: 349 - DNA (genomic), 201 bp, Enterococcus faecium; double-stranded, circular
  misc_feature (B) LOCATION 1...201
  hypothetical: NO
  anti-sense: NO
aataaatatacgaaggtgaaaactatgttaaccaatgaacaacgcgctcatgatttagcaattgcaacattaccttttgtcagagatattgttaaatctcaaataattgaagggaaagatgcaaaatttgatgcatattttgaatatataaagctttataatcaatttctttccgctgtttctgaagattttaaaaactag

SEQ ID NO: 350 - DNA (genomic), 1071 bp, Enterococcus faecium; double-stranded, circular
  misc_feature (B) LOCATION 1...1071
  hypothetical: NO
  anti-sense: NO
gaaatgtatactataatggaaattatcaattatttatttggaggaatatccatgaaacaaaaaatcgcagttcttggtcctggatcttggggcactgctttagcacaaacattggcagaaaacgggcatgatgtccgtatttggggaaatgtacctgaacagattgatgaaatcaataagtatcatacaaatcagcattttttacctgatttgacgatcccagaatcgattatcggatataaagaattggcagaagcagtggataacgcagatgctattttatttgttgttccaacaaaagcgattcgttcagtcgcacaggaacttattggtaaaatgaatactaagccaatcattatacatgcaagtaaaggactagaacaagatacgcataaacgaatctcagaagttttggctgaagaaattccagaagaaaaaagacaggcaattgttgtattatctggtcctagccatgctgaggaagtggcagtacatgatatcacaacaattacagctgcaagtattgatcaaaaagcagcagcctatgtacaaaaactgttcatgaatgattatttcaggatttatacaaataatgatgtgattggcgtagaaactggtgcagcactgaaaaatatcattgcaattggtgccggcgctatccatggattaggattcggagatgatgcaaaagcagcaatcatgactcgaggattggcagaaatcagccgtcttggtgtcgcgatgggtgccaatcctctgacatttatcggtttgagtggtgtgggggacttgatcgttacttgtacaagtgttcattctcgcaattggcgtgccggtaacttgttaggacagggacataagctggaagaagttctagaaaacatgggaatggtcgttgagggtgtggcaacgacaaaagcagcagtagagctagctcaacagctaggtgttgagatgccaattactcaaacaatctataatgttttgtataatggagaagatatcaaaaaagcagcaaaagaaatcatgttacgtgacggaaaaatggagaatgaattttctcttcgttaa

SEQ ID NO: 351 - DNA (genomic), 873 bp, Enterococcus faecium; double-stranded, circular
  misc_feature (B) LOCATION 1...873
  hypothetical: NO
  anti-sense: NO
aagatgtatacaacattgaaagaagtaacaaaaacagcagaagagttgaattttacagttggagcttttaatacgcataacctagaaatgcttcctgctatgctaggcgcagcaaaagaaatgggttcgccgatcattattcaaacaagtgtcgataccgctaaatatatcggcatgcatgtgttagtcaatgtaatgacagctattgcagaagaagaaatggttgatgcagtcttgcacttagaccacgcccgagactttgatgatatcaaagaagcaatcgacagcggatatacttctgtcatgtatgatgggtcccatctgcctttcaaagaaaatatcctgaagacaaaagcagtagtagaatatgcccatgcgcacggtgtttccgtagaaggagaacttggaacaatcggcggtacagaagaaggaatccatgtcgctgaaaatgacaaggtatatacaagaccggaagacgcagtgaaatttgtagaagctacaggcgtggatgcattagctattgctatcggtacgaatcatggacaattcaaatcaaaaacagaagtaaacattcccttgctgaaagaaatcgatgcagtagttgatgtccccctagttatccatggaggaacaggtgtgaaagaagaagattatcctgaattgatcaataacgggatccgcaaattcaatgttggaacggagcttttagtcaactggacgaaagtagctaaagaaacctttagtgaaacagaaatcaacaagtctcttcgccataatgtgattccagcaaatgaagcagtaaaagaaattgtcaagcataagattggactgtttatgaacttggaaagtccaattaacttaggaaataaatga

SEQ ID NO: 352 - DNA (genomic), 1263 bp, Enterococcus faecium; double-stranded, circular
  misc_feature (B) LOCATION 1...1263
  hypothetical: NO
  anti-sense: NO
ccacttcatactatatttttgataagcgcttacaaaaatgaaaggaacatgcttatgaataaaaagatgatgaaattttctctgctgtcagtctctcttattttgacttctgctggtgcagtcacgtctgcaattcccagtatgtcagctacttatgccacgcgttctttatctgctgttgaattattaacgactgctccctcttttatggtcactatttttgttttgattagtagttttattgctaggaaaatcggacaaaaacaaactgtgatcatcggattagtgattgcatcgatttgtggtatcctccccctcttctcacaaagttacagtattgtcttagcttcaagagctggactaggtattggctttggattgatcaattctttggcagtcagcatgattgctgccttttatcacggagatgaacgagcctctatgattggttttcaaagtgcatttcaaggatttggtgcagctttaatgacatttgttgcaggacagctagtacagttcggttggcaatatacctttttagtctacgccatcagcttacctattcttgtcttgtttgttttgtttgttcctacacctgaaacaactgaacttcaatcgcatggcacagccccaacaagacaagtaatcaaaacgaatcctaaaatgattagttatggtatttttctcttgctggtcatcgtggtatataatgctgtatcgattaaattagccacagtcctgacgacttattctctaggaaacgaaactaatgcagcgaatatcttaacaatcatgcaattggcaagtatggctgccggagtttgttttggctggcttcagacaaaagcacatcgctatatgcttacactttctttactactgatgggaatcggctttgtattgattgccactgtgataaacctgtatgtgattgggtttggtgcgatcctaacaggaatttctttttcgttattcattccttacttattcaaccaagtaagtatccaagcgcccaagtacgcggagagtttcaatacttcaatcttattggttggcgctaatttaggtactttcattgcaccatatggtttgctctttctctcttttgcttctcttgggagtaaaacacttgctgttttcgtcaatggcagtatcttgctgttgattagcgcgcttattagccttctagtagtacacaggacgaatagaaagacagtgataagagtagatgaagaaataaaagaacaattgacaacaaaataa

SEQ ID NO: 353 - DNA (genomic), 564 bp, Enterococcus faecium; double-stranded, circular
  misc_feature (B) LOCATION 1...564
  hypothetical: NO
  anti-sense: NO
gaggtggagtttttgaaagaaatcattcataacagttggcaagaagttttgtcctcagaattttcaaaagattattatctgcatctaagagaatttttaaaaaaagaatatgcgtcccaaaagatccatccagatatgtatcatatctatgaagcattggaattgactccttatgaagaagttaaagtggtgattttaggacaagatccttatcatggagaaaatcaagctcatggcttatctttttctgtgcaacctggcgtaaagatcccgccatcgttaagaaatatctataaagagctttatgatgatcttggaatcgcacctgttcaacatggaaatctagtgtcatgggctaaacagggagtccttttactcaacaccgttcttaccgttcgggaagggcaagcgtattctcatcgcgggaaaggttgggaaagattaacagacacgatcattgaaaaattaaatgaacgggaaaaaccaatcgtgtttatcttgtggggaaaaccggcacaagaaaaaatcaaaatgatcgataagagtcgccatatcatcataaca

SEQ ID NO: 354 - DNA (genomic), 915 bp, Enterococcus faecium; double-stranded, circular
  misc_feature (B) LOCATION 1...915
  hypothetical: NO
  anti-sense: NO
cctcctaatacaatggagtatctggttgagtttcttttacaagaaagcagccaaggaaatcaatcacgaaggtggccggaaatgatcagaatcggattaacatcgtttaaagaacatgacaaattaactggtaaaaagaataacactctttatgaatatgcagggtttctacccttagtggaattagatactgcctattatggaattccccgaaagtcctcagttgagaattggataagtgaagtacctgaatcatttcgctttgtagtcaaagtctatcaaggaatcagcggtcaaggagactggaagccttattatcagaccgaagaagagatgattgcgcattttttagatgttatgtcgccaatggtagatgctggaaagatgttttgctttttagtccaattcccctcatcattcaaatgtacgaaagaaaatgtccagtacttgcgcaaacttagaaagtggtttgagggttatcctgtttctatagaattgcgggattattcttggtacagcgatgaatttcttgaacgtacaagaaactttatgtctagagccgctttttctttagccatcatcgatgagccacagttgctgaatacaacgattccttttgatccatttgtcaccaatccgaactttgctctttttcgattccatggtaggaatgcgcaaggatggcaagcaaatgataaagagtggcgtaaaaaaagaacgttatatcgttattcagaaaaagaactgcaagaactagcacatgaagtcaaagtagttgattctaagacaaaagaagtaggtgtgatttttaataataattctggtggtgatgcggctgaaaatgcattagcactgcaaaaaatattaaatatcaagccagatggactcaatccaacccaaatggatctgttttaa

SEQ ID NO: 355 - DNA (genomic), 711 bp, Enterococcus faecium; double-stranded, circular
  misc_feature (B) LOCATION 1...711
  hypothetical: NO
  anti-sense: NO
ggaggcaatacaatgatttacacagtaacacttaatccatcaattgattatatcgtacgcgtagatgggttaaaactaggcgatttgaaccgaatgaaggaagacttcaagttacctggaggaaaagggatcaatgtttcccgtattttgaaacggatcgattctcaatctacagcactagggtttttaggagggttcactggcgaatttatttcgaagtggcttgaaaaagaacaaatccagtctttgttcacaaccgtaaaagaagatacaagaatcaatatcaaactaaaatcagacactgaaactgagatcaatggcttaggcccatctatttcagatgaagaaatcgatgagttgaagcaagcattaggaacagtaggacaaggagatatcgtcgtattgtcaggaagcgcgccagctagcctgcgaaaaggattttatcaagaactgattgatatcattcgagaaaaaggtgcagatttcgtgattgatacaacaggtgatgacctaaaaaatgcacttgttaagaaaccgttgttgatcaaaccaaacaatcacgaattagctgagctttacaacacaaccttccaatctgtagaagaaatcattccgtatgggaaaaaattactagctgaaggggcacagaatgtgctgatctcaatggctggagacggtgctttgctcttcacgggaacaaggaacttataa

SEQ ID NO: 356 - DNA (genomic), 1455 bp, Enterococcus faecium; double-stranded, circular
  misc_feature (B) LOCATION 1...1455
  hypothetical: NO
  anti-sense: NO
cttctaaatacgaatagagaaatttacttggaagtgagagtcatgcgaacccgccgtttaggccaaacgcttttttcacaaccttttttaggagagatctcaatgaatctaacaatacaagaaattgcacaagccgtgggcagcgaatgctctgcactgacaaagattaccaatgtcgaatttgacagccggaagataaccgaaggaagtttattcgttcctcttgctggtacgcgagatggacatgaatttatccagcaagcgatcacaaacggagcatctgcttcattttggagcttgcctgttgaacaagctccaaaaaattttccagttattcctgtagcagatcctttgaaagccatgcagcaattggcaacctattacttggaaaaagtaggcgcagaagtcgttgcaattacaggaagcaatggtaaaaccaccacgaaagatctaaccgcgtctgtcttgtctgaaaaatacaaaacatataagacgcaaggaaattacaacaataatattggtcttccttacacgattttgcacatgccccaagatacagaaaagatcgttttggaaatgggcatggatcacgccaatgaaatcacggaactttcacttatggctcaaccaaaagctgcagcaatcacaatgatcggtgaagcacacatagaaaatcttgggtcgcgagaaggaatcgcgaaagccaaattggaaatcactgacggacttgtatcagaacgattactcgttgtgcccgcagatgaaccgttgctgacacctttaacggcaacattagtacaaacagtcacaacattcggtattggaaatggcgatgttcatgcggaagtgacagcaaaaggaaaagcacaaaccgattttgtagtagaaggagaaacatttacgatcccgctgcctggaagttataatgtaacgaatgctttgattgcgtatacgatcgggcgcttctttggactgtccatacctgagatacgccaagggctcgcccatgtttctatcactcaaaacagaaccgaatggctaacggcaggaaatggtgcagctattttgagcgatgtctacaatgcaaatccaacagccatgggactggtattagatacttttaaaaatctgccaacaaaaggacgcagaatcgctgtgttagcagatatgctggaattagggaaagagtctttaaatatgcatgcgcaaatgagtgaacatatcgatcctgagaaattcgccatgattttcctttatggggaacaaatgcatgcattaaaagaagaattgaaccaaaaatacccccaactacctgtgttctatttggaaaaagaaaagaataaattgattgatgctatcaaacaaaatcttgaagcaacagatagtattatgctaaaaggcagcaacagcatgggcttatttgaagtggtagaacaacttcagcaaatgaaataa

SEQ ID NO: 357 - DNA (genomic), 534 bp, Enterococcus faecium; double-stranded, circular
  misc_feature (B) LOCATION 1...534
  hypothetical: NO
  anti-sense: NO
agactaaatacttcggaggaacaaatgaataacaatgataggttattgcgattgcgttatgcgattgatttgaaagatacggatttgattaaagcttttgagctaggcggtgtaccactgactaaagaagaagctcaggcggtactgaccaaagtacaggataagaacaaagataatgcagaaaataatgtgtatgaaaaaaccatcaacaaccaagtttttgacgcattcctaaatggcctgattctcttggcgcgtggtccgcaaaaagataagccgatagtagacacgccgcaaaaaagcaaggaaatcaaatatatcaacaatgtgttgctaaaaaaattaaaaatcgccttgtctatgaccactgatgatattttagacgtttttgctgaggcagaaatctatccatcaaaaggcgaaatcggggcatttttgagaaaagaaggccaacgaaattttaagccttgcggagataaatatatgcgtaattttctcaaggggttaggaatttataatcggagaaaagtataa

SEQ ID NO: 358 - DNA (genomic), 516 bp, Enterococcus faecium; double-stranded, circular
  misc_feature (B) LOCATION 1...516
  hypothetical: NO
  anti-sense: NO
ttggtaaatacaaatcttgatgcagtagaaaaagaaaaatggatgcgccttgcattggcagaagcaaagaaagcagaaatgcttcatgaagttccgattggagcagtggttgtattggatggaaaagtgattggaagaggatataaccttagagaaaccacgcaagatgctactacacatgcagaaatgcttgcaatcaaggaagcctgtgaaaaagtgggaagctggcgcttggaagatgctgcactttttgttaccttagagccttgtcctatgtgcagcggcgcgatgattttgtctcgtgtagcagaagtttatttcggcgcgtatgatccaaaaggcggaacagccggtaccttgatgaatcttttggaggacgagcggtttaaccaccaagcatatgtagaaggtggcattttagaagacgaatgtgggatgattttgactgactttttccgaaagctccgccagcgaaaaaagaaattaaaaaaagactggtcaacgaatgaaaaataa

SEQ ID NO: 359 - DNA (genomic), 828 bp, Enterococcus faecium; double-stranded, circular
  misc_feature (B) LOCATION 1...828
  hypothetical: NO
  anti-sense: NO
atgaaaaatacagcagttacatttaaagaatctaaattaagaaatgaaaaattaacaatgcttacagcttatgactattcaacagcaaaaataattgatgaagctgggataaatggaatattagtaggagattctcttggtatggtatgtctaggacatgaagatacactttcagtaacaatggaagacatgattcatcatactagagcagttacaagaggagctaagaacactttagttgttgcagatatgccatttatgtcttatcaaacttcagtatatgattcagtagttaatgcaggaagattaataaaagaaggacgagctcaggttgttaaattagaaggagggatagaagtatgcgataaaatagaggctatagtaaaggcttctatacctgttatggcgcatataggtttaacacctcaatctgttaatgcatttggaggatttaaggtacaaggaaaggacaaggaagctgctaaagaattaataagagctgctaaagctgtagaaaaagcaggagcattcgctgtagtgttagaatgtgttccaactaagcttgcagagttaatttctaaagagatatcaatacctacaattggtattggagcaggtgcagggtgtgatggacaaattcttgtatatcaagatatgttggggatgtatagtgattttacccctaaatttgtgaagaaatatgctaatttatcagaagagatgaataaagcatttacaaaatatatagaggaagtaaaagatggagtttttccaggtccagaacatgggtttaaaataagtgatgatgttttagaaaaattatattaa

SEQ ID NO: 360 - DNA (genomic), 552 bp, Enterococcus faecium; double-stranded, circular
  misc_feature (B) LOCATION 1...552
  hypothetical: NO
  anti-sense: NO
ataagaaatactattaaatcaagaaaaaagaaagaaggcacaagtatgtcaaacacagccgacgcaatagtagtgatcgatttacaaaaaggggtatgttttgattcttcgccgatacacgaattagaaacagtgacagcattagtgaataaaagaatcaaaacatacgaaacgattgggaaaccagttattttcgttcaacacgaagatgctcaattagtgccacaaacaaaaccatgggagctattgtcggaattatctattcctgagcacagttattttgtgagaaaaacccatgcgaattcattttataagactaatttgagtgttttattaactgaattggactgtcattcgatcgaattatgtggggcacaagcagagtattgtatagatacgactgtgaagtttgctcatggattaggataccagcttatgatgtgtagaggagcaacgacaacttatgataatccttttatgaaagcaaaggaaacaatcgctttttacgagaaaatttgggataaacgatttctgacatttttggagcaataa

SEQ ID NO: 361 - DNA (genomic), 579 bp, Enterococcus faecium; double-stranded, circular
  misc_feature (B) LOCATION 1...579
  hypothetical: NO
  anti-sense: NO
atgagtgatacaacacgtacgaaacaattgatcaaaaacgtattgattgatttgtgccaaacgcaatcttttcgaaaaatcagcgtccaaaaaatcgcaaacgaagcaaaaatcaatcgacaaacattttattatcattttacagataaatacgatttgcttcgttgggtctattgtgaggatgcattgcattatttagatccacaatgtctttcacttgataattgggaagagcaagcattgaaaatgctgaaagcaattgctgagaagaaagaattttatgcaaatactgtgctttctgacccagaaattttacaaaaagagttttctcaactgatccaaaaatcatttatcaagatttttgaacaaatggatgaagaaagacaactttctgcaagagacaaactattttatgctcgttttttttcttacggttgcagtggtgtattagtcaattggatcacgaatgaatatgaagaaacaccgatggaaatcgctatgcagcttttccgtttagccaaggatacggaattatattcttatcgtctttatgcaaaagaagagttggaagaacagtaa

SEQ ID NO: 362 - DNA (genomic), 282 bp, Enterococcus faecium; double-stranded, circular
  misc_feature (B) LOCATION 1...282
  hypothetical: NO
  anti-sense: NO
tggttcgataccgtcaatgtagctggaaaaacgttccgctatacagaaaacgggccagaaggattagtgacaggtaaaaaagcactgcacatccaatctaatggcggtgtatacaacggacaagactttgcctctcaatatgtaaaaggtattttaaactttgtaggcatcgatcaagtagatcagctattcatcgaaggaatcgattatgaccctgaccgtgcagatgagttgatgcaaaatgcattagataaagctgctgctttaggtaaatcattttaa

SEQ ID NO: 363 - DNA (genomic), 366 bp, Enterococcus faecium; double-stranded, circular
  misc_feature (B) LOCATION 1...366
  hypothetical: NO
  anti-sense: NO
aaatcagatacagtgatcgttccgcctttcatcgttgcgatatctttattagtatcgcctgaacaagctgctagagttaaaacagccaacgcactagtagctgccaaaataattgatttttttttcattaaaatttgcactcctgtaattagttattatttttatatattaactataccatatcccatttcctttaaaaacgttgtcgtggtagtttcaaacaaaattcaaaatttcatcacattcctaggaaatacgcaaacttttctcacttatatagttaaatctgttgagaaaataatcattattatatttgttcaggatactctggcagatcagcttttagtttttctacttgttcattga

SEQ ID NO: 364 - DNA (genomic), 237 bp, Enterococcus faecium; double-stranded, circular
  misc_feature (B) LOCATION 1...237
  hypothetical: NO
  anti-sense: NO
tattcctgtacccgttgtttttgtttgagcaatggagggacgcaggaggctaaggaatgcagacgatcggaaatgtctgtccaagcagtaagtctgaagaggagtcaaatgcttcttttcttaaggacaagctgtgatggggagggaaataatagtaccgaagttcctgatgtcacactgccgagaaaagcttctagtgagaaaacagcggcccgtaccgcaaaccgacacaggtag

SEQ ID NO: 365 - DNA (genomic), 1362 bp, Enterococcus faecium; double-stranded, circular
  misc_feature (B) LOCATION 1...1362
  hypothetical: NO
  anti-sense: NO
aatcgctgtacgtatcattcgtgcatagccgcgaactatgggatccaaaccgtagcgatatattcagaagcagatgccgaagcacttcatacacagttagcagatgaagcaatctgcattggcccggcaaaagccgttgattcatatctgaatgttcaggaagtactgagcgctgcaatcgtgacaaaagccgaagcaattcatccaggatttggttttttatctgaaaatagccgatttgcctccatgtgtgaagagtgcaatatcacatttattggtcctaaaagtgcaacgatcgatgcaatgggaaataagatcaatgcgcgtcaattgatgcaagaagcaaatgtcccagtcattccaggaagtactggtgtattatctacagtagaagaagcattggaaatagcagacagaattggttatccagtgatgctgaaagcagctgcaggtggtggcgggaaaggcattcggaaagttcaatcaaaagaagagctcccacagcatttttcttcagctcagcaagaagcagcagcggcatttggaaatgatgatatgtatttggaaaaaatcatttatcctgctcgccatatagaagttcagatcttaggtgatcgatttggtcatgtcattcatttaggcgaacgagattgttctttacaacgcaacaatcaaaaagtactggaagaatctccttctgtagtgatctcacaaacaaaaagagaagcactaggagacgctgctgttcgagcagctaaagcagtcaattatgaaaatgccggaacgatcgagtttctgatggatgaagaaggcgatttttatttcatggaaatgaatactcgaatccaagtggaacatccagtaacagaaatggtcacaggaatcgatttagtaaaaaaacaggtggagatagcagccggtgagcctttgaatgtgtgtcaagaagatatagtattccaaggacacgcaatcgaatgccggattaatgcagaaaatcctgctttccattttgctccttctccagggaagatccaaaacttactgcttccagcaggtgggatgggactgcgagtanacagtgcagtttacccgggatatacgatcccgccatattatgattcaatgattgcaaaaataatcgtccatggaaatacgcgttttgaagcattaatgaagatgcagcgagccttaagtgaatttatcacagaaggaatcatcacgaacgcagaatttcagatggatttgattagtcatcctgcagtcatagcaggtgattacagcacagcatttttacaagaaagaatttttaccgaattggacaccagaaacggagataggaggcgcatagatggctctgtttaa

SEQ ID NO: 366 - DNA (genomic), 978 bp, Enterococcus faecium; double-stranded, circular
  misc_feature (B) LOCATION 1...978
  hypothetical: NO
  anti-sense: NO
actatgtgtacgtctattacttatgtaacaagtgatcattattttggaaggaattttgattatgaaatatcttacaatgaagtagtcactgttactccaagaaattataagttgaattttcgaaaggtaaatgatttggatactcattatgcaatgattggtattgccgctggtatagctgactaccctctttattacgatgcgacaaatgaaaaaggattgagtatggctgggctaaatttttctgggtatgctgattataaagaaatacaagaagggaaagacaatgtatctccttttgaatttattccttggattttaggacaatgctcaacagtaggagaagctaaaaaattgttaaaaaatatcaatttagcaaatataaattatagtgatgaacttcctttatcccctttacattggctattagctgataaagaaaaatcaattgtcattgaaagtatgaaagatggacttcatatatatgataaccctgtgggcgttcttaccaataatccttcatttgactatcaattatttaatttaaacaattatcgtgtcttatcgagtgaaactcctaaaaataatttttcaaatcaaataagtttgaatgcctatagccgcggtatgggagggataggcttgcctggagatttatcctcagtatctcgttttgttaaagcgacttttacgaagctgaattctgtatctggagattcagagtcagaaagtattagtcaatttttccatatcttaggttcagtagaacaacaaaaaggtttgtgtgatgttggtgatggaaaatatgaatatacaatttattcttcttgttgcaatgttgacaaaggaatctattattatcgaacatatgaagacagtcaaattactgcaattgatatgaataaagaagacttagatagtcataagttaattagttatccaattatagaaaaacaacaaattaaatatataaattag

SEQ ID NO: 367 - DNA (genomic), 2874 bp, Enterococcus faecium; double-stranded, circular
  misc_feature (B) LOCATION 1...2874
  hypothetical: NO
  anti-sense: NO
agcctaagtacaatagtctatagaaaaggagcgataccattggcaaaacgcattgaccgaatttatatgtatgtcaaagaaaaaaccgctcatttaacaaaggcagaatatgatcaaggagtaacaacacaggaaattgctgaagtgttagggattcagcgaacaaatagcagtaaagatctgaatcagctagtgcgcgaaggaaaactgataaagacagacggacgaccagtacgttacatatatcaaacactcgttacgcacgtaaagccagttacaaaacatgtagtcagttacaaagaaacgccggtctctgaagaaaaaaatacactccaaatagatactaaggatatctttgcaaaaatcattggagctaacggcagcatgaaaaattcagtggaacaggcaaaagctgcgattttgtatccgccaagaggattaaattgtttgattacaggacctaccggatcaggaaagacttattttgcacacgcgatgtatcattttgcaaaagcgcatcatgtaatagatgaggaaacggaactgattgttttcaattgtgctgattatgccaataaccctgagcttttgatgagtcatttatttgggtacgcaaaaggtgcttttacaggcgcagatgaagaaaaaatggggattatcgatcaagcggatggcggtatgctgtttttggatgagattcaccggttgccgcctgaaggtcaagaaatgatcttttactttatggatcatggaacttacagtcgtcttggggaaacaacgaaatcccatgaagcaaatgtacggatcgtaggtgcgaccacagaagacccaggttcttctctattagaaacttttgttcggcgtatcccaatcaatatcaaacttccggcttttgaaaaacgtcctgcaaatgagaaagtcgatttagtaaaaatcatgattgcccacgaagcaaaccgcacgcagcgaaagatttctttgacagaagatgtagcaaaagcattgatcggcagtgtgacctatggaaatataggacaattgaagtcaaatatccagttagtatgtgcacgaggatttctaaatcatatgcaatcacccgaaatctcgatcacaatcgatgatttgacagaagggattcgtagcggattgattcaattagcaagcaaccgcagtgcaatggcagagctttctaaaatattggagccaaagataactgtagcaccaaatgatacgatcatgaaaatccaatcggactcctatgagttaccttataatctatatgatatcatcggagataaagcagctttactgaagtcggatggtttggatcaagaagcaatcaatcatttcatttctacagatatcaacatccatctgaagtctttctataaagaccatggtttttcttttaatgcagacagcaaattagcagaatttgtagatccgaaaatcatagaagtgaccaatcagatttatgtaatggtcaaaagatctttaccatatgagtttcagcaaaactttatttatgctatgagcttgcatatcagttcttttttgaaaaaaatcaacttaggagaagaacggcatacgaatgataacatccgtgagatggcttttgattttccagatgaatatgctgttgcgaaagaagtgcgtagttatatcgaaacgtattttcaagtggagattccagaaagtgaagactattacttgaccgttctactcgtctcgttacgggcaaatcaagcaagcggcagaatcggtgtagtcgttgcagctcacggaaacagcacagcaagcagtatggtccaagttgtccaacagttgttagatgcagagaacgtacgagcagtagacatgcctttggatatggatccgaaaacagcattggaccgaattgaacgcaatgtacaagaagtagatgaaggaagcggggtcatactcttagtagatatggggtcccttgcgtcgtttaattcgcaaattcaaagagacactggaattccagtacgtactgttgatatggtaacaacttctctagttttggaaactgtacgaaaggtctcagtattagggacagatctagatatgttgcatgaatcattgaaaaattttcgaggttacgcagaaatatcttctgtagaatctgttcaggaagcaaaacctattcataagaaaaaagctgttttggctatctgcgcatctggcgaaggtacagcacaaagaatcaaagaattgatcgaacgagcggtaaacaagcgtcaagaaacagaattagaagttctagctttgtcgattgtggaagtgaaagaagaactgccagttatccaaaaagaatatcagatcatagctactactgggattactgatttgaatatccaagccccatttattcctttagaacgttttattgatcaaaatatcgaagtcattttggatcagttgctgatggaatcagaattggaggaaactgaattcatctccctagatgaagagtcagctaaaaatacgtgtgttgagtttatctctgataacttcatctttattaatggtagtaagttaatcgatccaatgtggcaattttctacacaaatctctcagacgacgggaatcggcgatgaagaatatggattcaaaatcaacctagtgatgcacacagcaggaatgatcgaacgtattattcggaatgaaccattgactgtggaagaaaacgaattgacaaatacaacgaatgatcctctttatagccaattggcagcctcagttgttctgttggaagatcagataaaagtaaaagtgccgatagaagaaatgtattatctgctacgtctagtccataatcagttagataaaaaagaatacactgtgccatga

SEQ ID NO: 368 - DNA (genomic), 1401 bp, Enterococcus faecium; double-stranded, circular
  misc_feature (B) LOCATION 1...1401
  hypothetical: NO
  anti-sense: NO
gagggtttcactatgagtgaatcattgtcgaaagatctaaacctaaatgccctattcattggggacaaagctgagaacggccaaatctataaagctttgttgaatgaattggtggatgaacatttaggctggcgtcaaaactacatgcctcaagacatgcctattattacgccagaagaaaaaagcagtgctagttttgaacacactgtgaataaaacaaaggatgttctatcagaaatttcagcgcggatgcgtacccattccgttccttggcataatgccggacgttactggggtcatatgaactctgaaacattgatgccatctttactagcgtacaattttgctatgctatggaatggtaataacgttgcctatgaatcttctcctgcaacaagccaaatggaagaagaagtaggaatggaatttgcaaaattaatgagctataaagatggctggggccacatcgttgctgatggttctttagcaaacttagaaggactttggtatgcccgcaacatcaaatcattgccgcttgcaatgaaagaagtgacacctgaactagttgctggaaaaagcgattgggaattaatgaacttgtcaacagaagaaatcatgaatctgttagacagcgtcccagaaaaaatcgacgaaatcaaagctcactcagcacgtagcggaaaacatttagaaaaattaggaaaatggttggttccacaaactaaacactattcatggctaaaagctgccgacatcatcggtatcggtttagaccaagtgattccagtgccagttgaccacaactatcgcatggacatcaacgaacttgaaaaaatcgttcgtggtctagcagctgaaaaaacaccaatcctaggtgtagtcggtgttgtaggatcaacagaagaaggagcaatcgacggtatcgataaaatcgttgcattgcgtcgcgtattagaaaaagacggtatttacttctacttacacgtagatgctgcttatggcggatacggccgtgcgattttcttagacgaagacaacaacttcattccatttgaagatttaaaagatgttcattacaaatacaatgtctttacagaaaacaaagattatatcttagaagaagtacacagtgcatataaagcaatcgaagaagcagaatctgtaacgattgacccacataaaatgggctatgttccatattctgccggtggtatcgtcatcaaagatatccgcatgagagacgttatctcttactttgcgacatatgtatttgaaaaaggcgcagatatcccagcattacttggggcttatatgcttggaaggttcaaaagcaggggcaacagcagccagcgtttgggcagcacaccatgtcttacctttgaatgtcacaggatatggtaa

SEQ ID NO: 369 - DNA (genomic), 243 bp, Enterococcus faecium; double-stranded, circular
  misc_feature (B) LOCATION 1...243
  hypothetical: NO
  anti-sense: NO
caacaattcacttcccgagtacaaaaaaaaagactaacagagtataggaaatatccctacatcgatatctattttcatgatgaaaattccggatttggttatggacataatcacaatctgatagctagcgattctcgctatggcattatttgtaccccagatattttagtggatgaagagacagtcaccagcattggtcttgttattgaaagaacatccggaatgtgcgatgttagcacctaa

SEQ ID NO: 370 - DNA (genomic), 294 bp, Enterococcus faecium; double-stranded, circular
  misc_feature (B) LOCATION 1...294
  hypothetical: NO
  anti-sense: NO
atgaggttcactaacttattttcactagttagtgaatttttttgtttgtatatattgttatgtaaaaaaagttatcaatcttatgcatcaatgtttttagattattttttgttttttatctgtcaagataatgcaataaaaagccaacattgtgaatataaaaacaagaaaaaaagagttataattttgaaaacgtttactagaagaggtaggaggaattcaaatgctttcacaaaatgctgttacagcaaatacaataaaaaaagaaaaaaaggaatttgggatttccgataa

SEQ ID NO: 371 - DNA (genomic), 765 bp, Enterococcus faecium; double-stranded, circular
  misc_feature (B) LOCATION 1...765
  hypothetical: NO
  anti-sense: NO
gaatattggttattcaaagaggaatcatacattggttttatctctttaccgtttttttcgctggaccaaaaatgctataataagtcattgcttcaaaggaggaattgtatgaaatataaaacatcatttcaggtggctggtagcttctttcttgtcctgtttttcattttgggctggatcgtaaagttccatctgtcgtggctttctggtttcgatcagtggtttacaggcattgtcagagcttcttatcctgatctgaacagctaccaactctttatgactaaattcggtaatcctcttaccgtcatcattttatttgcttgtgcggctttatggatgtggtataagaaaaaaagggcagaaacattttggttcgtttctggatttattgtaattgctggaatcatcaacccggtgatcaaactatttttcatgcgagagcgtccttcattggcgcacttagtagttgaaacaagttacagtttccctagtggacatgcagcaggcagtatgattctttacggttctttactatttctgcttccagcttttgttcaaaaaagaaccttacgcacattgcttcaattgctgatgatgtttattatagtaagtgtcgggataagccgcatttatctgggcgttcattttcctactgatatcatcggcggctacttactcagtctttcttggctgtgcctgacttatccagtgtatagagaaaaaagaaaacaaatagataactcttacagaaagaaggacttttaa

SEQ ID NO: 372 - DNA (genomic), 424 bp, Enterococcus faecium; double-stranded, circular
  misc_feature (B) LOCATION 1...424
  hypothetical: NO
  anti-sense: NO
gatcctcacccttagcaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataa

SEQ ID NO: 373 - DNA (genomic), 204 bp, Enterococcus faecium; double-stranded, circular
  misc_feature (B) LOCATION 1...204
  hypothetical: NO
  anti-sense: NO
atccacctcactttctacagtgagtataccagagaaggaggtaacaacatgaaaattagcattgaagcaaagccacaagaaatagcagaattgctccaagctatcggaagtagcaaggagcacactaaacgcaaacatccagaatcgaaaatagaatatgatccgcagacgggtgaaggaaagcttattcctcaaaataaataa

SEQ ID NO: 374 - DNA (genomic), 1416 bp, Enterococcus faecium; double-stranded, circular
  misc_feature (B) LOCATION 1...1416
  hypothetical: NO
  anti-sense: NO
aaaagttggttcatagttttatttactatatttagaaagaaagaaggtttatttatggaagttttccaaaccattatcaattatgttttgaacttaggatcagccatttttgttcccctgattattttgatacttggattgttggcagggatgaaattaaaaaaagcattcatgtctgctttgactttagggattgcttttagcggaatgtctatggtcattggctatatgtctaacgcagtaagtccagcatcagaagcattggctaaaaatacgggaatcagtttgcctgcacttgatcttgggtggacaggtgcagcaagcatcacatggtcgtggagttatgcttttatattttttgcagtaacgattggggtcaattttgtactgttactttttaattggacgaagacgttaaatgttgatatgtggaatgtttgggggaaagctttaactgcttatttagtttattatgtttccggtagtttggctgcaggctttcttactgcaatggtccaagttatattggaattaaagcttggtgatatgtttcaaaaacatatacaagatctcacagggattccattagtaacagtgactcattttatgacatctgccgctgtcttgttgctgcctttcaatatgatcatggataaaattcctgctttaaataaacgagcggatacgaatgcattgaagaagaaaattgggatcttctctgaaaactctgtaatgggattcattattggattggggcttggctttgctgctgcgtatggcgtttcaggttctcttaatctagcgatccaaacagctacagcattaagtttgtttcctatgatctctaaaatgttcatgcaatctttgtctcctctagcagacgctatgtcagaatttatgaaaaagcggtttaaggatcgtgaagtatatatcggattggactggccgatattagctggtcgttcagaaatttgggttactgctattttacttgttcctgtgtttattggttatgccattattttgccaggaaaccaagtattgccattagcagggattatcaactattcgattgcggtcggcggattacttttaacaggaggaaacttggctcgtatgctgatcttgggaatcatcactatgcctatttatttgtacggggccacttaccttgcgccaatactcagtgatttagcagaaaaaagcggagcagtcgagggaatcaagaaaggacagttgatcacatggtcatccatagaagggccggagttcagggttttatttgcggaggcatttaataggaatattctcgctattgtaggatgcgtgatttttctaggactgtttgttctactttataaatatatgataaaagcgaaagtaccgagtgaacgttatgctgaactacaaaaatag

SEQ ID NO: 375 - DNA (genomic), 435 bp, Enterococcus faecium; double-stranded, circular
  misc_feature (B) LOCATION 1...435
  hypothetical: NO
  anti-sense: NO
aactttatcacatcaaaaaaaattgatatgtcatgtaaaggaggaactttaatggaagtaataaattcaatatggctattttttcaagaccaaatattaggtatgaaatggttgaatggcttaattggtaatgggctatcattgctagggctagacattaacagtcgtttaggtggaagtattcaattctttttatacgatgtaatcaaaatcacaatcttgttatgtttactgattttctttatatcgtatattcaaagttattttccacccgaacgaagtaaaaaaattttagggcgatttcatggtatcggtgcaaatatcatatccgcattgttaggaacagttacaccattttgctcgtgttcttctatcctgttgtttataggttttacaagtgcaggattaccgttaggagttctttttcctttttga

SEQ ID NO: 376 - DNA (genomic), 1266 bp, Enterococcus faecium; double-stranded, circular
  misc_feature (B) LOCATION 1...1266
  hypothetical: NO
  anti-sense: NO
tcggctatcaccanannnngngtngcggcgcaccaaaatgctggtccagcactgtcactttcatttgtcttagctgcaatcgttgtcattttgtctggactaagtttcgcagaatttgcttcgcgagtgccagtgattggtgggccatatgcctatctgtatgttgtatttggtgaatttgctgcctggctgacagggtggttgttgatcggggaatttttactagcggtttcctctgttgcttccggatggtctggctatatgcaaggttttttgaaaagtttaggggccgaacttccacaagcattaactggcgggtacaatccggaaaatggtacatacattgacttgattgcggtgctcgtagtgatattcgtcacttacatcgtgtcgcttgaagccaagaaagcattacgtttgaataatgccatggtatatgtcaaatttggtatcatcgcgttgtttatcattgtaggaatatttttcgttaaacctgataactggcagccattcatgccttttggtttttccggtgtgctagatggtgcagctcttgtgttttttgctttcttgggatttgatgccgttgcaatggcagccgaggaagtcaaaaacccgcaaaaagatgtgccaagaggaatcattggttcgatactgattgctactgtcctttacatcatcgtgacgctgatcttgacaggaatcgttccgtatactgaactaggagtcaatgacccagtggcttttgcaatgaggtatgtaggacatggaacagtgggcgcggtgatcgctgtaggggcaattttaacgctactgacggtaacgatctcgatgatgtattcacttgctcgtttactgtttgctgtcagcaaggatggcttacttcctaagtttatgacagaaatcgatcaaaagcatcgtacaccgaaaaaagcgacttatgccgctggtgtggcagctgtattctttgccggatttttcccattgaatgtattagcggaactaacgaatatcatggcgctcgcctatttgatgcttgttagtctaggcttactgaagttgagaaaaatgtttggcaaaccaaaagctggagaattcaaagtgccattcgttccgctattgccaatcgtctccatcttgacttgtattgtattgatgcttcgtctgcaaactgtgacatggatcgtgttcggtatcgtaatggttattggactgatcatttattttggctatggctatggacacagcaagatgaatgagaaatag

SEQ ID NO: 377 - DNA (genomic), 465 bp, Enterococcus faecium; double-stranded, circular
  misc_feature (B) LOCATION 1...465
  hypothetical: NO
  anti-sense: NO
acaggtatcactgtactagcatttgggagctactttttcttattgggaaaagcagctcgcggatggcctagcagacaaacttttattcgaaatacttcatccatattaacgatgctagaaatgatccgtacgattgatgatccgagtgtagcgtatgcgtttgttgatgaaggctgttatggagaaaagggcttagacagcgtgagatcgggtatgaaaaaagaggctattcttttttatctagactctgttggggcagatacaccgctacagttttcgggaaattatttttcaaataaagaacagtggctgaaacaagttgataagttgaaagaaaaaaacgtcaattatatttttagtgcaagaaaaaagcaagcgcagttcttctatttgaccaaaacagatttacgagggaaaacatttaattggcaaaatgccaatcagattattgctctttttcgataa

SEQ ID NO: 378 - DNA (genomic), 714 bp, Enterococcus faecium; double-stranded, circular
  misc_feature (B) LOCATION 1...714
  hypothetical: NO
  anti-sense: NO
ggagcaatcactatggaaatcattcgtgtaaaaaacgctgaagaaggcggaaaaaaagcatttgaaatcatcaaagaaggtatgaacaaaggtgcaaaagtattaggattggcaacaggaagcacaccagttactttatataaagaaatgacttcaagcgatttggatttcagtgaaatgacttctgtaaacttagatgagtacgttggactaggcggttcagatgaacaaagctaccgtcatttcatggatgtccaattatttgataaaaaaccattcaaagaaacgtttgtaccagatggaaaagcagaagatctggaagcagcatgcaaaaagtatgatcaaatcatcgatgcacatccaatcgatatccaaatcttaggaatcgggcaaaatggacatatcggtttcaatgaacctggtgcttcatttgacggaacgacttcagtagttgacttaacagaatcaacaatcaatgcaaacaaacgattcttcgataaagcagaagatgtaccaacaaaagctgtttcaatgggaatcggttcaattatgaaaagtaaagaaatcgtcttgatggcatttggcgaaagcaaagctgatgcaatcaaagggatgattgaaggacctgtaacgaatcatttgccagcaagtgtattgcaaaatcacgacaatgttgttgtgatcatcgatgaagaagcagcaagtaagttgtaa

SEQ ID NO: 379 - DNA (genomic), 1020 bp, Enterococcus faecium; double-stranded, circular
  misc_feature (B) LOCATION 1...1020
  hypothetical: NO
  anti-sense: NO
gggaaaatcacaaaacgctggctcgttttgttatctagaaaattcagaagaactgaagaaaggacgaatgaaatggccaaacgaaaagtagttgtcgctttaggaggcaatgccatcttgtctacggatgcaagtgcaaaagcccaacaagaagcgttaatggaaacagcaaagtatttagtgaaatttatcgagcaaggagatgaactaatcatctctcacggaaatggtccgcaagtcggcaacctattgattcagcagcaagctgctgattctgagaaaacaccagcaatgcctttagatacatgtgtcgcaatgacagaagggtcaatcggctactggctccaaaacgcgatgggtgaagtactgaaggaaaaaggaatcgataaagatgtagtttctttagtcactcaagtcattgtggatgaaaacgatccttccttcaaaaatccaagtaaaccagtcggcccattctacacggaagaagaagcgaaagaacaaatgaatgctgattctactgtgacattcaaagaagacgctggacgtggatggagaaaagtagtcgcttcccctaaaccaatctcgatcaaagaagcacgtgtcatcgaaacgctagtcgaacaaggagttatcacggtgtctgtcggcggtggcgggattcctgttgtagaaacagctactggattagaagggcgagaagccgtgatcgataaagattttgcttcagaaaaattagccgaaatcatcgatgcggatttgctgatcgttttgacaggtgtagacaatgtgtatgtcaattaccaaaaaccggatcaaaagaaactagaaactgttactgtttcagaaatgaaacaatacattgatgaaaaacagttcgctccaggaagcatgcttccgaaagtagaagcagctattgcatttgttgaagcaaaaccgaacgctaaggcaatcatcacttctttagaaaatatcgaaaatcttttagcttctgaagaaggaacgattatcgtagctgattaa

SEQ ID NO: 380 - DNA (genomic), 594 bp, Enterococcus faecium; double-stranded, circular
  misc_feature (B) LOCATION 1...594
  hypothetical: NO
  anti-sense: NO
aaaggaatcaccatgaaaattattggttatgcacgcacaaccataaatgacgttgatttaacaactcaggttgatcaattatctgactttggttgtcaagaaattttccatgagacatatgaagtggaacaaaatgattctactgctgttcatttggagtcagtgatcgctgacatgcaacaaggcgatgcactagtcatttgccaacttcatcgattaggcaaatctacgcggcaattaacagaactcacgcaattattcaaagatcgcgggctgcacttgattagtcttgatgaaggaatcgatacgcgcgaaatgggaaaaatctatttccaattaatggaaaacctagcaaacatggagtgcgcattgatcaaagaacgtacattagttggattagatgaagctcgtaaaaaaggaaaaatcggcggaagaccaaaaatcgatgcaaaaacgatcaaaaaaatccgacgtctctattatgaaaaaaaagaaacgatccaatttatttcttcaaaatgcggtgtttcagttggaacatgttataaatatatcaatttacctgaaaaagaaatcgagcaattatgcatctaa

SEQ ID NO: 381 - DNA (genomic), 501 bp, Enterococcus faecium; double-stranded, circular
  misc_feature (B) LOCATION 1...501
  hypothetical: NO
  anti-sense: NO
aaaatgatcacccaaattcgtgtagacgaccgcttgatccacggacaagtagccgtagtatggaccaaagaattgaacgcacccctgttagtagttgctaatgacgaagcagccaacaacgaagtcatgcaaatgaccttgaagatggccgtgcccaacggcatgaaattattgatccgaaaagtcgatgacgccatcaacgtcttcaacgatcctcggggaaaagataaacggatgttcgtgatcgtgaactccgttagcgatgccaataagatcgcccaaaacgtggaagacctagaaaccgtcaatgttgccaacgacggccgcttcgacaaatccgatccgaaatcaaaaacgatgatctttccaagtgtgcaattaaaccctgaggaattagcggcggcgaaagaattagcccaactgactcgggtcaacagctacaaccaagtattgccatcaaatccgcagctgagtctcaaagacgcagtagcgaaagtctag

SEQ ID NO: 382 - DNA (genomic), 186 bp, Enterococcus faecium; double-stranded, circular
  misc_feature (B) LOCATION 1...186
  hypothetical: NO
  anti-sense: NO
gtatttgtcactcagtcgcacataaaatcggcggggaatacgggatccctcatggacggacaaatgcgattcttttaccgcatattatccgctataatgcaaaagatccacaaaaacatgcgatgttccctaaatatgactatttccgtgcagatacagattacgcagatatcgcaaaattcttag

SEQ ID NO: 383 - DNA (genomic), 236 bp, Enterococcus faecium; double-stranded, circular
  misc_feature (B) LOCATION 1...236
  hypothetical: NO
  anti-sense: NO
caaattgtcactttagagttacactattcaacaagtgacattttgtcactatcaatctatcatagggaggaaaaacaaatgtttctagctatcaaagaaattcgctattctaaattacaatatggcttgatcgtcggtattatgttcttgattgcgtatgtcgtattcatgttgtcaggactagcgaatggactttcagaagagtttaaaaaagcaatcgatgattgggacgcaca

SEQ ID NO: 384 - DNA (genomic), 288 bp, Enterococcus faecium; double-stranded, circular
  misc_feature (B) LOCATION 1...288
  hypothetical: NO
  anti-sense: NO
cgttatgtcacaaagggagtaatggacagtttgccggtggaattacaagctttatgttggaatctaatcgatcaaaacgttcaaaagcaatttcctttagactatcttcaaatttttgaattttctacggaaaaaggaaatcaaaagttggttcatcgtcaagaagaaccggaagaaagaaaagagtatctgatttcacctaagcttcgtttgaaatcagtgtctcaaaaaatatgggccattgattcgggtgagtatcaaacgatgttattaccagaagaatactag

SEQ ID NO: 385 - DNA (genomic), 480 bp, Enterococcus faecium; double-stranded, circular
  misc_feature (B) LOCATION 1...480
  hypothetical: NO
  anti-sense: NO
caaaaatggttggggcttcccttaaacgtttgttggaaaatgatcaattggttgttggcatcagtgaaattaagtgatatcgtaggtgtgtctccacgtcaattaaggtattgggaacaaaagggattcattcgttcgatcgaagctgatgcgaattgtcctagaaaatatcgtttacctacagtcataaaagtagaactgatcaaaaaatatttagatgacggatttactttgtcaaaagctgcaaaaaaggcagaaatccgccaaaagaaaatgcaccatgtccgtaaagttttttcaaaagcaatcaaagatatcgaattgatcgacgaacgctatacgattttacaaatcggtaacttcaaagaagagaatgctaagatgtacatcattcatgacaacgagacagacgaattaacttacaagctccttcctgtcgatgaaaaagctgactacgaacagttgttaaaagaactctaa

SEQ ID NO: 386 - DNA (genomic), 312 bp, Enterococcus faecium; double-stranded, circular
  misc_feature (B) LOCATION 1...312
  hypothetical: NO
  anti-sense: NO
ccattttccacccgcattaccactaaccaggatattcggcgtgtaggcgtgaactgttccgacctcgtatacgcgacaggtttacagcttaacctttttgaagatcctgaaaagcagataaatgaagcgaaagttgattttgttgtcgatacgattagaaaaaaatacggctttcaatcaatcatccatgcgcatagtctcttgcaaggaggacgcgccatcgcacgtagttctctcgttggcgggcatgcaggtggtatgagtggattagaaggtggaaaagatgagacggacagcaaaaaaattcattga

SEQ ID NO: 387 - DNA (genomic), 1002 bp, Enterococcus faecium; double-stranded, circular
  misc_feature (B) LOCATION 1...1002
  hypothetical: NO
  anti-sense: NO
atgaaatggttcaagcgaatagtgattgcagtaccagttatcatcgtagttattttagtcactgtatttttgattaatcaaatcacaccaaagccgattagcttgcttgttagaaaacaatttgacacaagtgaaaaagaacaagtatatgcccgaccagatgatttccagcaaaaaatcgaacaaatcgatataaaaaaagaaatatcctatccttcaaagtacaaaaataataatatggatatctacacaccgaaagtggaaaagaaaaaattaccgattcttttctggatgcatggaggcgcatatgtaggaggggataaaaatgattgtcgtgattatttggaatatctatgttcagacacgcagcaaatcatcgtaaatatagattatgaacgatcaccggaagcaaaacatcctacaccagttatccaattgaacgaagccattcaagcagctaaaaaagagataaaagatcaagcagattggtcgaatatttcgattggtggaaattcggcaggtgcacaaattagtggagaatatttgttagcacttcaaaatgaagaaattaaaaaagctgatcatcttgatccgactttggagaacaagcagattacgaagtttatttctttgtctggtctgttggatccttctgcacttactcaagtaagtgataaaatctctagctttctttatgaaaaatgtggatgggcttactttgataataaggactttgaacaatcagagaaggtcaaaagtttagccttggtcagacatgcggatcgttggacgcaaaacacattcttaacggatggaaatacaaatacgtttacgaaacaaatggaagaagtaacttctgtatttgagaaagcgggggtgaaagtcacaaaagtagattatgcggagaaaaatgctgttttgaaccatgaatatcagtttgatttcagcaataaacaagcgcaagaaacatatcaaaagttagtaatgtttttcaaggagtaa

SEQ ID NO: 388 - DNA (genomic), 198 bp, Enterococcus faecium; double-stranded, circular
  misc_feature (B) LOCATION 1...198
  hypothetical: NO
  anti-sense: NO
gaaaattccaccttcaccatggttatcttcattcaatgcgtccacgacagaggngttcgttgtagggcgggtcgtggccggaagggggggggggggggggggaagggaggggagggggcggggcggggggggagagggggggggagcgttngggagaggggagaggaaggagggggagagggaggggggagggggggg

SEQ ID NO: 389 - DNA (genomic), 438 bp, Enterococcus faecium; double-stranded, circular
  misc_feature (B) LOCATION 1...438
  hypothetical: NO
  anti-sense: NO
atggagtggttttgcaaatttcttttatttctagaagttattcacgtatacggatttgtttttctcacaaataaaaaggcaggaagtacaatggatcatttgtatataaaatatattcatcaattttccgttttggtgttaggcacactaattatagcggggattgtcgcatttattattcaaggccgtgacatattaacagtacatcaagagtttttcagttatgcatttggtattcctctgatcgctataaggtctgataacaaaaagtggaagaaacgctattacattctcttgctatttttgtgtttttatctgccacctaagatttttactttattaggtatacaatgcctatcattttcttttatttcctatatcattgttttaattttcctcagtttcatagtatggatgttttatcttgtcaaaaaataa

SEQ ID NO: 390 - DNA (genomic), 183 bp, Enterococcus faecium; double-stranded, circular
  misc_feature (B) LOCATION 1...183
  hypothetical: NO
  anti-sense: NO
tttttcaccactctcttattatcaggaaacactggggggacaaaaaagtctggcttacaaactgccgagtcctttcccagaaggaaaccagcaagttttcatcgcaaattacctagagacgacttatcgaaaaagggaacacagtctggcaaaattagtagagacgattcatgcttttgctga

SEQ ID NO: 391 - DNA (genomic), 1263 bp, Enterococcus faecium; double-stranded, circular
  misc_feature (B) LOCATION 1...1263
  hypothetical: NO
  anti-sense: NO
attgaaaccacatttttcagatgtgctgtaaggagaatagctatgacagaatatgcaattagactaaaagatatcacaaaatcttataatatgtacgcaaaaccttcggatcgatttcgtgaagccctcaatccttttaagaaatcctatcatgatgtattttatgcgttgaaaaacgtgaatgtagaaataaaaaaaggtgagatgatcggtttcgtgggagaaaacggatcgggaaaatctacaatgttgaaaatcattacgggagtactgacaccaacatccggcacgatggaaatcgaaggaaaaatctcagctttgctagaactaggatcaggattcaatcctgagtattctggctatgaaaatatctatttaaatggaatggttctaggattttcaagagaagaagtcgatgaaatggtcgatgatatcattgaatttgctgacatcggcgaccatatttatcaacctgtaaaaacctattcaagtgggatgttcgttcgtctagcttttgctgtagcgatcaatgtgaatcctgatattttgattgtggatgaagcattggcagtaggagatcttgaatttcaactaaaatgtatggaaaaatttacagaaatcaagaactcgggaaagacgattttattcgtttctcatgatattagttcgattcgccgtttttgtgatcgttcctattggttgaaaaatggaaaagttgtcgaatatggtgatacgatggaagtaacgacgaattacgaaaactttttgaagaaaaaatcagttaaaacagtagatcgaaataaaaaccaagtagaacgcttcgcagctccagatatcgtagacgtgacgaaagccgaattgttggataaagataaaaatccagtggatatgctggaacaaggagaaaaactatacgttaaagtaacctatgaagtaaaagacgatacaatcaaaaatccagttttaggaattgctctgcgtacagtcgacaatttttatgtgtgcggactcaatactctactagatggtatcaagatcccttggaaaaaaggtgagaatatcttttatctggagtatgaaaagttaggtttgttagctggtgaatattattttgacgttgcggtctttgaagaaaatgcaacggttcctttggtatacaagacaaaatacatgaacttgtttgtcagcggttcttatatcggagaaggcatcgtggtcttagaccataaatgggaagaagggactcatagcaatgaaatatga

SEQ ID NO: 392 - DNA (genomic), 1281 bp, Enterococcus faecium; double-stranded, circular
  misc_feature (B) LOCATION 1...1281
  hypothetical: NO
  anti-sense: NO
aaaaactacacggaggtcagtaaaatgaatattattgatgaattaacttggcgcgacgccattaatcagcaaacaaacgaagaaagacttcgcgagctcgttgaagaaaagagcatttcactttattgcggcgttgatccaactggtgattcgatgcatatcggacatttgattccatttatgatgatgaaaagattccaattggcaggccatcatccatatattctgattggcggcggaacaggaacgatcggcgacccaagcggccgcaaaacagaacgtgtgttgcaaacgatggaacaagtgcaacataacgtggacgcactttccaatcaaatgagaaaattgtttggtaaagatgcaaatatcacatttgtgaacaactacgactggttgtcaaaaatctctttacttgaatttttgagagactacggtaaaaacttcaacatcaacacgatgttagcaaaagatatcgttgccagccgtttggaagtaggaatctcatttacagagtttacttaccaaatcctgcaatctatcgactttttgcatctgcataaaacatacgatgtgcaattgcaaatcggtggagcagaccaatggggaaatatcacagctggattagacctaatccgaaaattagaaggaccagaagcagaagcgttcggtttaacgatcccattgatgctgaaggctgacggaacgaaattcggaaaaactgcaggcggtgccgtttggcttgatccgaagaaaacttcaccatttgagttctaccaattctggttgaatcaagatgatcgcgatgtagtgaaatacttgaaattctttactttcttgtctcaagaagaaatcgaagacttagcgaaaaaagtagagacagaacctgagaaacgtgaagcacaacgccgtttggcagaagaagttacaagatttgtgcatagtgaagaagacttgaaagaagcgcaaaaaataacgcaagcattgttctctggaaatattaaagaactaaatgcggaagaaatcgcgcaaggattcggtaaaatgccgaacgttgaaatttcaagcacacctgaaaatatcgtggaactgcttgtttccacaaaaattgaaccatctaaacgtcaagcacgtgaagatgtttcaaacggagctataagtattaacggtgaccgcgttaccgatttaaattttgtcataaatccatccgatgaattcgatggtaagtttgtggttattcgaaaaggtaagaaaaattactttttggccaaagtaattgattag

SEQ ID NO: 393 - DNA (genomic), 822 bp, Enterococcus faecium; double-stranded, circular
  misc_feature (B) LOCATION 1...822
  hypothetical: NO
  anti-sense: NO
tcggatcggtttgaaaaaacattgatgacaggattgtttatcatcgttgtattcgctggtcttggcggattatctgggaatatcggaatgctgattgggttacgtgccggctggggtgtcgggaatgctttatttgtctctactgctttagcaacgatcgtcagtattttagttggtaacacagaaaaagcaatcatgatgtatgaagcagcacttggctgcggaatggctgttggccctctagtcggtggggtcttgggcagtggttcatggcgttatccattttttggggtagcatttttgatgttttgcggttttatagccctagcggtacttttacctgaaactgagaaaccaaagagaaaagtaggcctttgggaaggtgtcaaagcgttaagcaatcataaacttcgttcagttggactaatcgcattgttatataatttcggattctttactttacttgcgtatgcgccatttttattgattggctattctgaattagaagtcggttttgtattttttggctggggtgtgcttctggctattgcttcgattttcgttgcaccggctcttgagcggaagtttacgacttatcggacaattttagcagcatttgtcttattcattatttgcctgctgttatttggagatgggacttatatcccagtccttgtaccattcagcattgtgttagcaggatttttcccaggaattatcaataacaacgttgacggacgattgctatggaaataccaggtctgcaacgaaacgttgcttcgtccagctatagttttgtccgctttttcggtggagctttag

SEQ ID NO: 394 - DNA (genomic), 414 bp, Enterococcus faecium; double-stranded, circular
  misc_feature (B) LOCATION 1...414
  hypothetical: NO
  anti-sense: NO
ttaagtaacactttcttagctaaaggaggagtgcattcgatgaacgaagagacagtatcgccaatgaagaagcttacgaagttagttactcatacttcgtatcaactttttgattcttttgtaaatgacactgaagaacatgctaagaatgtacgattgcaaggaaagtttattcttgagctgcaaaaagctgctactgaacatagtctagttatcttacaagtaagagcaaatcgtttgagtagcaagtatgaaacgatctcaggctgggtggcgacaaaaacggtcgaaaaagaccgagtgatgatccgcctacaaaacgaagagcagcagatccggatggttcctgtagaacaaattgaaaaaataacaatcctttcaccagcaggggaacaggaacggttatcaaaataa

SEQ ID NO: 395 - DNA (genomic), 330 bp, Enterococcus faecium; double-stranded, circular
  misc_feature (B) LOCATION 1...330
  hypothetical: NO
  anti-sense: NO
ttagacaacactcataatggagggattaagatgagaattttagtatcgtgtgcaaatggatcaggaacaagcttgatgatgatgagaagtgtggaaaaagcaatgaaagaactaaacgtaccaattaccaaaatccatcattgtgccatttcagagggaaaaagttcagctggccaatacgatgtagtttttacgccagtcaattttttgaatatgtttactcaggcagagaaaaaaggagttacagttatcggtatcaaaaatgtgatgtcagtcaaagaaatcagtgaaaaatttgctgaaacaaagtggtaccaaaaaaacaagtaa

SEQ ID NO: 396 - DNA (genomic), 897 bp, Enterococcus faecium; double-stranded, circular
  misc_feature (B) LOCATION 1...897
  hypothetical: NO
  anti-sense: NO
ttacgaaacactaaactcacaaattggagtaaaagaggtataaaaatggtacttacagaacagaaacgcaaatctttggaaaaaatttcagataaaaacggtgttatctcagctttggcatttgaccaacgtggtgctttgaaacgtttgatggcacagtatcaagatacagaaccaactgtagctcaaatggaagaactaaaggttttggttgctgatgaacttacaaaatacgcttcttcaatgttgcttgaccctgaatatggacttccagcaacaaaagcattggataaagaagcaggtcttcttcttgcctatgaaaaaacaggttatgatacatcaagtacaaaacgtttgcctgactgcttggatgtttggtctgcaaaacgtatcaaagagcaaggcgctgatgccgttaagttcttgctttactatgatgtagacagctcagatgaacttaaccaacaaaaacaagcttatattgaacgtgttggttctgaatgtgtcgctgaagatattcctttcttcttggaaatccttgcttatgatgaagaaatctcagatgcaggttctgttgaatatgcaaaagtgaaacctcgcaaagtcattgaagcgatgaaagttttctctgatccacgctttaacattgatgttcttaaagtagaagtaccagttaacgttaaatatgtcgaaggttttgctgatggtgaagtggtttacagtaaagctgaagctgctgacttctttaaagcacaagaagaagcgactaaccttccatacatctacctaagtgcaggtgtatctgctaaattgttccaagaaacattgcaatttgctcacgactcaggtgccaagtttaatggtgtgctttgtggacgtgctacttgggcaggatct

SEQ ID NO: 397 - DNA (genomic), 513 bp, Enterococcus faecium; double-stranded, circular
  misc_feature (B) LOCATION 1...513
  hypothetical: NO
  anti-sense: NO
atcatacggttgatctgtcatgagagattcctccttagttgtctttacctatctatagtaaaaggtgaaaaagaggaaaacaattcaacttgttcggtaaagtattctacaatggaatggatgcgtttttttgataatagaataaactatgatatacttatcactaaaagaaagcgcatacttagtgttggaggaaggaaagtgaaaaaaatggaggagtcatttcctaaagcagtaaaagtggaaaatatagcgaatattttgaaagttacatttgaaaacggagaagtaaaatacgtgaaatctcattggacagaagagataaccgatgccttgcaatttggaaaaaaaggaagaggaaaaagaaaaaatcttctcgcactttctcgtaatatgtggattgggactgaagtaacgattgaagcagatggaacagtattcataaatggaaaagacaggtatacgccagaagagttgtggtacaaaggaaagaaaagtataccagaattataa

SEQ ID NO: 398 - DNA (genomic), 549 bp, Enterococcus faecium; double-stranded, circular
  misc_feature (B) LOCATION 1...549
  hypothetical: NO
  anti-sense: NO
atacaacggttttacttctcaaacaaaatcttttcctttttgtataaatacccttacacttgtttatatagattatgttttttaataaagggggatactaatatgccatggaacatgaaggactttcctgcatcaatgaaaaacttagataaactgacaagaaaaaaagcaatcgacatcgcaaatgcactgttggatgaagggtaccctgatagccgtgcgatcccaattgccattgatcaagcaaaaaaatgggatgaagatgctagtgaatcagaaaaacgaaccttcgaaaaagaaaaaaatccaagcaagacggatgaacacgatacgaatcctcgtgccggaaaactgcttgattcagatgtgatcgtagaatatgaggaaaaacaatggatcgtgaaatctaaaggggcaaaaaaggcaagcaaccattttgatacaaaaaaagaagcaatcgaaaaaggaaagcaagtagctcaaaacaaacaatcaactttgatcatttataaaaaagatgggacaaaagaaaaagaaatcagttactaa

SEQ ID NO: 399 - DNA (genomic), 219 bp, Enterococcus faecium; double-stranded, circular
  misc_feature (B) LOCATION 1...219
  hypothetical: NO
  anti-sense: NO
actatttgcacttttttggttaaaaaagaggttgcgacaagacttttgtcacaacctcttataaacggtgttctcctaccaactcttcggtcacaagtcaaaatattcatcaaacatgagaagctgttttttgaaattgctccttgtgactcagagttaaacggcaggctcacaacctctgatataaacggtgttcaatcaactgaccctcggtattag

SEQ ID NO: 400 - DNA (genomic), 351 bp, Enterococcus faecium; double-stranded, circular
  misc_feature (B) LOCATION 1...351
  hypothetical: NO
  anti-sense: NO
tgtttgcggttttctataagccatgttctgtactttgcttttccagggagaaaaaacaaagcggtaaccatctatctgcagttatactgcctttttgtcctgttcttcttccagacaaaaagcgcccctaccattgtttgggttgctcgctcgaggggtttaccgcgttccaccggatgggtttccccagccgcttcgtcactgtggcactttcaaggatacttaagcatagccgaagccttagcttgttttcctgccgttactccaaagagtaccttagcttatggtttcgctaagcacgaacactacaggcatcacagcctgtgcgagcatggactttcctcagcctga

SEQ ID NO: 401 - DNA (genomic), 555 bp, Enterococcus faecium; double-stranded, circular
  misc_feature (B) LOCATION 1...555
  hypothetical: NO
  anti-sense: NO
gtcaagcggttgggagaccagtggatgctgaacattttgagcagcggatcagcagcactggaaaatcggagtagtctcaattctgaactgcgggagctagactatttttttgaagcacatccgatgattaaggaaaaaattgattcctttgtgacgatcgatgatcttcaggtcggcaaaccagatccagaaggttatttgttgtgcttgaaacggctgagggttgaacaggctgttgtagttgaggatagtccagtcggtgcccaagcagcaccgcatatgacagttgatgtacaagcgttggatgcagattttttcgcctttagcgggcataaaatgtgcgggccgacaggaatcggtgtattatatggcaaacgtcaattgttagaacaaatggagccagtcgaattcggcggtgaaatgatagattttgtcaatctttacgatagttcatggaaagagctgccatggaaatttgaagctggtactccgaacattgcaggagcaatcgattacttgaatgagattggtatgcgagaatattcatcgttatga

SEQ ID NO: 402 - DNA (genomic), 516 bp, Enterococcus faecium; double-stranded, circular
  misc_feature (B) LOCATION 1...516
  hypothetical: NO
  anti-sense: NO
gggggaagcacgatggaacagatgcgtgtttatattgcgaacctcgggaaatataacgaaggtgaattggtgggggcgtggtttaccccacctgtcgattttgatgaagtgaaagaacgaattgggttaaatgacgaatacgaggaatatgcgattcatgattatgaactaccctttgagattgatgagtatacatcaattgaggaaattaatcgattgtgtggcttagcggaggaattagaaggaacgccaattggtgaggttgcttcagagattcagcacgctttctttaattctttcgaggaaatggtggagcatgtggatgatattatctattatccagattgcgatgatatgagtgatgtagcatatttcttgattgtagaagctggtgattttggagaagtaccagaacacttgaagacgtatattgattttgatgcgtgtggtagagacttggagattggaggcaattatttggtaacgagtcgaggtgtttttgagtatccatattaa

SEQ ID NO: 403 - DNA (genomic), 849 bp, Enterococcus faecium; double-stranded, circular
  misc_feature (B) LOCATION 1...849
  hypothetical: NO
  anti-sense: NO
tatcctggcacagttactgcaacagaagactcaatcgtagtggatggcgaagcaactcgtgtttatgcagaacccgacgcaagcaaaatcccttgggcaaaagaaaacggtgtagatatcgtactagaatgtactggtttttatacatctgaagaaaaagcaaaagcgcatttagatgctggtgtcaaacgagtagttatttctgccccagctggtgctatgaaaaccatcgtctataacgtcaatgatgatacattagatgaaaacgacaaaatcatctcagcaggttcatgtacaacaaactgtttagcacctatggcttatttcttaaataatgaatttgggatcgaagttggtacaatgacaacagttcatgcctacacttccacacaaatgctcttagatggacctgtaaaaggcggtaatttgcgtgctgctcgttcagctgctgacaatactatcccacattctactggtgctgcgaaagcaatcggcttagttatccctgagctacaaggaaaattacaaggacacgcacaacgtgttccagtcgttgatggttcattaactgaattggtttcagtattgaaaacaaaagtaactgctgatcaagtaaacgaagcaatcaaaaaacacacagttgacaatccttcattcgggtatgatgaccgtcaaatcgtttctagcgatgtcattggaacaactcaaggttcgatctttgacccaacgcaaacagaagtaacaactgctggtgatttccaacttgttaaaactgttgcatggtatgacaatgagtatggatttacttgccaaatgattcgcttactagaaaaattcgctaacttgtaa

SEQ ID NO: 404 - DNA (genomic), 447 bp, Enterococcus faecium; double-stranded, circular
  misc_feature (B) LOCATION 1...447
  hypothetical: NO
  anti-sense: NO
ttcacaaggttctataatgaaatcgcaatcaatccaacatatacaaagaaggcgattcaaatggagatccgatttgatgatgcttctgctgctgaaataaagcagcatctagcacctgaaaacaaactaatattaacattcgaagatggaataggtccgtattctcagcatgcaatgatccacatgcaagttcaattcacccttggaatcatcggatcagatatgtcgacagaaagttatgaccaatctatcccaagcaatctaggagagatattagtaaagggatattcgttggcagacttagatgagcatatgaatatacgttttgatgcttctcgtcatattttgagtttgacgggcgacagtgggctgattgacggaaacttaggtctgatcgatttcactgaatcaaacaacgaaggaatcaagaaaaatccggcacgttaa

SEQ ID NO: 405 - DNA (genomic), 198 bp, Enterococcus faecium; double-stranded, circular
  misc_feature (B) LOCATION 1...198
  hypothetical: NO
  anti-sense: NO
aatgtattaactcgtttgtcccaacttccaaaacatatttttgaaagttgggtgttatcttttttgaagtataaaaagatctcaaatcaatccactttactttcttattatgttattcatagtaacaaaagagagtataaaatattttgtgtaaatgaaaaaatccatacaaaaaaggaagtcccttctgtagaataa

SEQ ID NO: 406 - DNA (genomic), 699 bp, Enterococcus faecium; double-stranded, circular
  misc_feature (B) LOCATION 1...699
  hypothetical: NO
  anti-sense: NO
caaacattaacaatctcgcaaaaatcaaatcgaacggatctagtaacaaatgtcgatcgaaacatccagaattttctaatcgaaaaaatccattcctttgatccagaggcgaaaatattggcagaagaagaagggtgtaatcaattatcggatctcgatggaagagtctttatcatcgatcctattgatggcaccttgaattttgtgattgaaggggaaaatttttgtattatgctcgctgtttatgaatccggcgttggaaagcttggtttcatttatgacgtgatgagaaatgaacttttttggggtggaaaaggaatacgcgtgtataaaaatgatgagccattgcctagaccagcaaataaatccttatcggaaggcttacttggtgtgaatagttatcttttcggtcataataaatatggaatccgagaaattgcggaaagcagcatggggacacgtatgtacggatgcgctggtcttgaactagtggcaatcttgaaaggaaaccacattgcttatatttcaaaccttagcccttgggattatgcagcgggaaatgtcttattggaagagtttggtatggtaacaagcggtctttttggtactcctttgacatttgaaaaaagggaatactatttagcagggacttcttgtgcatatgcagaaatcgcagaccttttgaaaaaagaaggctga

SEQ ID NO: 407 - DNA (genomic), 867 bp, Enterococcus faecium; double-stranded, circular
  misc_feature (B) LOCATION 1...867
  hypothetical: NO
  anti-sense: NO
acaatgaggttcaaagatatgaaaaggggaaatttgatgaagaaaataagcaatgaaatccaaattctggcagaaactttaactcttcccaaagtcgttatagagcaaatgattgtacaagcaaaaaacatccttgatgaggtgtttgagcaatatagtcatgaactaatggatcctaataaagcaaaggcgactgcaaagaaaatagacaaagtctatgaagaggaaccttttgcagcattagctatttatctatatgcagcttctcaaagttggaaaaaaatttatcaaccattgaagattccaagaactatctatttggcaacaatgaatgcttttactagatttattcatgaacatttccaagtaacaggaagctatcgctttgaccgtggtttttggatttggcattacactagtggcttgatctttcggattggtgaattggagtacgaaatgacatattttccgaaagggtacacggatctaagattagaaggaaagcagtgcctttctcttcatattccttccgatgcagatttatctcagaataagataagagatagttacgaaagtgccattcgtttttttgaactttattttcctgattaccattaccaagtgatgtacacagatacttggttactatcacccaatcttactaaatggttgaaaaaagagtcaaaaatctgtctttttgcagccgattatcgattattatcagttgatgaacaggacgatagtggagtcccttggatctttggacgagtagatgcccaaatacatgattatccagaaagtacgagtttacagccgcacaagcaaaagagcaattgcttgcaggcgagcacattggctctggcttag

SEQ ID NO: 408 - DNA (genomic), 201 bp, Enterococcus faecium; double-stranded, circular
  misc_feature (B) LOCATION 1...201
  hypothetical: NO
  anti-sense: NO
actatactaacattgttagcgtttgctatatgtattattattgttttttatacacaaatacttatcttcaaaataaattattcaatgcgaatgtatattttttacataataacaaatcaaatttgtaaagtattaaaacttatgtttaattcagatgtgttaaaactttacaaattctttaaaaaaagtaacaataaatat

SEQ ID NO: 409 - DNA (genomic), 267 bp, Enterococcus faecium; double-stranded, circular
  misc_feature (B) LOCATION 1...267
  hypothetical: NO
  anti-sense: NO
tacaatataacagaaataagaaaaggaggacctccgatgacacattcacaattagtcgcaatcataaaacgactggaggctatggtcgagtcagcagataatgaactgcaagttcgccgttttgaaaaagaaggcgtagagaagtgtacagtaacttatgataaagcgaccgatacatttgaattaactgaaacagatactcatcagcaatacgaatttgataatatcgatatcgtagcgatggaaatctatgacttaatccaataa

SEQ ID NO: 410 - DNA (genomic), 303 bp, Enterococcus faecium; double-stranded, circular
  misc_feature (B) LOCATION 1...303
  hypothetical: NO
  anti-sense: NO
cagaacataaccattcccacgaccatgaaaggacacgaacacttcacattggtggatgaccaaggaaatgaaacattatatgaaatcctactaacagttgacggacaagaagaatttggacgtaactatgttcttttatatcctgctggtgtttcagaagatgaagatgtagaattacaagcttatgcatacatcgaaaacgaagatggaacagaaggcgagttagaacaaatcgaaacagacgcagaatgggacatgattgaagaagtattcaatacattcatggcggaagaagaagaatag

SEQ ID NO: 411 - DNA (genomic), 645 bp, Enterococcus faecium; double-stranded, circular
  misc_feature (B) LOCATION 1...645
  hypothetical: NO
  anti-sense: NO
aaaaggaggttttttatgaaaattgcactcattggagctactggccatgcaggttcatttattttagacgaagcattgtccagagatttagacgtgacggcaatcgtgcgtcatccagaaaaattgccatcagatgttccgtttatacaaaaggatttatttgagttgacaactactgatcttgcatcttttgatgttgtcgttgatgctttcaacgctcccaaaggaaaagaagaaatgcatcaaacttctttgtcccatttgattgagatgcttgaaggaaccgatacacgcttaattgtcgttgggggtgcctcttcgttattcttagatacagaaaagacgactcgtatgattgaccaagtacctaaaaatgcacccttctatccaacagctttcaatatgtacgaaggattgttaaaattgaaacaatctaaaaatctacattggacttatatcagtccagcttctttatttgatccacatggcaaacgtacaggtacttatttgttaagtgatgattatttacaaagaaacgctgctggcgacagtacgatcagcatggcagattacgcgattgcattagtagatgagatactggatgagaaacatgaaaagcagcacatcagtgtagtcagtcgataa

SEQ ID NO: 412 - DNA (genomic), 774 bp, Enterococcus faecium; double-stranded, circular
  misc_feature (B) LOCATION 1...774
  hypothetical: NO
  anti-sense: NO
aaagtaataacaaacaaaaggagtacagaaatgattgaattcatcaatgtaagtaaaagttacgggaaaaaacaagcattaaaagacttgtctctctcgataagacaaggggaaatttttggatttttaggacataatggtgccggaaaatcaactacgattaaaagtttagttagtattattgaaccatcatcgggaacgattttagtagatggaatgaaattgacggaaaatcgattgagtatcaaacaaaaaatcggttatgtgcctgattccccagatatttttttacaattgacggctggagaatattgggacttgatttcagctgcctatgaattagacacacaaaaaaaagaaaagcgtttagcagaattgacagcgctttttgatatgtatagtcatcaaaatgaaacaatcgcaagtttttcacatggaatgcgtcaaaaaacgattttgatcggcacgttgctgccagatccagatatttgggtattggatgaacctttgcaaggacttgatcctcaagcagcatttgatttgaaagaaatgatgaaggctcatgccgcaaaaggaaaaacagtcattttttctacacatgtattggataccgcacaacagttatgcgataaactggctattttgaagaaaggtgaattgatttatcagggggcagttagtgaattattgaatggctcacctgatgaaacgctagaaaagatttatttgaaaatggctggaaggcaagcgacaggagatggaccgtatgtataa

SEQ ID NO: 413 - DNA (genomic), 633 bp, Enterococcus faecium; double-stranded, circular
  misc_feature (B) LOCATION 1...633
  hypothetical: NO
  anti-sense: NO
ggtaaaataacactgttttctgtggataaacctgtggatgttgtgcataactgttggggaaatctttttaacaaaaatagccaaaataaacatatagacgaaaaaattgattataataaacaaagtgagcatgaagaccaaaggagagaaaacatgaatatcaaaattatctcagtaggaaaattaaaagaaaaatacctgatccaaggtatcaatgagtatgtcaaacggctgaatgcctatgcaaaaatcgaattgatcgaagttcctgacgaaaaagccccggagaatttaagcgaagcgcaaatgagacaagtaaaagaaaaagaaggggaacggatcttagcgaaaatcaaagaacaagaatacgtctatgccttagcaattgaagggaaaaatcctacaagtgaatcttttgctaaacaaatcgaccaattaggtatccaaggaaaaagccaccttgtttttgttatcggcggctctttaggactcagcgaagccgtcatgaaaagaagcaatgctcagatctcttttggaaaaatgacgtatccacatcaattgatgcgtctgatccttgtcgagcaaatctaccgtgccttccggatcaatgcgggggcgccttatcataagtga

SEQ ID NO: 414 - DNA (genomic), 1152 bp, Enterococcus faecium; double-stranded, circular
  misc_feature (B) LOCATION 1...1152
  hypothetical: NO
  anti-sense: NO
ataaaaataacctctcagcaatttccaaatgtgagccttttgctcgtatttgaaaattgctgttttttattgacacggaaagagaacgtgtgttctagttgtgttgaagaggtgattgttatgtgggcgaatcaaaatccggtatttgtttatgaaaaagaaccttcaagagatattttatgtattgactgcaaatctttttacgcctccgtagagtgcgttgaaaaggatcttgatccccttacaactaaattagtagtcatgtcctatccgtccgattcgacagaaacacggggtagcggattaatcttggcttccagtcctgcagcaaaaaaagcttacggcatcaccaatatcagccgtgccagagatcttcccttcccctatccaagtgatttatatattgttgccccaaggatggcctattatatggaaaagaacagagaaatcaattctatctataaaaaatatgcagacgaagcgaaccatcatgtctattccgtcgatgaaagcttccttgatgtaacaaatagcatggcactctttggtaaaacaaatgcgtacgacatggctaaactgatccataaagatgtgtttgagcagaccggaatctacacgactataggaattggcgataacccgctacttgctaaactagccttagacaatggctcaaaagacggaaagcaaatgtttgctgaatggcgttatgaagatgtaccagaaaagttatggaaaatctcagatatcactgacttttggggaatcggcaaacgaacagcaaaacgtctgaaacaaatgggtatacattctgtttatgatttagctcacgcggattattatcacttgaaaagcaagctaggggtcatcggtactcagctttatgcccatgcttggggcatcgatcgaagttttttgggacaagaatatacaccaaaatcaaaaagtatcggaaatactcaaatcctagatagagattataccagacgagaagaaatcgagatcgttatcaaagaaatggccgaccaagtcggcactcgcttgagacgatctgcagcaaaaacacaagtagtcagcttatgggtaggatactctttaggctatcttgatccaaatgggaagacggggtttcaccaccgaatgaaaatctaa

SEQ ID NO: 415 - DNA (genomic), 279 bp, Enterococcus faecium; double-stranded, circular
  misc_feature (B) LOCATION 1...279
  hypothetical: NO
  anti-sense: NO
ttttttgtaacaggattttcctgccattggctttctacccaatggtctaactcattaagaacaatgtttgctagtagtggggatattattcccccttgcggagttcctttctctggatatgttattgtaccgttagtcattttgattggagcttttaatatcctttttaaaatgaatatcaagtgcttgtcccgtattcccatagcccatatctgttttatcagcttggaatggttcacgttgtcaaagaaacccttaatatcaaattcaatcacataa

SEQ ID NO: 416 - DNA (genomic), 1683 bp, Enterococcus faecium; double-stranded, circular
  misc_feature (B) LOCATION 1...1683
  hypothetical: NO
  anti-sense: NO
gtgagtgtaacagaaataagtgcaagccagttccaggaaatggtccaggcaggtgcgaatcgtctgcaagtaaatgcagaatacgtcaattcattaaatgtattccctgtgccagatggcgatacgggaacaaatatgaatctatctatgactagtggagctaaggcagtagtagattcaacctcagaaaaagtaggagaattagcagcaatgctttcaaaaggattgctgatgggtgcgcgcggaaattccggcgttattttgtctcaattgtttcgtggattttctaagcaaattccagatgttgtctcattaaatgcttctgatcttgctgcagccttcactcatggagttgaaactgcgtataaagcagtaatgaaaccagtagaaggaacgattttgacagtagctagagaagcagcgaaagctggagaaaagaaagcaaaaagtactgatgatgtcgttgaagtaatgacagctgttgtaaaaggagcaaagcgtgctttagctaaaactccagacttgcttccagtcctaaaagaagtcggtgtcgtagacagtggagggcaaggactgctgtttgtttatgagggctttttaagtgcattgaatggagaattccaagcggatgaaacatatgaaccttctccagcagaaatggatgatatggtcaatgcagaacatcatcgcagtgtccaaggtcaaatggcgacagaagatatccattttggttactgtacagaaatcatggtaaaaatcggagaaggacctacagtcgatagtacattcgattacgaagaattccgtaactatttagatggtataggagattctttacttgtggtcaatgatgacgagatcatcaaagtccacgtgcatacagaaaacccaggagaagtcttgaattatggacaaaaattcggttcattagtcaaaatcaaagtcgacaacatgcgcttgcagcatgagacgattttggaacacgatgaagaagtgaacgagtttgcgaaaaaagaaataccacgtatcccgtatggtatcgtagcgatcgctgctggtaaaggcgtccaagagctgtttgaaagtttaggcgctaattatgttatcagtggtggacaaacaatgaatccaagtacggaagacattgttaaagcgattcaagaagtaaacgcagataaagtgattgtcttgccaaacaataagaacatcttcatggcagctgatcaagcagcagaagtagcagatatcccagtagcagttgttccttcaagaacgatttcccaaggattgacagctatgctttcattcaatgatcaagcttctttagaagaaaacaaagaaacgatgacagaaatgttgtctagcgttgtgagcggtcaagtcactcacgcgatcagagatacctcaattgacggtgtagagatcaaagaaggagactttttgggcatgatcgatggaaaaatcctgatctctaacccagatatcacagcaacagcgttaagtacactagaacaaatgatcaatgaggacacagagatcgtaacgatcttggcaggtgatgaaggaacagttgaacaagcaaatgaatttgctgagaaactaacagaaaaacatcctgatttggaaatcgagatccaccaaggagatcagcctgtctatccttatctattttctgctgaataa

SEQ ID NO: 417 - DNA (genomic), 1323 bp, Enterococcus faecium; double-stranded, circular
  misc_feature (B) LOCATION 1...1323
  hypothetical: NO
  anti-sense: NO
tcaaaagtaacaccagatgcaccatttggacctggacctcgcgacgcattgaaacatatgttagcttatggcgaacgtgatggatttaaagtaaaaaatgtcgataactatgcagggcatattgatcttggcgaaggagacgaaacgctagggatatttggacacatggatgtcgttcctgcaggagatggctgggacacagatccttatgaaccagtaatcaaggatggaaagatctttgcacgcggatcaagcgatgacaaaggtccaagtatggcagcttactatgcgatgaagatcattaaagaacttgacttgaaactatcaaaaaaagttcgcttcgtagtcggcagcgatgaagaaagcggctggggcgatatggcttattatttcgaacatgaagaagaaccagattttggtttctcaccagatgctgaattcccaatcatcaatggtgaaaaaggaaatgtttctttagctttacgcttcaaaggcgacaatgcaggagattatgtcttgaaatcttttgtttccggacttcgcgaaaatatggtgccaggaacagcaactgcagcacttcaagtaccaagtgcagatgcagctatcgcgatggaagaagcattttaccaattcatcgaagcaaatccagtaagcggaacgattgaagcggacaatacgtatgtaaaaatcgaattagttggtaaaggcgcacatggtgcaagcccacaatctggtatcaatgcaggttctttcttggcattgttcttagataactatgaattcctaggatctgctaaacaatttatccatgtagcagctgcttatgtccatgaagatttttatggagaaaaactaggagtcgcttatgaagatgaaaaaatgggcaaattgacaatgaatgctggactatttgcttttgaagaaaatggtacagaggaagcgaacttcatcaatatgaatttccgttttccaaaaggtgtaacagtagacggattgcaaagtgacatcgaacaaacagtggggcaagaaggcgcaacagttactcgaggtgctcgcgtaatggaaccacattacgtaccaatggatgatccattggtggctacattattgcaagtctatgaagaccacactggagaaaaaggctacgaacaaatcatcggtggcggaacttacggacgtttgttgaaacgtggcgttgcttatggagcgatgttcccaggatatactgatacaatgcatcaagcaaacgaatttatgagtcttgatgacttgttcagagcaacagcaatctatgcagatgccatctatcgtttggcgaaataa

SEQ ID NO: 418 - DNA (genomic), 771 bp, Enterococcus faecium; double-stranded, circular
  misc_feature (B) LOCATION 1...771
  hypothetical: NO
  anti-sense: NO
aggagggtaaccaacatgagaaatagaaaatggctatttgtttgtgcagccgctcttttttctttcactgcctacacacagttgacgtttgcagacagacaagaaagcacggatagcacagaacaaacaatccaaacgtcagatagcagcacgattcaaagcagcgatgaaaccgtcgattcgtcaacagttgattcttcagaagaacctaaaattgctgaagacgatcaaatagtcaaacagaccattcacgttcaaaagattatttcttcagaacaattagacaaccaggggcatgaaaaacaagaaggagtaaatggcgcgaagttttctgtttatgatgtatcggacattttacaaaagatggatgttaaggatctcactactgaccaaattgaatcccaattaaaagatcgagtgaaaaaactatccagtgatcaattgaagctagtttctaatggagaaacaaagacaattgatcaacaaacaggtgtctttgaattctcggtagaagtacaggcaaatcagaaacaagcttattatattgtcaatgaatcaagtcctgaaaacatttctaatagcgaggatattttgctattaacacctgtttctgataaaaacggtgaattcttaaaggatgtgtggatctatcctaaatcagaagcttcgcaacctaaagaagaagtaaaaaaaatcgtttctactggcgtaaagaaaaacttctttgagaattgttgggattttgttactcacttgttttctagagattaa

SEQ ID NO: 419 - DNA (genomic), 426 bp, Enterococcus faecium; double-stranded, circular
  misc_feature (B) LOCATION 1...426
  hypothetical: NO
  anti-sense: NO
tgtatttcaactcataaaatatataaatacttcaaatgtcattacaaatacaacaacttgttgtactctactgagaaggggggtgtattaatgaaacagaagcaatatgcaaaggtcattagagaaaagcgaaaagcactcgggtggacacaaaaagaattagctaaaaaaatcttctctacacaacaggcagtagcaagatgggaaaattctgtaacagaacctaacctcgatagcttaacagctctttctagagccctaggaacccctgtaagccattttctagacaatgttgacatagattatgaggaagagtttttggctctctatcgctctcttagtactgaagatgcaattcgaacaattgactatatgaagctattaaaaaggcaagaaaatgaacgcaatcagctattgaaagattga

SEQ ID NO: 420 - DNA (genomic), 480 bp, Enterococcus faecium; double-stranded, circular
  misc_feature (B) LOCATION 1...480
  hypothetical: NO
  anti-sense: NO
ttctcttcaacagcccttacgatggctacttctgttggattacctttgataacaaggtcgtcatcttcttgctcgaccgtcacatctgtacatagtgcagccattttcaatatttccatcgcgctgttcgtcattgaatcttcgatattcgttacttcatcttctttgctccatacccggcggacgcgcatttcattttgtgtcagcgttcctgttttgtctgagcagataacattagcggttcctagcgtttcaactgctggcaactgtcggatgatcgcatgtttcctcgccatcttctgcacaccgtatgcaagtgtcaacgtaacaataacagtcaaggtttccggtacagctgcaacagccaaggaaatcgaagtcatgaacatctcaaggagtggttctccttgcagttcaccaatcacaaatactaaagccgcagccgctaaagcgatcatactgattcgtttgcctagctga

SEQ ID NO: 421 - DNA (genomic), 1305 bp, Enterococcus faecium; double-stranded, circular
  misc_feature (B) LOCATION 1...1305
  hypothetical: NO
  anti-sense: NO
aatcattcaacaagcaactgcattgaagggttgagtatgaaaaagaaactttttgctattttcggcccggttgttttagctgttggcttactgtttgtgttttttacctcctcctatcaagtagatatctctaatccagaaacgattagacgtgcctcttcttccatgtcagtgaacgtgttgaaaggagatgcgataaaaaattatgcattatctgaaaaacaatatattcctttttttggctcaagtgaattaagcagaatcagtccatttcatccgtctgttctggcagaaaaataccagcgaaactatcgtccatttttgctgggagcacccgggacacaatcgttaagccaatatatgatgatgcgttctgcaggagatgctatgaaaaacaagaaagtcgtctttattatttctcctcagtggttcgttaaaaatggtgtaaaaactgattactttaatacgtattattctgaacttcaaacatacgactggttgttttcaatgaagaaagtaacgcctgctgatcgctatttagctagaagattattaactttctcaaaagtaaaagagaatgatacgttgacggcgattctgcaaacgatcaaaaaagggaagctacctttacctgaatctttgaatcagctgcgcagccaatggaacatgctgaagagagaggatgaagtattcagcaatattgggttgaaagatcgacagcaaaaaatcgatcatgagtcaaaacgattaccaaaacaataccaagaaacagaattatccattttagcaaatcaaattggagaacgagaaacgacgaataatccattcgggttgaaaaacgatttttatacgcatcgtatccgagcccacgagccagagctcaaacagtcacaaaaaaattgggattatcgtttttcgccagaattttctgattttcagctggtcttggatcaattagcaaaaaaccataacgaagtattgttcatcatcccaccggttaacgagaaatggagcgattataccggactatctcaagaaatgttacaaggatttgccaaaaagatcaaatttcaattaaatagccaaggattcaatcgaatagctgattttgtcaatcaagcgggtaccaactattttatggaagacacgatccatctaggctggaaaggctggttggctgcagatcaacagatcagaccgtttttagaagaaaatcatattactgctagtaagtatcatcttgacgatgctttttttagcaaatcttggcaacatcaaataccagataaactacaattaaaataa

SEQ ID NO: 422 - DNA (genomic), 216 bp, Enterococcus faecium; double-stranded, circular
  misc_feature (B) LOCATION 1...216
  hypothetical: NO
  anti-sense: NO
accgttgggtttgtgaatcaccaattaaaaatggcactgagttatggtaacaaaaaatggtcacttgacgaggctgagattcctacttatgaagacacatggcacttaagagtcgaggtaaaggaagaagctgaaaatataggaggctgtacattatttggcaaaggattcggaaattatgatcaagacatcaaaatcaaaatgttttacagctaa

SEQ ID NO: 423 - DNA (genomic), 189 bp, Enterococcus faecium; double-stranded, circular
  misc_feature (B) LOCATION 1...189
  hypothetical: NO
  anti-sense: NO
tttagctcaactattccagcgtcagctgaagatattgcaattcccgattccttaatcatttatctggatgagacagaaagtgaagttgcaacagatgtgcatgtagttgaggataaaaatgatagtttaaaaattaatagttcagatactttactaagagtaagtcctatcttttcagctgttatttag

SEQ ID NO: 424 - DNA (genomic), 435 bp, Enterococcus faecium; double-stranded, circular
  misc_feature (B) LOCATION 1...435
  hypothetical: NO
  anti-sense: NO
acatcatcaacgaaaaaaaatatttaccgcatggcattcaaaagccgtaaaaaagaagccgaggcatttcaagactggattttcgacatcatcaaagaactacgccagtccacaggacttgaaggctttcaagtattccgcatgctagacaaagaacaccaaaaagaagcaatgactaaattaagccacgctattactgaaccaaaaccagtagactacattaaagcgaatgtgatagccaataaagctgtatcaactatttatggtcattccaaaatggtaaaaaagaaagatatgactcctgaaatgttggttgatcgtgaacctattttagatgagacagtagaattaatgactgttaaagaaaaatatgggttgcagttttcagtgagtgagaaaatttataatcgttctgctgaattgcagacaacttag

SEQ ID NO: 425 - DNA (genomic), 426 bp, Enterococcus faecium; double-stranded, circular
  misc_feature (B) LOCATION 1...426
  hypothetical: NO
  anti-sense: NO
ttcagatcaacgatgatcgaccgttcatggagtagaaagagaggcagttttttgcagcaggagccggaaattcaaaaagaagtaaggaaactgacaaaacttttaagagagaatgaaacgatcattcgctacaaagaacttgaagaaaagatccagcaaaaccagtatttagctgagttgagagaaaaaatcaaacaagcgcaaaaagatgctgttcattttgcccactatgacaaaccagcagcagaaaaagaagcaatcaaacaagcggatcaattcatgcaagaatttgatcagcatccgcttgttgtagcttatagaaaacagctgttggaagcagatgatctgcttcatcatttaacaactatgatacaagaagaaatcaatggacaaatagaggaggaaaaacatgcctcaaaaaactaa

SEQ ID NO: 426 - DNA (genomic), 228 bp, Enterococcus faecium; double-stranded, circular
  misc_feature (B) LOCATION 1...228
  hypothetical: NO
  anti-sense: NO
ccaaagtcaacaaaacgaatactcatcaacatacagaataaaaccacagcgtatggtttatgcttcgattcaaataatgttgtaattataatgataaaacaaatggcaaacaatacgatgaataatgatcgtaaaaacaatgaacaaatatacatgcacttttcttttttagaagctgcttctcgtattttttgttttaaaataaacggatctagttgtagagactga

SEQ ID NO: 427 - DNA (genomic), 1488 bp, Enterococcus faecium; double-stranded, circular
  misc_feature (B) LOCATION 1...1488
  hypothetical: NO
  anti-sense: NO
aaatgtccaactgggaaacaaagttcacgaaaaaaaggatttacttttgatgatgtcttattgataccagcagaaagtcacgtgttaccaaacgaagtggatatgagcgtacaattagctaaaaatattaagttgaatattccaatcatcagtgcaagtatggatactgttaccgacagcaagatggccattgctatggcaagacaaggcggactaggtgtgatccataaaaacatgacgatcagccagcaagcggatgaagtaagaaaagtcaaacgttctgaaagtggcgtaatcattgatccgttcttcttaacgccacagcatcttgtagcagacgcagaagaattgatgagcaaatatcgtatcagtggtgtgccaatcgttgaaacacttgaaaacagaaaattggtagggataattacaaaccgcgacatgcgttttgtaacagattatcacatgccgattgctgatgtgatgacaaaagacaacttagtgactgccccagtaggtacctctctaaaagatgcagaaaagattttgcaaaaacataaaatcgaaaaattaccaatcgtagataacgaaggtcgtttaagcggattgatcacgatcaaagacatcgagaaagtgatcgaatttccaaatgcagcaaaagatgaacatggtcgattgcttgtagcagcagccgttggtgtaacaagcgatacatttgagcgtgcgaatgctttattagaagcaggggcagatgcaatcatcatcgatacagctcatggacatagtgcaggtgtgatccgaaaaattcaagaaatccgttcaacttttgcagatgcaacattgattgcaggaaacgttgcgacggctgaagcgacaaaagctttatatgatgcaggtgtagatgtcgtaaaagttggtatcggaccaggatcgatttgtacgacacgtgtggtagccggtgtaggtgtacctcagctcacagctatttatgatgcagcatcagttgctcgtcaatatggcaaagcgattattgcagacggagggatcaaatattctggtgacatcgtcaaagcattagctgccggcggacatgcagtgatgctaggaagtatgttggcagggacagatgaatcaccaggtgaattcgaaatcttccaaggacgtcgattcaaaacataccgaggtatgggctcattaggcgcgatggaaaaaggttcaaaagaccgttacttccaaggtagtgtcaatgaagcaaataaattagtaccagaaggaatcgaaggtcgggttgcttataaaggaagtgttgcagatattattttccaaatgatcggcggtttgcgttcaggaatgggttatgttggggcagccaatctacagcaattacgtgatgaagcgcaatttatccaaatgagcggcagtggattaaaagaatcacaccctcatgatgtacaaatcacaaaagaagcaccaaactattcagttgaatcttaa

SEQ ID NO: 428 - DNA (genomic), 258 bp, Enterococcus faecium; double-stranded, circular
  misc_feature (B) LOCATION 1...258
  hypothetical: NO
  anti-sense: NO
agttcaccaacatcaaaaagtatagagccaaaattccctgaattaaaccaaacattagaagaactagcagctaaatatcaaacgacaccaactggcttggcttctgcttggattttacgccatccagccaatatgcaagtgatcgccggtacgatgaacgtagggcgaatcaaggaaatcgctcaagcttcagaaattaatatgtctcgggaagattggtacgaattgtaccgtgctgctggaaacattttaccttaa

SEQ ID NO: 429 - DNA (genomic), 771 bp, Enterococcus faecium; double-stranded, circular
  misc_feature (B) LOCATION 1...771
  hypothetical: NO
  anti-sense: NO
atggggccaacttgggctgattacagacgctatgttcattctgtccaaactttcggttcagtaaacggacctggactgcgctttgtcgtgtttatgcaaggatgccgcatgcgttgccaattttgtcacaatccagatacttggaatattggcggagggaaagaatacacagcagatgaacttttagataaagcagaacgcttcacaccttactggggagataaaggtggtattactgttagtggtggagaacctctattgcagatcgattttttgatcgaactatttaaaaaagcaaaagagcggaagatgcatactacattggatacatgcggaaaaccttttacgtatgaagaacctttcttttcacgttttcaagaattgatgaagtatacagatttactgttatttgacatcaaacacatcgataatgaagagcataaaaaactaacgcattgggacaatgaaaatattttagaaatggctcaatatttgtcaaaaatcaacaaaccggtttggattcgccatgtactagttcctgagcgaagtgattatgatgaatatttgatccgactagacaactttattcaaaccttgtcaaatgtagacagagtagagatttttccttatcatacgatgggaaaatacaagtgggaaacacttggtttgaaatatccattagaagggatcgaaccacctacaaaagaacgtgtcgaaaatgctaaacgattgcttcatacagaagagtatacaaaatatttaacgcgatag

SEQ ID NO: 430 - DNA (genomic), 297 bp, Enterococcus faecium; double-stranded, circular
  misc_feature (B) LOCATION 1...297
  hypothetical: NO
  anti-sense: NO
caaattacaacaacaataaaccatagtagaacgacaaaaaagccaggaataatagcaacgaaagctcggcttacatttggtggaacgcttgccggcattttaattgtaatatttttaagtacaaaccaccggaaaatttctgtagatacaagtgctacaataataccaacaaaaagacccgaggtaccaaagtattttgttggaaatcctatagaaccatctgcatccaataaaggtgtaagtaaaacatatccactcaaagataataatcctgctgataatgagtctacaccataa

SEQ ID NO: 431 - DNA (genomic), 1503 bp, Enterococcus faecium; double-stranded, circular
  misc_feature (B) LOCATION 1...1503
  hypothetical: NO
  anti-sense: NO
gtaaagacaactaaggaggaatctctcatgacagatcaaccgtatgatttaagaaaagtcatcgaagaactaaaaacacttccaggtcaatatcacgaaacagatattgaaatcgatcctgaagcagaattatctggtgtttaccgttatatcggtgctggcggtacagtaaaacgtccgactcaagaaggaccagctatgactttcaacaatatcaaaggtttccccggcacacgtgtgaacatcggaacaatggctagtcgtaaacgtgtaggtgaaattttgcaccatgattatcgaacacttggtcgtttcttgaaagacgctgtagaaaatccaatcaaacctgtgaaagtagacaaagcagacgctccagcacaagaagtcgttcatctagctaccgatgcagacttcgatattcgcaacatttggcctgcacctacaaatactcctgaagatgctggtccatacatcacaatgggtgtagtcttaggatcagatccagaaaaaacaatgagcgatgtaacgatccatcgtatggttctagaagataaagatacgatcggtatgtacatcatgcctggcggacgccacattggtcacttccaaaaacaattcgaagccttgaataaaccaatgcctatcactatcaatattggtttagatccagcaattgccattggcacgactttcgaaccacctaccactccacttggctacaatgaactatggtgtgcaggagctttgcgtaacgaacctattcaaatcgttgatggtatagcagtcgatgaagtgggtattgctcgtgctgaattcatcattgaagcagaaatcatgccaaatgaaacaatgcaagaagatatcaacacgaactcaggaaaagcaatgccagaatttcctggctatactggggatgctaatccagctgtacaagtagtgaaagtcaaagcagttactcaccgaaaagacaatccaatcatgcaaacaacgattggtcccagtgaagaacacgtatctatggccggtattcctacagaagcaagtattcttgccttggtcgataaagctattccaggaaaagtagtaaatgtctacaatcctcctgcaggtggtggtaaattgatgaccatcatgcaaatccgtaaagaaaacgaagcggatgaaggtattcagcgtcaagcagctattcttgctttatcagccttcaaagaattgaagacagtcattttagtcgatgaagatgttgatattttcgacatgaacgatgtagtttggactttcaacactcgtttccaaggagataaagatatcatcgtgatcccaggaatgaggaaccatccattggacccatcagaattaccagaatataatcctggctctattcgtttccgtgggataagtgcaaaaactatctttgacggtacagttcctttcgatatgaaagaacattttgtacgtgcaaaattccaagaagtagaagattgggaaaaatatttgaaataa

SEQ ID NO: 432 - DNA (genomic), 726 bp, Enterococcus faecium; double-stranded, circular
  misc_feature (B) LOCATION 1...726
  hypothetical: NO
  anti-sense: NO
aactttgcaacagaacccaaattattaagtattaatgcttggaatgatgatggaaatactttaactaaatttgttgctttcacaaaatatagcattatacgagataaacaacttgttataatttcagttaatccagaatttaaaggactttttaatcaattaaagaactggacaagatttaatctagagcaatttactaatttggatagcacatattcaaaaactatgtttcgattattaaaacaatatcgaactcaaggctggactgaattttccaaagaaaaattttttgatttactagatattcctaaaagttattggaatagtccgtcaaatattgacaaatttatcttaaggccaattaaagaagaactcactcccttatttaaaggattaactattcgtaaaaaatatggtaaaggtcgaggtaaacctgttatcggttatcgttttacttggaaagctgaaattaaccatgctgacgatttttccaaagggaaacaagaagatttacgtataaaattatttaatattgatcacaatggagaattaacacgagaagaaaaatggcgcgctaaagatcgaatactaaatcttcccttaggcactcatgaagctgattttaaacaacaacaacaaactgaagaaaaacaggcagaaaaacgagaactttcaaacaaactcaaacaagatttactaggaaatttacaaaacttattcgattaa

SEQ ID NO: 433 - DNA (genomic), 633 bp, Enterococcus faecium; double-stranded, circular
  misc_feature (B) LOCATION 1...633
  hypothetical: NO
  anti-sense: NO
aggaaagcaactgggcccccagcctggaaggaatactatcatccggtgcgttttacgcgaatgctgacggttgcgccaagctgggaaaactaccagacagaagatcctctagaaaaaattatcacactagatcctggtatggcatttggcacaggcactcatcccacgacttccttgacattgacagcactagaaacagtcttgcgtggtggtgaaacattgctagatgtgggaactgggtcgggcgtgctaagtattgcagcaaaatatcttggtgcaaaagatgtctatgcctttgatttagacgaagtagccgttcgttcggcgaaagaaaatatggatatgaatgaaatagccaaagatgtccatgtatcagctaacgatcttttgacaggaatcgagattgaaagtgatgtaatcgttgcgaacattttagcagatatcatcttattgatgatcccagatgcttggcgtttactgaagcaaacaggcacgctgatcgtttcaggaatcattgaagagaagaagcaaatggttctggatgccatgttagaacaagggtttatcgtggatcaaattttccagcaaaaagactggtatgcaattattttgaaaaaaccagaggtggaatag

SEQ ID NO: 434 - DNA (genomic), 1161 bp, Enterococcus faecium; double-stranded, circular
  misc_feature (B) LOCATION 1...1161
  hypothetical: NO
  anti-sense: NO
tctttggcaacctatttgaanatatgtccggctcctcagacaagaatgaattgtgtgactcttctcacagacggacaagagaaattggattcactgcttcaagatctaaaaaaagccaaacattcgatccatatcgaatattacgcatttgtgacagataatatcggccagcaagtcttacatgttttagaagaaaaagccgcagaaggcgtggaagttcgaatattatatgatgcatttggctctcatggcacaaaagcaaaagatttcaatcgtctaatcaaaaatggtggacatgtccatacatttgttacctcacaaagggcattacttcgtttccgattgaattaccatgatcaccgaaaaatcgttgtgatcgatggaaagattagttataccggtggtttcaatattgccaatcaatatgtaaatacaacaaaaaaattcggctattggcgcgatacgcatatacggattttcggtgccgcttcttctttgctccagcttcgcttcttaacagactggaacgtctcggtacctgaagaaaaaaaggtcggctatcatttgaattatttctttaaaaaagcagatcgagatgaatctaagcttgctgatacatccatccagcttgtttcaagcggaccgaataacgaaagggaacaaatcaagctttcatttatcaaattgattacttctgctaaaaaacgtgtttggatacagacaccttaccttgttcctgatgaaagtgtcattgctgctttaaaaatcgcaactgcctctggtgtagatgtgaaaatcatgattcccaacaaaccggatcatccttttatttatcgagcaacacaatattatgctcggcagctgatcaaggaaaatgtacaaatccttgtctatgagaacggcttcctccatgcaaaaacattgataatggatgatgaaatctgcatggtaggttcagcaaatcaagatattcgtagctaccgattgaattttgaaacaagtgctgtcatttacgatcctgagtttttagaagaacttgctactcagttcaaagaagatgagacacattgttcatccatgacaactgaaacagtcaaggaaatgtctaactggctattattcaagcaacaaatttctcgattattttctccaatcctataa

SEQ ID NO: 435 - DNA (genomic), 417 bp, Enterococcus faecium; double-stranded, circular
  misc_feature (B) LOCATION 1...417
  hypothetical: NO
  anti-sense: NO
tcctgggcaacccttggtgaatacatcggctttttcgctaacaatagtgctcacgaaagatttgaaaggagaaagaagatgacattaccaaattgcccagaatgtggctcagagtacacatatgaagatcgaggcttgttgatttgcccagaatgcgggaacgaatggaacaaagaagaacaagaaactgtcatagaagacggattagtggtattagatgcaaatggaaaccgtctgttagagggcgatagcgtgacagtgattaaagacttgaaagtaaaaggtgcgtcaggtgccattaaacaaggaacaaaagtcaagaacatccgtttagtagaaggcgatcataatatcgattgcaaggtagaaggatttggaccgatgaaactgaaatcggaatttgtgaaaaagaattaa

SEQ ID NO: 436 - DNA (genomic), 678 bp, Enterococcus faecium; double-stranded, circular
  misc_feature (B) LOCATION 1...678
  hypothetical: NO
  anti-sense: NO
catggagggtttattatgataaaacgaaattggccgtggcttctagcattggtcttgctatttctctttgtccgaaacaatagtttttcttttgttctaggacttttattgataggtgtagttttagttttgtggggactctttggttcgcgcaggaaaaagggaaaacaagaagaaattcctgcactgactgacgaacttgaaactcactatgaaaaaagcggtatgacagcgaatgaaatttcattttttcgacaaacaatgaatcaaacaaaaaatgagatcaatcaattgcaaatgaatatgcagcagacagccaaacttaaagcaatcgatctccgccatgatccagtcaaagcagcgaaagctttattcaaagaattggtgaaagaaccaaaccgactgcatgaagcaagtcagtttctttatacgcatctgccgaatctagttgatttgacaaataagtataatgagatcaatgaccatgagatcaaaaacaaacagacctatgaaaaactagaagaaagcgcgcagatcatcgaccagctgtcagctttaatcgcacaagattatcaaaaattcgttgctgaggatctagatgatatcgacgtagagatatctgttgcgaaacagagcttaaagcgtgataataaatatgaaccagaacaaaaggattaa

SEQ ID NO: 437 - DNA (genomic), 879 bp, Enterococcus faecium; double-stranded, circular
  misc_feature (B) LOCATION 1...879
  hypothetical: NO
  anti-sense: NO
agatatcaaacagtatgcggacagacagatccgactggtgagaaaggaggattctcaatggcgttgctttcatatgaattcatgagaagagcgtttcttgccgctatcttcattgccggaatcgccccgatgctaggtgtgtttttagtgatcagaagacaatcgctgatggctgatacgctttctcatgtctctttagcaggggtagcgttaggattctttttgaaccttaatcctacacttacgaccatgctagtcgttgtattagcagctgtgatattggagtatctgcgaacgatctaccgaacctattcagaaatctccattgccattttaatggctggtggtttggcgctagcgttagtattgatgaatttgagcggagggaattcagcaacaagtatccaatcctatctgtttggttcgatcgtgaccattacatgggagcaagtcatctttttaggaatcttattcgttgccatcggtatattgttctttttattcaaacggccgatgtatgttctgacttttgatgaagataccgcccacgtggatgggctacccgttcatttgatgtcgatgatgttcaatgtgattactggtgtggctattgctgtgatgatcccgattgccggtgcacttttgatatccgcaatcatggttcttcccgcagcaatcggtatgcgattaggcaaaagcttcaatgtcgtgattgctatcagtgtttgtgtaggatttctagggatgctgtcaggactaactagctcgttttatctagatacacctccaggagcaacaatcacattagtctttattgctttgttccctgattgtaaatatcatcaaacgaatattggttgccttcagaagaaaaaataa

SEQ ID NO: 438 - DNA (genomic), 990 bp, Enterococcus faecium; double-stranded, circular
  misc_feature (B) LOCATION 1...990
  hypothetical: NO
  anti-sense: NO
aaaaatcaaacaaaaaatatttttgtaaaatctatttacaaaaaaatttttttgtataatgagggtataagaaatggaggcgctatcatggaaattggtgtaattggtttgggaaaaatgggattgaatttagctttaaacttaaaagaacaccatcacaaagtacaaggactcgacatttcaagtacagctgttaatcaggcaagagaaaatgacattcctgcttatcaagagatctctgaatttctagctacttttgagcagaaaaaaatcatctggttaatgcttcctgctggagagataaccgaaaacatgttaagaaaactttttccaaaactcggaccaggagacattattattgaaggcggaaactcttattataaagattcaatccgtcgagcagaaaagtttcagaaaaatgaaatcggttacttggattgtgggacttctggaggaatcgaaggagcacgacatcaagcctgcttaatgattggaggagataaagaaacttttctatccgtggaacaattattcaaagatgtagcaattgaaagaggatatctgtatgctggtgcatccggaagcggacacttcttgaaaatgatccataatggaatcgaatatggaatgatgcaagcaatcggtgaaggattccaacttgtacaaaaaagtgagtatgcttttgacttggaacaagtcgcacgtgtttggaatcatggttcggtgattcgcggctggctgatggaaatcatggaagatcagttaaacgaacatcccaatttaagtaattatcggggaatcgtttctgcatcaggtgaagcaaaatggacggttgaaacagcgctagaaatggctgttccagttccagtaattgcaactagtttgttcatgaggaatctttcacaggaagaagatagtttttcagcaaaagtagtttcagcactaagaaatgggtttggcggacatgaaatagttgaaaagggtgagtaa

SEQ ID NO: 439 - DNA (genomic), 201 bp, Enterococcus faecium; double-stranded, circular
  misc_feature (B) LOCATION 1...201
  hypothetical: NO
  anti-sense: NO
tccatacaaacaaatcattgtttcaatgggttcaggagctactgcagctttaggagcattcgattatctgatgcgcacttgagctatgaagattgtaaaaagtcagagagcggaaaaaaggatggtgacaagaattttgtcacaatcctttttgtttttttgaataatcgctttttcttctctttttcttatatactataa

SEQ ID NO: 440 - DNA (genomic), 1263 bp, Enterococcus faecium; double-stranded, circular
  misc_feature (B) LOCATION 1...1263
  hypothetical: NO
  anti-sense: NO
cttagtaaaacaaataatcaaaaaataaaggcggtggtcttagtgagtaagaaaaaagaaccaaaaaaattgtctcatccgtcttctgatgaaaacaatttgactccttggcaaaaggctaaccgaaaatatctggcagaacaagagatgaaaaaccaagagccaaaaaaagaagacataacattagatacacccctttcagattctgaagaagaaaaaacggttcaagaggaacagcaagaagaaagccagtccgagaaaaaaatcgaattttttgaagagatcaagcaaaagaaaaacggtggaccatataacggttcttttttgaaccggctgcccaatttaaaaagtcaacggcacaaagtactatttcgtcggttagctttgatcatcactgtattgggtataccgctgatttttttgatctattatgtttctccttatagcaaattacaagcagttgcagtatcaggcaataagacagtcaacagccaagaaatcatctctgatacaaaattgtcattaggagaaaatgtttggggacagtattttcatcgatctacttatatcgatcgccttaaaaaagcacagccaagaatcgaaacagcaaatatacatttcaaagggatgaatgaattcgatttggatgtaacagaatataaagagattgctttgatcgcaaaaaacaatcaatactacccagtgattgaaaatggaacagtattagatgaaaaagtagcaaatcctacaaaaaatctccctatcttggaagagttcaaagactctgcaaaaatcaaagaattaacaaagcaatacaatcagttatcatcagaattacaaaaagcaatttctgaaatcaagtacacgccaagagcaagcaataaaaatctgatccaattgaatatgaatgacggcaatcaagttattgtaaatatcaataatcttgcgaaccaaatgaaatattattcgcaagtagccaaagatatggatgaaaaaggtgtgatcgacatggaagttggtatcttctcgcatccttacggtagcactcaagaaacggaagaatcgggccaatcggaagaaacaactgaaagtgaagaaaatgcggatcaaacaaacgaatcaagtgaagaggcagaaacgcaaaaagcacaaacacctggatcgtctagcacaaacggatcatctgattcaaatgattcaagtgaaacaagtcaaatagaagataatccaagtacaactccgtcaagtttaaatgaaaattga

SEQ ID NO: 441 - DNA (genomic), 2403 bp, Enterococcus faecium; double-stranded, circular
  misc_feature (B) LOCATION 1...2403
  hypothetical: NO
  anti-sense: NO
agatccaaaacacctggcgaattcaaagaacaaatgccatatatacgtgatttgttgacaggactaggggtacagtattacgaattgcccaattatgaagcagatgatattatcggtactttggcagaaaaagtagacaaagatcaatttgatgtcgtcgtgctttcaggtgatcgggatttgactcaattagctagtaaagaagtaaaagtggatatcactgtaaaaggtgtcagcgatatcgaaagctatacaccagaacatgtagcggaaaaatatgatgggttgacgccaaaacagattattgacatgaagggactagccggagatgcctctgacaatatccccggtgtgactaaaatcggtgaaaaaacagctatcaagctattgaaacaatatggctcagtcgaaggaatttatgaacatatcgatgaaatgaagcaaagcaaaatgaaagaaaatctgataaatgacaaagagcaggctttcttatcgaaaaaattggcgaccatcaatacttcagcgcctgtggatgtctctatcgactcattgaagtatgaagggaaaaatctcgataaactcgttccgttttataaagaaatggatttcaatcagttcctttctaaattgaatatcgtagaagaagaagtaaaaatggatgatattttgtttgaagtcgttcatgaattcaaagaggaaatgtttactacggatatggcgttgtacgtggaaatgatgggcgacaattatcatacagaggaaatcgtcggagtagcgtgggggacagaaaagaaaatttatgtcacgaacgatctatctgtattcgaaaaccgagcgttccattcttggatcactgatccgactcggctgaaaaaagtatatgatgcgaaacgaacttatgttgctttaaaccgctatactggaaaaacgaaaggaatcgattttgatgtcttgctaggtgcataccttctcgatacgaatgaaaaaagcacagatatcgaaggaatagctgctcattacggatacaacgatatccaatcagatgaagctgtatacggcaaaggggcgaaaaaaggtttaccagaagaagaggaactcttttttgctcatttagcgcgaaaagtagctgcaatcaatgcgttgacaccaaaattgagccaagaactggcagaaaaaaaccaagaagatcttttccggaaaatggaactgccattgtctatcattttggcagagatggaaataagcgggatcaaagtagatgcgactcgcttacaagaaatgaagggcgagttctctgctcgcttaagagagatcgaacaaaaaatctacgaagaagccggcgaagaattcaatttgaattcaccaaagcaattaggagtgatcttatttgaaaaaatgggattacccgttatcaaaaaaacaaaaactggatattccacagccgtagatgtactggaacagcttcgtgaacaagcaccaatcgtagaggatatcctcacctatcgtcaaattgcaaaaattcaatctacctatgtcgagggactgctgaaagtgatccaatcagatggaaaagtgcatacccgttatgtccagacattgacccaaacaggacgattaagctctgttgatcctaatttgcagaacatcccgattcgattagatgaagggagaaagatacgtcaggcatttgttcctagagaaaaagactggctgatttattcttctgactattcacaaatcgagttacgcgtacttgcgcatatctcaaatgatgaacatttgaaagctgccttcctagaaggtcaagatatccatgccagcacagcgatgcgtgtatttggaatcgaaaaggcagaggatgtcacaccaaatatgcgtaggcaggcaaaagcagtgaattttggtatcgtgtatggcatctctgattacggactttcacaaaatctaggaatcagccgaaaagcagcacagcaatacatcgatacgtactttgaaaaatacccaggtgtcaaagaatatatggaaagaatcgtacgcgaagcaaaagaccaaggctacgtcgaaacgctgtatcaccgccgtcgatatctgccagacatcaattcaagaaattacaatatccgttcttttgcggaacgaacagctatcaatacaccaatccaaggaagtgctgctgatattttgaaaatcgcgatgatcgaattggataaacgattaaaagaaacaggtcttcaagctacgatgctgttacaagttcatgatgaacttgtcttcgaggtaccggaaaaagaacttgaatcattagataaattggtgaaggaagttatggaacaagctgtttctcttcatgtaccactgatcactgacagcagttggggaaaaacgtggtacgaagcaaaataa

SEQ ID NO: 442 - DNA (genomic), 663 bp, Enterococcus faecium; double-stranded, circular
  misc_feature (B) LOCATION 1...663
  hypothetical: NO
  anti-sense: NO
tcgaccaaaacatcaccctaccaaaggagtcgctctatggataatcatactagaaaattactcggattaacagataaacatttattttttgatgaagaatggctgattgccaaagaatataaaggcgttcaagcgcagtttattaaagggagattggatgactcaccttcccattgtgaacactgtggatcgattcgtattatccgcaacggttcctatacgacacgtactcagatgttgaaagtcaaagaaaagttgactattttagaattaagacgtacccgttttctatgctatgattgtgggcagaccttttctgcgaaaacggacttagttgatgaacatcatcaactaacaaaggaactgaagcaggcgattctcatagaactgtacgaaaatcaatcacgtaatctgaaaatcagaagaagtaccgtcggctcaagcgatattggaaactcttactcaaagattccacgacattggagccgctcaaacggcattatcatcgactgtttaaacgaccaattagtcaaacagaaatcgtcgatgaaccgttgtgcacaatggtgtcgtgaacgtacagcgacaccttccatatccagagcagtcgccacatcacggggatggatgccatccaaattaaaagcaaccacgccagtatga

SEQ ID NO: 443 - DNA (genomic), 363 bp, Enterococcus faecium; double-stranded, circular
  misc_feature (B) LOCATION 1...363
  hypothetical: NO
  anti-sense: NO
atgtacaaaacaaaactattaaaccaactcgatagccttgaattagaggaaattaatcaagggatcgctgaactagaaaataatatcgggaaaacctactttggaaattcattcaatgaaaaactaacagttttgtatgtactcaaaaaacatgcagaacacaaaataatttgtcgagaaatcaacgagctaaaaaatcagattttaaccgcatggttaaacattactgatatgcaagaagcaagggtgaaaacatttaatacatgggtaaagtatcagaatcaattaaaaggtgctgaatttgttcgggatgggttgaaatacgaacttgagcagttgaagctcatggaggtgtctgaatga

SEQ ID NO: 444 - DNA (genomic), 1353 bp, Enterococcus faecium; double-stranded, circular
  misc_feature (B) LOCATION 1...1353
  hypothetical: NO
  anti-sense: NO
gggcgcaaaacaaaaccggcgcgggctttccctttcctgcgggatgcaagaccttacgccgtaggtattcctgcggcgcaacgtgtttcatccggcaggagaaaacaaataaggcggccagggccgaaagaagtgatgaaaatgcacatcaacattgacgcaatccaggtcaattccgggcggcgggaagccctgccggaagccgtgcgcgaactggcggacagtatttcggcggtagggctgctaaatccgatcaccgttgaccgggactataccctgattgccggactgcaccggctggaagcggcaaagctgcttggctggtcggaaatcgagtgccatatcagcacattggagggcttgcaggcggaacttgctgagattgacgaaaactttgtacgcaccgatctggaaacggtggagtttggaaagctgctgatgcggcggaaagaaatctatgaaatcctgcatccggaaacaaggtgcggcgtgtcgcaggcaaacgcaatgaaccgcgcccagggcaacaacgtgagcgagcgcggcgcgtccacgtcaaagtcctttacacgggacacagcaaaaaagctgggcatttccgcccgttcggtggaagaaaatatccagattgccagggatataaccccaaaagcgcaggaagtcattcagggttccgaccgcaaaatcaagaaaaaggacttgctgaagctgtcccgcatggagccggaacagcaggaacacgccgccgcacagttggcggctggtaaaatcaagtccgcagacgagtttcaaccggcagaacctccgggacttcccaaaccggcgcggaaactggaacaatccaaaccagcaccgaaactgaaacaggcggaaccaaggcaggagccaaagtaccccaagccaatgccggaaccgaaacagcccgaaccaatcccggagcaggctgagcaaacgcagaaaccagaacagtccaaactgacacagaaaccagaacaaacggaaccggtgcaggaacaagggcagacctcagagccgattacaaaacttccctcgcagccctccgttccctatacgctgggcgatcagcactatgacactttggaggaatccatagccgacctgaaaaacccggataaggattgcagctacacgccggacacgcttctggcagacatcgacggctttgtgcagacctttcacaagggcttcgcatggtatcacgacccgttctgtactatcgtgttcccgcgcatttccaaggtacagtttgaatttgtccggcagcgctttgaaagcatatctactgcgatggaggaattattaaatcaaatggaaaggacaataacgacatga

SEQ ID NO: 445 - DNA (genomic), 2145 bp, Enterococcus faecium; double-stranded, circular
  misc_feature (B) LOCATION 1...2145
  hypothetical: NO
  anti-sense: NO
attacaaaaacaactgtaggaagaaggcggatatcgatggccaaaatccaagaattatctgaacgtttagctaatcagatcgctgcgggagaagtagtggagcgaccagcttccgttgtgaaagaattagtggaaaatgcaattgacgccggcagtactcagattgatatcttagttgaagaagcgggactgcggacgatccaagtgattgataacggagaaggcattttggcagacgacgtagagaatgccttcaagcggcatgcgacaagtaagatccataatcgcgacgatctttttcgcatacgaacgctgggctttcgaggggaagctttgccaagtattgcctctgtttctgaaatgactctggaaacggcgaatcaggaagaaaaacaaggcacctatctgtcgctgaaaggcggagaagttattgagcatcgaccagcaccactgcgtcaaggaacgaagattaccgtcagcaatctgtttttcaatacgccagcccgcttgaaatacgtgaaaacactgcacacagaattagcgaacatcggggacatcgtcaatcgactggcattgagtcatccatcgattgcttttcgtttagtacatgatggaaacaaaatgctggcaactgctggaaatggcgatctgaaacaaacaattgcgggaatctacggattatctaccgcaaaaaaaatgctgaaaatcgaaggaaaagatctagattttgagttatttggctatgtttcattgcctgaggtgactcgtgccagtaggaattacttatcgacgatcatcaatggacgttttatcaagaacttttccttgaataaagcaatcgttgcaggttatgggtcaaaattaatggtcggtcgtttccctattgctgtattggaaatcaaaatggacccgcttttagtagatgtaaatgttcatccgacgaagcaggaagtccggctgtcgaaggaaaaagaactaacagagctaattagtaacgccattcaaaaagcattgtctcaagaaaatctgattccaagtgcagcggataatctacggtttaagaaaaaagtacctgatcagcctaaaacagaacaaatcgaaatcgatttgtcctacgcttttgaagaagaaaaacctaaaaagccaagtagtttgaattttgatcgagagacaggtacctttttcgtagaagaactaaagaacacatttgttgacagaattgttgataagtctgtggaaaatgttgaaaactattctggtttttctgaagaaaacaccacttatccagaaaaaacagcgaaaacggtggataagtttggtgaaaatgttgataactttgtagaaaaaacagtggaaaaatctgaaaagaaagaatttcccattgtggataacatggagaaaacaaatgaagaacaagcagataaatccgtagaagaggatgaaaagatttacgaggaagaattgacactccatcctgaatttgatttcactcaaggaaacgacaaaacattagaacaagccatcaagaaattagaaacggaaaaaccagtacaacgttttcctcagttggaatattttggacagatgcacggaacgtatctttttgcccaaagtagcgatgggttgtacatcattgatcagcatgctgcccaagagcgcattaagtatgaatatttccgggaaaaaattggggaagtatctgatgatctgcaagaattgcttgttccatttgtgttagactatccaaacagtgatgctttgaaattaaaagagcaaaaacacttgctagaagatgcagggatttatttagaagaatttggtcaaaacagctttattgtacgggcccatcctacttggtatcccaatggagaagaagaatcgattattcgggagatgatcgatatgctgctgacaactggaagtgtgagtgtaaaaaaattccgtgaagcaacagcaatcatgatgagttgcaaacgatcgattaaagccaaccattatttgaatgaagcacaagcacgtgtgctgctgaaggatctggcacgatgcgaaaatcctttcaattgtccccatggccgtccagtattgattcactttaccaattcggatatggaaaggatgttcaaacgaatccaagacccgcattaa

SEQ ID NO: 446 - DNA (genomic), 201 bp, Enterococcus faecium; double-stranded, circular
  misc_feature (B) LOCATION 1...201
  hypothetical: NO
  anti-sense: NO
gagcaaaaaactggaggtttatcaggtaattggtctaatggatttaagtatgcggtcaccgtgtatagagttgcttctgagattcaagaaaataaagttattccagtattgctatatggaacacataacaatttttatgaattagccgagaacactcgcaactttattcgtgtagataaatcggcttcggttgagttataa

SEQ ID NO: 447 - DNA (genomic), 435 bp, Enterococcus faecium; double-stranded, circular
  misc_feature (B) LOCATION 1...435
  hypothetical: NO
  anti-sense: NO
aataaaaaaacatccttatcgagtacaattataaggagcaaaaaaataaaactcatcagaaaagaggaagaagatatgacgatactatcgaaaattttagtgactctagttgcaattgaatttttttatatcatgtatatcgaaacggtgagaactgattctgacacgacaagtagggtttttaaaatgagtaaagaagagttaagcagaaaatctgttcaaacattgtttaagaaccaaggagtgtacaatggactattaggagtgggactactttatggagcttatctttcttccgcatctaaagaaatcacaagtatgctattaatatctattttttttgttgcattatatggcagtttgactagcgatcgttggattttactcaaacaaggtgggctagctctgttggcattgctttctattttcttataa

SEQ ID NO: 448 - DNA (genomic), 675 bp, Enterococcus faecium; double-stranded, circular
  misc_feature (B) LOCATION 1...675
  hypothetical: NO
  anti-sense: NO
ttcaaaaaaacagaagaaaaaaacaactacaccttcttttatactcgtaatcgtagaaaggaggcgaaaaaaatgaatacattacctatcaatacaggagatacagcattcatgattttatgtacagcaatggtttgcctgatgactcctggtctagcttttttttacggcggattagcacggaagaataatatactaacgatcatgtctcaatcttttctctccgttgggataacaacgattatgtgggtatttggtggattcggattggcctttggacgggatatcggcggtgttattggaaacccggcagatttctttttgatgagacatgttacaagcttccccaacatgtttcatggtgcaacgattccatttttaatgttctttctttaccaactgatgtttatcgtgattaccgttcctttgatgacaggagcttttgcagggagattgaatttaaaaggctatattatacttgttattttttggaatctgctgatttatttccctgtttgccactggatatggggtggcggatttttggatcagatgggatttagagatttcgctggtggagcagtcatccacacgacagctggattcggctctttagcatgtatcctcacacttggtcaaaagaaagattcctttaggagaaagaagtcagcatag

SEQ ID NO: 449 - DNA (genomic), 468 bp, Enterococcus faecium; double-stranded, circular
  misc_feature (B) LOCATION 1...468
  hypothetical: NO
  anti-sense: NO
atgaaaaaaaccaaaatcgttagtacattaggaccagcaagtaactcagtagaaattatttctcaattgattgaatctggggcaaatgtcttccgctttaatttttctcatggtgaccatgaagaacaattatcacgtatgactatggtccgtgaagcagttaaaaagacaggaaaagatgtcggtattcttttagatacaaaaggagctgaaatccgtacaactgttcaaggcacaacagaagctgattttggtcgtgcaggatacatcaaatttgaagtaggagatcaaacacgcatctctatggatcctgaacatgtaggttcaaaagaaaaaatcgcggttacttacccaggattatttgacgatgttcacgttggcggacacattttatttgatgatggtttgatcgatatgcaaatcattgaaaaagacaaagcaaaccgtgaattagtcgtagaaagttaa

SEQ ID NO: 450 - DNA (genomic), 993 bp, Enterococcus faecium; double-stranded, circular
  misc_feature (B) LOCATION 1...993
  hypothetical: NO
  anti-sense: NO
gctatgaaaacaaaacaacagaaggctgttctttctaggcatcttgctaaatatgatataattaagggacgtaaaaacaagaaggaggaaaatcctatgcaacagccattggcttatcgcatgagacctcgaacgatcgatgaagtcgttggtcagcagcatctagtcggggaaggaaaaatcatacgccgcatggtcgatgctcgcatgctctcttccatgattctatatggacctcctggtactggaaaaacgagtatcgcaagtgcgatcgccggctctactaattatgcatttcgcatgctaaacgccgctacagattcaaaaaaggatctacaagttgtagcggaagaagcaaaaatgagtggtacagtgatcctcttattggatgaagtacaccgattagataaaacaaaacaggattttctgcttcctcatttagaaagtggccgaatcatcttgatcggagcgactactgagaatccttatattaccatcaatccagcgatccgcagccgtacacagatctttgaagtcaaaccattaacagaacaagacatccagttggcagtcgaacatgctttaagggataaagaacgcggccttggacaacaagcaatccagttagacgaagatgctcttcttcacctttcgcgtgcaacgaacggcgatttgcggagtgcattgaatgggctggaactggctacactatcgactccttcagataaagaaggaaggatnnnnnnnnnnnnnnnnnnnnnnnnnnnnnnnnnnnnnnnnnannnnnnnnnnnnnnnncnnnnnannncnnacnnnnnnnnncnnnnnntccccccccanaaaancncccccnccccacccaccaagggcgggcggccncggggggnnnngcanncccccccgagaaaaacccccgggtgggggaaaaaaagtttggtgggacaaacggaaaaagtccgccctctaaggaggggtaatatgcagggggggtaa

SEQ ID NO: 451 - DNA (genomic), 678 bp, Enterococcus faecium; double-stranded, circular
  misc_feature (B) LOCATION 1...678
  hypothetical: NO
  anti-sense: NO
caaatgaaaacacgcgtgttatttattggtgacagtattacagacgcaggaagagaccgttcagaagcaacggatttaggtaaagggtatccgcttttgattgccgggaaactaatctcacgatatccaacgatggaatttgaatgtataaaccgtgggataggaggagacaaaattgcagatctgcaagcgcgctggcaagaagattgtttagctctgcaacctgattatgtatcgattttgattggaatcaatgatacgtggcataatactggagatcaagctatattcggcactgagaaatctgtgcagcaatttgaatccgtttatcgagagttactaaatgaactacaagcagctggaatctgcaatatcgtattaatggagccttttgtacttcctgtgacaaatgatcgttatgggtggcgcaaagacttagaccctaagatccaaaccgttcgtaaactcgcaaaagaatatggcacattactgattcctttagatggaatattcaatgctttaggaatcgcttatggtttttcgaaatatacaaaagaagatggcgtgcatccaacgattggcggacacgagattattgcacaaagttggatagatgcgatttccgcagttgattcttttagtggaaataaaaatgaacgaaagaaaagggagaaatga

SEQ ID NO: 452 - DNA (genomic), 489 bp, Enterococcus faecium; double-stranded, circular
  misc_feature (B) LOCATION 1...489
  hypothetical: NO
  anti-sense: NO
gaaatgaaaactaagcaattaacgatctatgctatgctgattgcgttgacagttgccctttcattaacaattttgatccctgtaccggctacgaatggatttgtgacattatgcgatgccgggatctataccgctgcttttctttatggtccaacgggtggattagttgttggtgcttccagtggtctattgatcgatttgatttcaggatatccgcagtgggcagttttttcattagtgatccacgggtttcaaggatatgttgccggtgcttgcatcaaatctcctactcgtatgtggggattagggcttttattaggaagcttagttatgatcatcggctatggtatcgccggttggattttatatgattggccggctggagtggcttctataccaggaaacatcttccaaaatctgattggaatgggacttgcctttcctataactgcaagtcttcaacgtattcaagcacggaagcaatattaa

SEQ ID NO: 453 - DNA (genomic), 333 bp, Enterococcus faecium; double-stranded, circular
  misc_feature (B) LOCATION 1...333
  hypothetical: NO
  anti-sense: NO
ttggtgaaaacactagggtgggagttgtcaaaggctaaaaatcgcaaagtaggatttgttttaggtttgacgggtggaatagctaccggtaaaagtacggcagccaaagtctttcagtctcatggatttcctttgatcgatggcgatgtgattgccagagaaactgttgagcctggaacgcttgctctgaggaaaattgtatcagtgtttggccaagaggtattgcagcctgatgggcaactagatcgagggaaacttgggatgattgtttttccatcaaaggaaaaacggcaaaaacttgatcagctattagatccgtttatccctttttga

SEQ ID NO: 454 - DNA (genomic), 681 bp, Enterococcus faecium; double-stranded, circular
  misc_feature (B) LOCATION 1...681
  hypothetical: NO
  anti-sense: NO
agcattgaaacacattctggtttcgcctataattcagacatcgagatcgattggatcaaagcacaagaattaacgagagaaaatgtagaagaacgtttgaaagacgcagatggaatcttggttcctggtggatttggtgatcgcggagtagaagggaaaatcgaagcgattcgttatgctcgcgaaaatgacgttccgtttttaggtatttgtcttggtatgcagatggcttgtgtcgaatttgcacgtaacgtcgttggattagaagatgcgtcatcagctgaaacgaatccagatacagcaaacaatattattgatttaatggctgatcaggaaaacatcgagaatttgggtggaactttacgccttggattatacccatgtaaaatcaaaaaaggaacgaagacggctgaagcatatggtggagccgatgttgtgcaagaacgtcaccgtcaccgctatgagttcaacaacaaatatcgtcaattgtttgaagaacaagggctagtcttttcaggtgtctcaccagataaccgtttagtagaaatcgtagagctgccagagaaaaaattctttgtgggatgccaattccacccagaattgatttctcgtccaaatcgcccgcaaaaattaatcaaagcatttgtcggagcatcattagcagatcacgaaacaaaataa

SEQ ID NO: 455 - DNA (genomic), 573 bp, Enterococcus faecium; double-stranded, circular
  misc_feature (B) LOCATION 1...573
  hypothetical: NO
  anti-sense: NO
tttgatgaaacactcgcgcgaataccaaaacaaaatgaaggaggaataagtgtgatcgaaggagagacacggcgaaaacaaatcatgcaaaccttggcaaatacagaaaaaccagtgagtgctagcaagtttgcgaaaacttttggagtcagccgtcagatcattgtaggcgatattgctttactacgagctgcaggtaaaagtatcgtggcaacagcaagaggttatatcctcgaaacagaagaaaccaatactgggcacatcagtaaaatcgctgtccagcatggaaaagatcaaacagaagaagaactgagactaatcgttgaaaatggtggtgaaatcattgatgtaattgtggaacatcccctttacggtgagttagcaggaactttgcacatcaaaacgccacaagatatcgattcctttatgagacgttatcaaaaaagtaatgctactttgttatccgaattaacaggcggcatccatctgcatacgatccgctacccagaaaagcatatgctgaaaaacatcaaacaaaaactagctgaagcaggaatcctttacgaaggataa

SEQ ID NO: 456 - DNA (genomic), 732 bp, Enterococcus faecium; double-stranded, circular
  misc_feature (B) LOCATION 1...732
  hypothetical: NO
  anti-sense: NO
atgaaagaaacgagacaatttatatggacatacattaagattatttttgccctcttcatattaggagtcgctatcaatatgtttttagggcctcatcatattgctgctggaggtgtcagcggtctaggaatattactggaagctgttttaggatttgaccgagctatagttattttagtgttgaatatcgttatgttggtactagctcttctatttttaggtaaaaaacccttttttaaagtacttttcggaagcttgttttttcctttaatcattgcaatagttccagaaacaatgattacttcagatcggttgttgtctgtcatttttggaagtgcgatttttgctttaggagttgcgattttatataaaaacaactcttctagcggcggtacgacgatccctcccctcatttttaaaaaatatttccacttgaatacttcgattggcttattttttacagacgcattcgttgtttctcttaatctgtttgtttttggaatagaagagtttctttatgctattttatctattgcaatcacttcaattgtcatgacttatatcgaaacaggtatcaatcgaaagaaatctgttatggtcatgagtgaacattatttggaagacatccgccttcgcttaagtgctgagattggacgtggccttaccctgctagaggcaaaaggcgggtatagatcgaaagtcaaaagaggttttattgatcgttgtgactga

SEQ ID NO: 457 - DNA (genomic), 732 bp, Enterococcus faecium; double-stranded, circular; identical to SEQ ID NO: 456
  misc_feature (B) LOCATION 1...732
  hypothetical: NO
  anti-sense: NO

SEQ ID NO: 458 - DNA (genomic), 411 bp, Enterococcus faecium; double-stranded, circular
  misc_feature (B) LOCATION 1...411
  hypothetical: NO
  anti-sense: NO
gaggaagaaacaaacatgaaaaaaggaaaagtaatcaattcagatatttcacgagtaatcgcacaaatggggcactttgataaattaagtatcggggatgcaggcatgcctgtcccctttggtactgaaaaaatagatttggctgtctcaaacggtcttccaagttttttatctgttttagaaaacgttttagaagaacttgaggtacaatcgattgaattggcggaagaaataaagacaatgaacccggaaatattggaaaaaatcaaattattgttaccagatacaccgattagctttatcccacatgaagaaatgaaaaaagagttgaataactgtcatgcatttattcgtacaggcgaaatgaacacttacgccaatattatattagtgagtggagtggtcttctaa

SEQ ID NO: 459 - DNA (genomic), 228 bp, Enterococcus faecium; double-stranded, circular
  misc_feature (B) LOCATION 1...228
  hypothetical: NO
  anti-sense: NO
cacatggaaacagaatggcaaagacgtgaaagaaaaaaacagaaaaaagaagagatgttacgattatgtcgattattagatgtaaaagactgggacaaaaacgagcaaattgcacaaaaagtacgatcaatcatccataaagaggaaaaagttaaaaataaagacacgcgtagaactgaaaatgaaaagagaaaagtacaaaagaaaagagaaaaatcaaaaagctag

SEQ ID NO: 460 - DNA (genomic), 1029 bp, Enterococcus faecium; double-stranded, circular
  misc_feature (B) LOCATION 1...1029
  hypothetical: NO
  anti-sense: NO
actgtggaaacgaaacgatatgatgaaacagaattgcaagaggcagccgaagcactgaaagaaggagaacttgttgcttttcctaccgaaacagtatacggattgggcgccaacgctcttttaccaaacgctgtcaagaaagtgttttctgtaaaagggagaccgcaagataatccattaatcgtccatgtcgcctcttttgaacaagtaaaagagtatgtggacaactttcatccggcagcagagaagattgtgaagaacttctggcctggaccattaactttgatatttaagatcaaaaaagacactttgccctcagttgtgacgggaggattatccacagctgcatttcgtataccggataacaaaaaaacactagaagtaatccaactttccggtgttccgcttgtcggtccaagtgcaaatacgtcgggaaaaccaagtccaacgactgcagatcatgtatatcatgatctacaaggaaaaattaccgggattattgatgatggagctacgcgaattggtgtagaatccactgttcttgatttaagtgatccaacagccatgcctatgattttacgaccaggtgcagtaacgaaagaacaaatcgaagcagtcatcgaatctcctgttgctattgatcagcatcttgtaaaagaaaatgaaacaccaaaagcccctgggatgaaatacaaacactactcacccgatacacgtgttctgatggtcagagatggcgattggtcaactgcagttcaatgggcaaaaaataagaagatccgtgcaggtgtcatagcaagccccgaaattgcggatcaagtgcggacagatactgcagctgtttatatgtataacgacaactcagtagaagcggcggctaaaggattgtttgcaggtctaagaggattagatgaaccaacacttggattagatttgatttttgtacaagtgtatccagaaactggattggggaatgcttacatgaatcgcttgaaaaaagcagcaggacaaaattattttgaaaaatga

SEQ ID NO: 461 - DNA (genomic), 522 bp, Enterococcus faecium; double-stranded, circular
  misc_feature (B) LOCATION 1...522
  hypothetical: NO
  anti-sense: NO
agtaaggaaacaagaataaatttcaatgaaggaagagataagatgcgaaaagtagcacctattttgaagccaatcgctgtattaacaatctcgacgattgtcgcgactactacaggtattgtgaatagttccagctaccgtgcaccaagttcaagttctagtactgtagaagaaacaacaccaactacttcagtctcgacatctgaaccaacaacaacggaaagtttgaatgaaaccactacgacaagtacatgggacgatacaacaactagttcgtcgtatgatgagacatatacaactgacagctcaagcgaaacaagtaatacggtaccagatggcactccatcggattcaaccaatccaagtacaagtccggatacaagtgctagctccgaaacgataccaagcagtacgactgtagatgataacacgcaaaatgatgatgcagcacgtacagcacagcaaaaccaagattcaggaaatacccaaacgtataaccagcaagcaggtgattctcaatga

SEQ ID NO: 462 - DNA (genomic), 1143 bp, Enterococcus faecium; double-stranded, circular
  misc_feature (B) LOCATION 1...1143
  hypothetical: NO
  anti-sense: NO
aaaaaggaaacgacgataatgaggctgaataagctgtatttaaaaaattatcgaaattacgaagagctgaacatcgaattttccaagaacctcgtcatctttttaggagaaaatgcgcaaggaaaaacgaatcttttggaaagtatctacgtattagctatgacgcgaagtcatcggacaagtagtgagcaggaattgattggctggactgacgatcaggcgatgattcaaggagagatcacaaaaggttcatccactcttccattagaaatcttattatctaaaaaaggccgaaaaaccaagatcaaccatatcgaacagaaaaagttaagtacttacgtgggacaaatgaatgtcattttatttgcaccagaagatctttctttagtaaaaggcagcccgcagatcaggcggaagtttttagatatggaattaggccagatcaatccaatctatctttatgatcttgtccaataccaagcaattttgaaacaaagaaaccagtacttgaagcaattgaatgaaaaaaaacaaactgatttgctttatttggatattttgtccgaacaactagcagcgtttggcagcaaagtattgaaagcaagagcacagttcgtcaagcgattggagttttgggctaattctttgcatcagcaaatcacccatcaaaaagagcagctggaaatcgagtatctcaccgcagtcgattctttagaaacacatacgcaagagcaaatccaagaacaatttctcgcacttttgaaccaaaataaaaagaaagacctttttcggggaacaacgacagttggtcctcatcgtgacgatctttccttttttattaatcagaaaaatgtgcagacttatggatcgcaaggacagcaaagaacaactgcactaagtgtcaaattagcagaaatcgatttgattaaagaagagacaggggaatatccaatccttttgttagatgatgtgatgagcgagctggatgataatcgtcaactccatctgctagaaacaatcgaaggaaaagttcaaacgttcttaacaacaacgacacttgaccatgtaaaaaataaaatgactgttgaacctgagattttttatgttcaacaagggaaactaaaaggagaagaaactgaatga

SEQ ID NO: 463 - DNA (genomic), 915 bp, Enterococcus faecium; double-stranded, circular
  misc_feature (B) LOCATION 1...915
  hypothetical: NO
  anti-sense: NO
ctaagggaaactggccaaagtatgcctgatgtactcatattgcctaaattagccagtttttttgatgtgtctgttgatgaactgctcggctatcatcctcaattgacgaaagagcaaatcagacacttttatcagcagtggaccaccgctttttctgaagagccctttgaatatgtgatggaggactgtagaaaagcggtcaaacaatattactcatgttatccttttcttttacaagtagccgttttgtggttgaatcattttatgctaacaaaggatctggaggaacaacaagcaattctgtctgaagcagaagcgttatgtacgaaaatcgtagaagaatcagcagaattatctctatgcaataatgcttctttgttaaaagtagcggtcatgctccagttaggcaaaccagaagaagctttatctgaaatcgaagaaaaagcggacccttatcgttttgcccagcaaagcgacaccttacttatccaagcgtaccgagccgctggtcaaacaaaaaaagcggtaagctatactcaatttagcatgttttctcatttaatcaatctcgtatcttcagccactcattatctattgatccaaatcattcaattaccggttatagaagaaactgtcaatagaatagatgctgtgatccaagcattcaacctgacggcggtccatcccaacagttgtgctcaattttcttacgctgcagcctgtgcttatgcgaaacatgaaaaagaagaacaagtaataaagtgcttaaaacagtttgtggatttgacacttatacttttaagcgaggaaggcaggatccttcatggtgataggtattttgatgagataactgagatatttgaaggagcagatcttggggtacagcaaataagagacacgaaattcatcaggtaa

SEQ ID NO: 464 - DNA (genomic), 966 bp, Enterococcus faecium; double-stranded, circular
  misc_feature (B) LOCATION 1...966
  hypothetical: NO
  anti-sense: NO
ggagtacgaaccatgacactaaaaatctttttagaagtagttgaaatacgaacaaaggtggctagtgtatttccttttgcggtaggggtattattctctatcgctttttttcatgagatacattggctaaacacttttttattttttattggaatgctagtttttgatttagcgactaccgctatcaataattacatggattatgaaaaggctcattctgaagtatataagtatgaagaaaatgtcattggccgcagaaatctatctcctgtattgattcgaaacatgattttagctatgattgcatttgtttttgttatcggcgttattctaacgatcaatacgggttggcttttacttttgatgggatttatctgttgttttattggagtattctatacattcggaccgattcctttatctcgaatgcctttaggggaaattttcagtggggtgactatgggccttggaatttttgccatggtcgtttatgtcaatacattcggttcagatgtctatgatctgacagtcaacttttcatctggacaatttgctttggtaggaaatctttgggctatagcagcaatcgtattagcttccttacccttggtgtttacgattgccaatatcatgttggctaataatttgcgggatcttgaccgtgatattgaaaatcatcgctatacactagttttttatatcggacgtcctgcgggaacagtcttattccagctattgatgtatgcttgctatttcgtgattttaatggggttgttgagcggtatctatgaatggccgatcttggtcaccttcttgaccttgccaattgtgaagaagcatttggatcaattcaagcaaacgttaccccagcctatcagtttcagctattccatcaaaaatatggtcttattcaatgccagttatgtattggggctattactaacaatcattatgcaagccatttaa

SEQ ID NO: 465 - DNA (genomic), 739 bp, Enterococcus faecium; double-stranded, circular
  misc_feature (B) LOCATION 1...739
  hypothetical: NO
  anti-sense: NO
gttgcgaacttgtggtcaagaatggccaggatcgtttttaggaatcttatgggcgtttatcaatccgctatttactgtattgatttattggctggtatttggtgttggactgaaagcacaaatgatcgatgcaaaatacccatttatcgtatatttagttaccgggatgattccctggttcttcttctcagatgcatttgcatcaactacggttgtttttcgggaatatacttatttagtaaagaaagtcgtattcaatattcgtatcttgcccacgacgaaaatcctatccaatctgtacacccatttattcttcattctgattggcatagctgtcgcgcttataaatggtatatatccttcagcaatgtctttacagctgatttattatttattttgcatgtgtgctttcttgacaggattgacttggctgacggcatcgatccaaccatttttacctgatatcatgcaattaattacgatcgtgctgcagttgatcatgtggacattaccgatattatggagccctaatcagtttgattcaggtcttgtaagcatattgaaattaaatccgctgtactatgttgttcaaggttatcgtgagtcatttttaagtgaagcttggttctgggagcatggaacatatactttgtatttctgggttttcacgttagtaatgttcgtaatcggctctgcagtgttccgtagattgaaaccacatttttcagatgtgctgtaa

SEQ ID NO: 466 - DNA (genomic), 303 bp, Enterococcus faecium; double-stranded, circular
  misc_feature (B) LOCATION 1...303
  hypothetical: NO
  anti-sense: NO
aggtcgcgaactggtgtcatgatgatacggttcaagtcattgatgattgtactgaagccttgctctttttgcatcaagtcattgattacttcttctgattggattttcacagccatttcttgtgctttcattgcatcttcgtcgctgaactcttgtccactcatttgtttttcttgtaattcgatttgcatcgcttggaagtctttgaacagtttgtgtgcttcttcgtttgcttgtactttctcgtacgcttctttcaacgctttgaattctggtaattcacggatctcacgttcgatttga

SEQ ID NO: 467 - DNA (genomic), 972 bp, Enterococcus faecium; double-stranded, circular
  misc_feature (B) LOCATION 1...972
  hypothetical: NO
  anti-sense: NO
agggggcgaactataatgtcgactatcgaattaattgccttgatccttacttctacactggtttattcaacaccgctaattctaacgtcactaggcggaactttttctgaacgaagcgggatcgtaaacgtagggctagagggaatcatggtcatgggtgcttttagttccatcgttttcaacttgacgatgagtccatcacttggttctatgacaccatggatcgctattttagtgggtggcgtcgtaggtatcctattttctctgattcacgcagtagcaacagtcagtttgcgtgctgaccatattatcagcgggacagtaattaatctgatggcacctgctttaggtgttttcttgatcaaagcatggtatggtaaaggtcaaactgataacatcacgcagaatctggggtatttttctttcccaggattagcagatattccggtcattggaccaattttctttaaaaatacattcttacctgcttattgtgctattttgattgctgtcctagcttgggtgatcatcttcaagacgaaattcggcttgcgcctccgttcagttggtgaaaatcctcaagctgccgacacattaggtatcaatgtatatgctatgcgttattcaggcgtactgatttctggcttgttaggcggtatgggcggtgctgtttttgctcagtcgatttccggtaacttttcagctggtacgatcgttggacaagggttcatctccatggctgctatgatctttggtaagtggaatcctttaggggcaatgggtgcctcattgttctttggttttgctcaaagcttgagtatcattggcgcacaattaccagttatttcttcgattccgccagtattgctgcaaattgctccatatttgctgacaatcattgtgctggttgttttcttagggaaagcttctggtccaaaagcaaacgggaagaactatatcaaatcaaaataa

SEQ ID NO: 468 - DNA (genomic), 525 bp, Enterococcus faecium; double-stranded, circular
  misc_feature (B) LOCATION 1...525
  hypothetical: NO
  anti-sense: NO
acaggcagaacccccatccccgcccagtacgatgtggaacttgagcagctgtcaaatggtgagcggatagacattcggatttctccctacctccaggatttgtttgatgccgcaagagctgatggagtttacccgattgtcgcatccggataccggacaacagaaaaacagcaagaaatcatggatgaaaaagtcgccgaatacaaggcgaaaggctacacctctgcacaggctaaagcggaagcagaaacttgggtggccgtgccgggaacaagcgagcatcagcttggtcttgctgtggatatcaatgcggatggaattcattcaaccggcaacgaggtttacagatggctggatgaaaacagctatcgctttggttttattcgccgctacccgccagacaagacagagataaccggtgtgagcaacgagccgtggcattaccgatatgtcggcatcgaagctgccacaaagatataccaccaagggctttgccttgaggaatatttaaacacagaaaaatga

SEQ ID NO: 469 - DNA (genomic), 1452 bp, Enterococcus faecium; double-stranded, circular
  misc_feature (B) LOCATION 1...1452
  hypothetical: NO
  anti-sense: NO
aacataagaacaactaaaaaaggagagattatcatgggaaaaaaaggaacaccaagttttttagaaacaacacttgtattaatggttattgttttaggcattgcgattggcgttgtcggattaaaggtctcacctaatatcacgatcttagcagcgatcggaatggtcatgttgtatgcagtgataaaaagatacccgacagattggctgcacgaaggaatcatcaatggcatcaaaccaggaatcatcccaatctttatttttattttagtcggttcattgattgctgtatggatacaagcagggatcattccaactctaatggtcattgggttcaaattgatcagtgtccagtggtttgtcccttctgtatttgttgtgtgtgcaatcgtaggtagcgctgtagggagtgcctttactgttatgtcaacgattgggattgcatttttcggtattgggacaacactatgcttaaatccagcgctggttgttggagctattgtttcaggtgccgtttttggagataagatgtctccattatccgaatcaacaaatctagcagcagctattgttgatgccgatttgttcaaacacatcaagcatatgatgtggtcaactgtcccggcatttgttgtttctttctttttattcatgattttaggacacacaagtaaagccgcaagtctttcatctattcgtgaagtgactgatgttctagaagcaaactttactatttcaatctggtcactgattcctttatttttaatgttactgtgtgcatggaaaaaggtgccggcaattttaacgattttgttgaatatcgctgtagcagtaggaatgatttttattcaaaacccacaaacttccttaacgaagttggctggggtcatcgaatcagggtttgtttcaaatactggaaaccaacaaatcgattcactgcttagccgcggaggaatcgaaagtatgatgcctactgtgtcattgattattctaactttgtcattaggtggattgttgatcgaatttggcttgatctcaaccgtgatggaacgagtatcaagaaagatgacgaacacaccaaatttgatttttacaacattgatgacaagtatcggagtaaatatttttattggtgaacaattcctatctgttattctgcctggtaatgcatttaaagaaacttatgaaaaagcaggatttgatccaactgtattaggtagaacgctagaagatggtggaacagtaatcaactacttagtgccttggggaattgccggaagtttcgtagcaagtacatttggtattcctacactcacttacttgccattcgtatttttcagtttgctttctcctgtgttttcgatggtcagtgccttcacaggttggggaatctcaaaaaaatttgtgaaaccgcaagaagcagtaagcaagacagcgcaattagaacaataa

SEQ ID NO: 470 - DNA (genomic), 294 bp, Enterococcus faecium; double-stranded, circular
  misc_feature (B) LOCATION 1...294
  hypothetical: NO
  anti-sense: NO
gggactggaacaatcatgcagaagaaacatcttttttttacacttagtattgcttttctttcattagcacatttaatattcagctatttttatattcgtatgtatggttattttaacctccatgggcatttgaacagttttatgacagcagcttggattttgcgttttatcattgacgtatatatcgttatttgtggcttctttgccattcgtgaagagcggtataaagtattgccgttttatctgcttttctttttattcaatctcatacttccatttatttttcatatttaa

SEQ ID NO: 471 - DNA (genomic), 789 bp, Enterococcus faecium; double-stranded, circular
  misc_feature (B) LOCATION 1...789
  hypothetical: NO
  anti-sense: NO
agacatggaacaatgggtatgaaggggcagaaaggaggtaacaaaatgaagaaaaatctttatccagcagtcagtatggcattcattttaattatttggcagattgttgtcatagtttggaaaatacctgcctttattttacccggacctgctgctgtattttctgcattagcggcagatgcacaagtattactttcccattctgtcacgacattaaatgaagcagtgcttggtttggtaatagctagcgttctttcttttattactgccttggcaatggattattggaagtttttagaaatgtctttttatccgttactagtgatttcacaaatgttgccaatcatggtgttagggccattacttaccctatggtttggtttcggtatgcttccaaaagtgatccttgttgtcttgataagctattttccgatcgtagtttctttttcggatacattgaggaaagtatcaaaagagcaaatcatctttttgaaaacgatgggggcagatacagggaagatttatcgaatatataaaataccagcgggtttatccggcttcttttccggtttaaaagtggctgctacttattgtgtcagcggagcagtcgttggagaatggctaagcgctcaagcaggcttagggtattacatgatacgcgtaaaaaacagctaccagatcgataaagtttttgctgcgatcatttgtgtcattctattgagtttattgctgaatggcgcttgttcattattgaaaaaagggtattatcgtatgctttatattttttaa

SEQ ID NO: 472 - DNA (genomic), 1758 bp, Enterococcus faecium; double-stranded, circular
  misc_feature (B) LOCATION 1...1758
  hypothetical: NO
  anti-sense: NO
gtttcaggaaccaaaacgatgaaatggaaaaaaatttatgagcgtctcttctttcttattcttttaattagtttgttttttggtggttggcaattgatctcccattatttccaacaacagatcgtcgaacagcaagaaagctacctgacaaaaaaagcacaactactgatccggcaattagatgtcgaaaacctccaagcagcgcaaaacaaaactgctttggaagaattcgtccatcagtcgaacgaacggatcactttaatggatgctactggaaaaatcttatttgacacaaacaatgaaacattgaatgaacggcgaagttctcgtccagaaataaaagctgtattgaatggtgggaacctaggtagcgctttgcgcaaaagtactactttgaatgaggatcttttatacgtcgcattaccagtcaaaaaaggaggccagttagaagccattttacgtatcgcagaaccgacaagcggatttttaccgagaacggaaagttttcgccgttgggtctttttcttctttctgtctttcttccttgttcttgcaggaatgatttattacctgatctaccaaaaaaatcagcctttgaaaactgtcctgcctgttcttagaaaaatggtacaaaatccaaaccaagcagaagtaatcatgcagacacctgaccaatgggaggaattgtatcaaacaatcaatgagctgagcgaacaaatgagtaagatgtatcgagcgtatactacaacagaagaacaattgtacacattattaaatgaactgatgataggcgtattcctgattgatgatgctgattctcgtttactactgcttaatccaaagatgcagttgcatttaaacgtgacaagctatgaacctgaacaacgatacacagaagtcatccaagagccaaaactcattcagctgattcaccaagtgactcctgagcatccgctgatccatcaggagatcaccatcgctgaaggacgacagacattagacttgagtttgcgctactttactaattcagaaggtaccggacagattctaggggtggcgtatgacttaacgaaagtgcgacgtttagaaaagctacaaaaggatttcgtgggcaacgtctcccacgaattaaaaactcctgtgacttcactgattggttttaccgagactttactggatggtgcaaaagatgacccacaaactctgacttcttttcttgagatcatgcaaaaagatgcgattcggttagataaattgattcgggaaatcatccagctgtcaaaagacggtgaaaattcttacgagatccagacgatttatacagaaccttatttccagcaaatcgttcaaaattatcagccaatcatcgaaaagaaacggttgacgattcgattgattggaaagaacgaaccatttactactaaaacagatatcctttatccaatcctcaaaaatctgattgaaaatgctgtccaatactcaaaaaacgacagcgagatcattatccgttatcaggcaacagatgaattatcgttttctgtccaagattttggtataggtatcgacattgaggatcaggaacggatctttgagcgtttttaccgcgtagacaaggcacgaagccgacattcaggcgggaccggactagggttagcgattgtaaaagactacgtgcaactccttcatggtacaattactgtagacagtcatcttggaacaggttcgactttcaccgttaccattccgaaaagcaattaa

SEQ ID NO: 473 - DNA (genomic), 624 bp, Enterococcus faecium; double-stranded, circular
  misc_feature (B) LOCATION 1...624
  hypothetical: NO
  anti-sense: NO
atagggggaacaacaatggctaaaacaaaaactgtagtaacaacgttcgataacgtaagtatcaaacgaattgcttttaattttaagaacgcaggaaatgcaatcgcaacgaattgtaatggacaattagatggcgaaacagaaatgcaaacggtggttaaaaaatgtggagcgacagaagtaaaatcaaaatctaaaccaatcaatatgacggtaacaattactgcacatgtaccgatggaagtttatcgacgtttcaatgggttgaaacaagatggacgtattaaaccaggcatttactcttacggtcctgattccgtaggcgaagatttctcacttgctgcagagatcgtggatgacttcgaagaaaatagaaagttagttggtatgttagcatgcacttcgaatacaggattaacattctctattgaaaatggtgcggatgaagtagctgcgttagaactagaaacaaaagttatgcaagatgaatttggtaaattttatcatgaagcaattgttgcagaacttgaagaagacttaacagatcaatggatgacgaatctatctgctgatgtgattaaaaaaacttcagttgtgacaactacggccactcaatcacagtaa

SEQ ID NO: 474 - DNA (genomic), 291 bp, Enterococcus faecium; double-stranded, circular
  misc_feature (B) LOCATION 1...291
  hypothetical: NO
  anti-sense: NO
tattgtttgactagcgcatttttcggctcagtcaagatccgtaccagatcatctgttgtcaatttctctaaagctgccataacaggtaatcgtccgataaactcagggatcaatccgaattttagtaaatcttcaggaatgatatgctgcatgacactttcgtcttcagaaagtttttggttttgtgtaccaaatccaatcgtcttttcgcccatacgattcttcacaatcgtttcgatgccatcaaatgcaccacctacgatgaacaatatgttcgtcgtatcaatctga

SEQ ID NO: 475 - DNA (genomic), 966 bp, Enterococcus faecium; double-stranded, circular
  misc_feature (B) LOCATION 1...966
  hypothetical: NO
  anti-sense: NO
cagaaattgactaagatagcagtggaaaaagtaagtgctgaggaggcgaggctcatgagtacaggtttcttatttcctggacaaggcagtcagaagttagggatgttagcggatatccctgaaatgtacatggaacgtttagaaaatgtgacggggtatcggttagttgataaagaagaaaactatcaagatacggtttttatccagctagcattactgacaaaagcagtattttatttagatgaaatggaaaaaaacggtattcagcctgatattgcagcaggacattcgattggtgctttttgtgcagctgttgcttgtcgatctttgagatttgagaatgcagcggaactagtctatcaccgcgcagtcttaatgaaagaagcttatccaagcggttatgcaatgggcgtagtagtaggtgtgacgagaagcgaagctgaggaaattgtagcaaaaacatttgatcctgaccatccagtttatctgtcaaatgaaaattgtccgatgcaacatacgttatctgggagtatcgaaggtttatccgttacgttggcagaagccaaacggcaccaagcgcaaacagcgaagctgctgaaagtccctgtgccatctcactgtctcttgatgaatgatacggtcaagaaattcaagccgtatatgcagtctgtccatctatctgatgctagatgtttgtatataaaaaatacggatggaagagccactcaggacgcagaagagattcgtaaagatttgttggaaaacctagctttccctgtgcagtggaaccaaatgatggacttggcaaaagaattaggaatggatctgacgattgaatttccccccggcaatactttgacaaagctgattcatacaaaatttggtgtagataaagggatccgtacgatcaatctagaccaacatggtattgatgacgccacgtttctatatcaaaaatggagatga

SEQ ID NO: 476 - DNA (genomic), 261 bp, Enterococcus faecium; double-stranded, circular
  misc_feature (B) LOCATION 1...261
  hypothetical: NO
  anti-sense: NO
atttttatgacccgatatgaagaaaattttaaacaaatgattgttgaactgaatcaaactggacgttctgttcgagggttagcgaaagaatatggcttatctgaagcaacgatttacaaatggaagaatttatatttacctgatcagtccacaggactgactggaaaagaagtagctgaactgagaaaagaaaatgctcgtttaaatgaggaacttgaaatcttaaaaaaagccgcagccatattctctcggaaaacctaa

SEQ ID NO: 477 - DNA (genomic), 213 bp, Enterococcus faecium; double-stranded, circular
  misc_feature (B) LOCATION 1...213
  hypothetical: NO
  anti-sense: NO
tcctctatgaccaaatataaagtagctaaagttttcattgatgttcacacgaaagaaacttataaagttggtcaagagattgatttgaacaaagagcgctttgatgaaattgagaaaaatcttgaagcgtttggtggaggattcttagaaccgattaagatcgaggaaaaacaagttaagaaaccaactaaatcaactaaaaagaaaggttag

SEQ ID NO: 478 - DNA (genomic), 387 bp, Enterococcus faecium; double-stranded, circular
  misc_feature (B) LOCATION 1...387
  hypothetical: NO
  anti-sense: NO
acggctatgaccaaagaatattgggtagcggtcttagaacaagaagatcgtttgataagtaattcagaccggaagttccggtattattgctattcacttgaaaacatgagtgaggagctggccttccaggaacgaaccgtctacatacaggaggacattgtatttcgttctttggagcaggattttatggactctgttcagaatgagcatttatcggctgctctaagccgtctgacagaccggcagcggcgagtgattgaacttcacttctggcaagggtatcaatacaaggagattgcagttatcctcggatgtgacccgtcggcggtaactcgcctgcttcaaagagcatttaagcagattcgtatatatttccttagtaggtaa

SEQ ID NO: 479 - DNA (genomic), 654 bp, Enterococcus faecium; double-stranded, circular
  misc_feature (B) LOCATION 1...654
  hypothetical: NO
  anti-sense: NO
tcgaatatgacaccaaatcgagaagattatttgaaaatcattttagaactaggtggagatacaacgaaagtcaacaataaacaaatcgtatctagtctagatgtctcagctgcatctgtcagtgaaatgatttctaaacttgtgaaagaagagcttgtagaacattccccttatcaaggtgtacaattgactgcaagcggactgcaaaaagctagcagtctgattcgcaaacatcgcttatgggaagtttttttagttgaacatttagactatagctggaatgaagtccatgatgatgctgaagtattggaacatgtgacttcggaacatcttgcagatcatttagaaaactatttgaatcatcctgaacattgtcctcatggaggatcgattcctaaaaaagaggaagttgtccatgaagaacgccgacaaacattggagtcctatcctgtcggtacaaaagtgcgtatcgcacgagtgcttgatgaaaaagaattgttggattacttagtcactattgacctgaatatcaacgaagaatatgagatcgttgacatcgcagcttatgaaggaccgatcactatccaaaatgatagaaagaaaatccccgtcagctttaaggcggccagcacgatttttgtcgataaaatataa

SEQ ID NO: 480 - DNA (genomic), 594 bp, Enterococcus faecium; double-stranded, circular
  misc_feature (B) LOCATION 1...594
  hypothetical: NO
  anti-sense: NO
aaggatatgacccacatccggcgatcaaagctcctatcgctgtttagaatcagaaaggatgagaaaatgttagctgcaatttgggcacaggatgaaaacggattgattggaaaagaagaccgtcttccttggcgtttgccaaatgatctgaaattcttcaaacaaatgacagaagcaaatacactagtgatgggacgaaaaacattcgaagggatgggtagccgtccgttgccgaatcgtcagacgattgttttgacgagagattcttcctataaagcagaaggcgtgcatgtcatgcatagtgtggaagacgtgcttgctctggaaaaagaaacagacggtatctttttcatcgctggagggtcagctgtttatcaagaatttctgccattttgtacgatattataccgtacagtcatccatcatgtattcgatggagatgcttattttccacctgttgactggtctgattggtcactgatcaatactagtcaaggagaaatggatgaaaaaaatcgttatccgcatcaatttgaaacgtatcagcgtaatgagaatcctgtaaaaagcgggacaggcgaattgacgatataa

SEQ ID NO: 481 - DNA (genomic), 741 bp, Enterococcus faecium; double-stranded, circular
  misc_feature (B) LOCATION 1...741
  hypothetical: NO
  anti-sense: NO
gaaggtatgacaataatatataagaggtggctctttatgaaaaaagttttagttgtcgatgatgagaagccgatttcggatatcgtcaaattcaatttagccaaagaaggctatgatgtttatactgcatatgatggggaagaagccttggaaaaagttgctgaggtagaacctgatttgattttacttgatttgatgctacctaaaatggacggcttagaagttgctcgtgaggtacgcaaaacttatgatatgccgatcattatggtaacagccaaagattctgaaattgataaagtcctaggcttagagttaggcgccgatgattacgtgaccaagccattttccaaccgagaattagttgcacgtgtcaaagcaaatcttcgtcgcggtgccacggctgcgaaggaaccagaagaggcagcacctgcggaattgacgattggtgatttgacgatccatccagaagcttacatggtgacgaaacgaggagaaacaatcgagttaacacatcgtgaattcgaactactcttttacttggcgaagcaccttggacaagtgatgacaagagaacatttattacaaacggtttggggttatgattattttggagatgtacgaacagtggatgtaactgtacgtcgtttgcgtgaaaagatcgaagataatccaagccatccaaattatttagtgacacgtcgtggtgtcggttactatttgcgtaacccagaacaggagtaa

SEQ ID NO: 482 - DNA (genomic), 1635 bp, Enterococcus faecium; double-stranded, circular
  misc_feature (B) LOCATION 1...1635
  hypothetical: NO
  anti-sense: NO
atatccatgacatttaaagacaaagtcatttaccaaatctatcccaaatcttacaaagacagtaatggtgatggaattggagatttaaaaggaatcaaagaaaaactcccgtatctgaatgatctaggcatcgacatgatttggctaaaccctatttatccaagccctcaaaaagacaacggttatgatatctctgattacacagccatcgatcctatctttggtacgatggaggaattcgaacagctaatagccgaagcaaagaaataccggatagaaatcatgctcgatatggtgctgaatcacgtttcgacagaacatgaatggttcaaaaaagcactagcaggggaccagcattatcaggacttcttcattttaagagaagagccaacggattgggtatcaaaatttggtggaagtgcttggtcgccatttggagatacggggaaatattatttgcacttatatgatcggacacaagctgacttgaactggcggaaccaagcagtaagagaggaactattcaaagttgttcgtttttggatggaaaaaggggtaaaaggattccgtttcgatgttatcaatgttatcggtaaagacgaacaattgaaaaataataaagaaaatgatggcaaacctgaatatacggacaaaccaatcacccatacgtatctaaaagaattgaaccaagcaacgtttgggacggattccactatcatcacagtcggtgaaatgagctctacgacgatcgaaaattgtatcttgtatacagaacctagtagagaagaattatcaatggtctttaatttccatcatttgaaagtcgattatgaaaatgggaataaatggtctactcctccatttgattttgcagaattaaagcgactatttcatacatggggagaaaagatgagtgagggtaacggctggaatgctctattttttaataatcatgatcagccacgtgcgctcaatcgatttgtagctatcgatcagtatcgaaaacaaggagcagagatgctagcaaccatgatccatttgaaccgtgggacgccctatatttatatgggagaagaaatcggcatgatcgacccagactattcatcgatttccgactatattgacgtagaaagtttgaatgcttataagttactccttgaacaaggattcacagaaaaagaagcgtttcgtcggatcaaagcaaaatctcgcgataactctcgaacacccatgcaatggtcagacacagaacaagcaggatttactacagggaaaccttggttaaaagttggaggcaagctagaagagattaatgtagaaaaagaactatcttctgaagattctattttgtcctattacaagaaattgattcggctgagaaaaacatatccaatcgttgcacaaggagattatcatgcttatgaagcaaatcatccggaagtttatggctttcttcgccaatttgaaggacagcagctgcttgtattaacaaatttctatgataaagatacaaggatcgccatcccagaaggattcacagaagccaatattcttatcgataattattccgatactgttcttcatcaaagtctggagctaaaaccataccaggcaattgctttgctgaaaaattaa

SEQ ID NO: 483 - DNA (genomic), 774 bp, Enterococcus faecium; double-stranded, circular
  misc_feature (B) LOCATION 1...774
  hypothetical: NO
  anti-sense: NO
ttctcaatgacatttttactagaccttatcaacggggtgcataaattccttggctatttagacatcagtcctaaatatcttaaccgtggatatacgattttaagtgtgattcccacgctttatttattgagaattgtttatggactttggcaaaaccaaaactatcttcaatttttcttatatggacttgcatttctagtgcttgtttattttactgttttaaatgtattttattactttttagataaaaacacgaaagccgatgtcactcagctttttgtgaagtatttacctgatgaagcgttcaacatccagacagaagaatcgatagataatggaaattcgatcgataaagtgaatacacaagaggtcatggtttcttatgacgaagattatcaattgaaattagccgagaatatgcggtatttgattggaaatggtgagatcaaaacaaatgaactcggtcgcatggatggatttctggtcgatagaaatacattgtatccttattactatgtcaagaaaacaggagagaaagagtatgttctaaatattggacgaagctactcggacatggaaaaagtagggaccattcgacttgactcaacagaagacacattggaacctgtcggattgttcatcgtcggcggtgattttgtcaaagacgggttacgctatcatgagccttatcgtctgaaattgattgcaaaaaaggcacagtcgcaggaagaaccagtggtttatagtcgtagccaaagaagaagacattcataa

SEQ ID NO: 484 - DNA (genomic), 966 bp, Enterococcus faecium; double-stranded, circular
  misc_feature (B) LOCATION 1...966
  hypothetical: NO
  anti-sense: NO
gtacaaatgacctatacccatcttacaacggatgaacttgtaatgatagagtcttatttcaaaataaatcaatctgttgcgaaaactgcgcattgcttgaatcgttcaagacaaacgatccataaagtatacctgttcttcaagcaaggaaaatcagccttagagtactatcaacagtataagaaaaacaaatcaaactgtggtagacgcccgcttgttttacctgaggaacaatcagaatatattcaaagaaaggttgttcaaggatggacacccgatgtgattgttggtcgtgcagcgtttcctattcgttgttctgctcgtaccatttatcgtatgttcaaaaaggggctatttaatccttctgacttaccgatgaaaggcaagcgtaaaccaaatggacatcaagaaagacgtggaaaacaagctttccgtcgctctattcatgaacgtgaaaaagattatagccaattctcaaatgagtttggtcaccttgaaggtgacactatcgtaggtttgaaacataaaagtgctgtaattaccttagttgagcgattatcaaaagttatcatcacattgaaaccgtgtggtagacaagcgattgatattgaaaacaaattaaatcattggtttgaatctgtaccgaaaaatctattcaaatccatcacttttgattgtggaaaggaattttcaaattggaaacagatcagtaatgccaatgatattgccatttatttcgctgatccaggaacgccgtctcaaagaggcctaaacgagaattctaacggattgttacgtagagatggtttattgaaatctatggatttcaattcagtagatgaatcttttattcaatctgtcgcatcgaaacgaaataatattcctagaaaatcactgaattatcgaacatctttggaagtatttttgagttacgtaagtattgatgatttgtctaacttaatttga

SEQ ID NO: 485 - DNA (genomic), 1071 bp, Enterococcus faecium; double-stranded, circular
  misc_feature (B) LOCATION 1...1071
  hypothetical: NO
  anti-sense: NO
aagatgatgacgttgattaaacaaccaatgtaccaagaagatttggcaaaagtaatcaatcatacaccaaaaataaaacagctacatggaaaatccgttctgatgattggtgcttctggaatgatcggctcttttttgattgatacgttgatggctgctaatgaacaactaggcatcaaaatcaaagtttatgcaatgggcagaaaccgtcagaagcttgaaaaaaggtttgccagttatcttgaattagatactttcgaaattgttgaaggtgacgtcacagaacccttaccaaaagaaattcaagctgactatttgatacacggtgcaagtaacacacatcctaaggcttacgcaactgatccaatcggtacgatcatgactaatcttgcaggtacagagcaagtattgaaacatgcagtagcaacccaaccggttagagtattatttttatcaacagtagaaatctatggcgaaaatcgaggcgatatagaaaaattcacagaagattactgtggatacatcgattgtaatacactgagagcaggctaccctgaaggaaaaagagtcagtgaatcattatgccaagcctacatcgcaaaacacgacctcgacatcgtgattccaaggctttgccgtacgtttggtccgacgatgcttttatctgatacgaaagcatcctcacaatttattttaaatgcagtcgaacaaaaagatattgttttaaaaagtgaaggaaaccaatatttttcgtatgtatatgttggagatgctgtttctgctattcttcatttactgcttgaaggagaaaaaggagaggcgtacaacgtttcttcagaaaactttgatttacgactaaaagaattagcccaacagctagctgatatcagcggcaaacaagtaatttttgaattgccggatgagattgaacaaaaaggtttctcaaaagctagcacagcagtacttgaaaataaaaaaattaaagagacaggttggaaaccaatttttcctttgaacgaatcattggttcatacagtagaattagttaaaggtgagaaatataatgtgtga

SEQ ID NO: 486 - DNA (genomic), 528 bp, Enterococcus faecium; double-stranded, circular
  misc_feature (B) LOCATION 1...528
  hypothetical: NO
  anti-sense: NO
gaggagatgactattttgattaataatgttgtattagttggacgtctgacgaaagatccagatttgcgttacacagcaagtggtacggcagtcgcaacatttactttggctgtgaatcgtaattttacaaaccaaagcggcaatcgcgaggctgattttatcaactgtgtgatttggcgcaaatcagcagaaactttagcaaactatgctcgtaaaggaacacttttaggtgttactggacgtatccaaactcgttcttatgataatcagcaaggacaacgtgtatacgtgacagaagtagtagctgacaacttccaattgctggaaagtcgttctgcatctgaaaatcgccaacaaagcggcggattccaaagttctggtcaatcagctggcggatttggcggaaacaataactctaatcaaacatctcaatcatccaacggtatgcctgatttcgaccgtgatacttctgacccattcggctcaagttcaacgatcgacatntcagacgatgatttaccattctaa

SEQ ID NO: 487 - DNA (genomic), 279 bp, Enterococcus faecium; double-stranded, circular
  misc_feature (B) LOCATION 1...279
  hypothetical: NO
  anti-sense: NO
ttcaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 488 - DNA (genomic), 186 bp, Enterococcus faecium; double-stranded, circular
  misc_feature (B) LOCATION 1...186
  hypothetical: NO
  anti-sense: NO
aagcgggtgacgagaatcgaactcgcgacaacagcttggaaggctgtggttttaccactaaactacacccgcatggcggttccgacgggaatcgaacccgcgatctcctgcgtgacaggcaggcatgttaacccctacaccacggaaccagtgtttttagtttttaattgcgggagcaggatttga

SEQ ID NO: 489 - DNA (genomic), 1077 bp, Enterococcus faecium; double-stranded, circular
  misc_feature (B) LOCATION 1...1077
  hypothetical: NO
  anti-sense: NO
gtttactcgactaaaggacaagtcggcaaactctacactggttatgatattaagattgagaaagtaacgtcaacaagtgatacggcaactccttaccagccaaatttactcgatgcgccatattatttgagtaaaaaaacactaggtaaaaatttacttgatccaactggcattacaagtagctcatatttgcttctaactaaaacaccaagcgaaaagttacttaaagaccagacctatactattacacttaaaggaactaaaccggcaacgcagacattccgttgttttgtacaatatgaaactaatggttctactgtgaatctttttgatatgaaaccagttgaaggtcttgttgatgagtggcaattgacatttaaagcaactagaagcgccactgatataactgggagactatatgtttatcaagtgccaaatacaagtttaggtcaatgtaaagtagaatggataaaactagaaaaaggcgacacacgaaccccaaatattagtgaatataaatactgtggtgaaggattgaaagacagcaacaatcccaatgattacagttgggacatcacgcctgaatatgctgaaaaaggcttgaataatacggttagtttgaccgagccacagtcagttgaaggtttaaaaaactttgaggatgggttgcagattgcaggtgaagaagttgcgacagttgcagaaagtacaggttggcttgctcttacacttgtggacggtttcgaagtagctgagaataatccacctcaatataaaatcacgtatcaagcaaatggtgataatgaaattgagtttagaggtgagttccaactgaccggagggacaaaatttacaaaggatacaagttattatccattcggacgtgctaatcaagctacaaatataccaaatgagttgaaacctgaccgaaccgcctttggttacggcgcaacaagtacaggtgtcggtggtcggctagctgtaaccacaacgccaacttttgtattcatacctggcgattcagatggtacttattgttccattagtcctttacggtacacgcaaacaaaaaaataa

SEQ ID NO: 490 - DNA (genomic), 354 bp, Enterococcus faecium; double-stranded, circular
  misc_feature (B) LOCATION 1...354
  hypothetical: NO
  anti-sense: NO
atgttaacgacgaaagaaagtgcggtgattttgaataagctcaaacaaatcgtgatgttgggtcgtcaatctggtttctttctgattttggcttgccaaaggccggatgcgaaatatttaggagacggaatccgcgatcaattcaactttcgcgtggctttgggtcgtatgagtgaactcggatattccatgatgtttggggaggtcgaaaaaaacttctttatgaagcacatcaaaggtcgaggttatgtggatacaggtggcagtgtgattagtgagttttatacgccacttgtaccaaaagggtatgatttcttagattcaattagtaaattagaaaagatgaatgattga

SEQ ID NO: 491 - DNA (genomic), 651 bp, Enterococcus faecium; double-stranded, circular
  misc_feature (B) LOCATION 1...651
  hypothetical: NO
  anti-sense: NO
ggcgatgcgacactcaacaagatttatatttgtttgatcagcctgaagcaaaacctcgagaagtcgtctttttttggacaggacagcttactgaaaaacaaacggaaatcgcaaagagaatactttgccattcagaaaaaaagacatcatcttatttgggctgtaacaggtgcagggaaaacagagatgctttatcctattttagtggaaactttaaaagctggaggaagagtagcgatttgtacaccgcgagtcgatgtttgtaatgaattgtttttacgctatcgttatgtttttccagaagaaaaaatcacgttgctccatgggaatacagcaacggcttatacctttacttcttttgttatctgtacgattcatcagctataccgtttttatcggtcctttgatttaatagtgatcgatgagatcgatgcgtttccttataacggagatgcaggattagctcatgctgtgcaaacagcgattaaaccagacggacgattcatctacttaagtgccacacctgataaaaagttactaaaggaaatcaagcagacgtttgacatccacaaacttgctttgcgctttcatcggcgtttacttcctgaacccgtcttggttttcatgaataattggcgacaaaaatgctag

SEQ ID NO: 492 - DNA (genomic), 186 bp, Enterococcus faecium; double-stranded, circular
  misc_feature (B) LOCATION 1...186
  hypothetical: NO
  anti-sense: NO
ttttatcagacgaactcggaaagtgaacttcatttttcaaacacaggatctgctttcagtctgcgacagatctccctgaactggtttagccaaactactctttttcgtcatcgttctttacttattcgtatggactatagtttacaagattttttttacaaaatcaaccgcattcttcctctgtga

SEQ ID NO: 493 - DNA (genomic), 876 bp, Enterococcus faecium; double-stranded, circular
  misc_feature (B) LOCATION 1...876
  hypothetical: NO
  anti-sense: NO
gatcatcagacatttagtaaaaggaggagagaaaaaatgatccaatcctttattgatggattaatgaattatcaattcctgcaatacgctttggtcacttccatgcttgtaggacttgcttctggagtcatcggttcttttattattttacgagggatgtctttgatgggagacgctatctctcacgcagttcttccaggtgtagccatttcttatatgtttggttttagttacatctttggagccactgcttttgggatgctaacagcagcagtgattggtttcgtgactcagcggagccgattgaaaaatgatacagcgattggaattgtctttagctccttttttgcattagggattatcttgatttcatatgcccagagtgcgacagatttgtatcatattttatttgggaatgtcttagctgttagggaaagcgatttgttgctgacagcactcgttagtggaatcgtcttgatatttgtctttttcttttataaagaattgaagatcacatcattcgatccgacaatggcaaaagcttatgggctgaacacatcgctgatccattatcttttgatgttctttttgacattagtggctgtagtcagtttacagacagtaggaacaatcttggtgattgccatgttgatcacaccagccgccacggcttacttgctaacgaaccatttactgaaaatgatcattacagctgcaggaatcggtatgctaagtgcagttgtcggtgtgtttttcagttatagttacaattggccatcaggagctacgatcgtgttagcatgtaccgcattttttatccttgcttttttattttctccaacaaaaggaattttatttcagaaaggaagcagatag

SEQ ID NO: 494 - DNA (genomic), 216 bp, Enterococcus faecium; double-stranded, circular
  misc_feature (B) LOCATION 1...216
  hypothetical: NO
  anti-sense: NO
aaatgtcagacatatggattgaaattaaagggggaaaaagataaaaaagtctttgatcgagtagttgaagaacgcctgaaggcagcgtctgtttgggatgatgtgaaagacaaattgcataaaagtgctttatctttatccggtgcgcagcagcagcgtgtatgtatcgcacgtgttttggcagttaatccggacatcatcttattgatgaactaa

SEQ ID NO: 495 - DNA (genomic), 1572 bp, Enterococcus faecium; double-stranded, circular
  misc_feature (B) LOCATION 1...1572
  hypothetical: NO
  anti-sense: NO
atcatgcagactatcaaagtgaaaaatcctattttaagaggattcaatccagatcctaatatattaagagtgaaagagcggtattacattattgtctcctcttttgaatggcttccaggaatccgagtatatgagtcgaaaaatttagtcaactggtcacatacaacggatattttgaccactcaagtatctttgcaaggaaatcctacaaatggaagtatatgggcgccacagatcagttatgctgatggattgttttatcttgtttacacagatgtcaaaagtgcaggccgtccgtttaaagatgtccacaattatttgatcactgcatctgagatcacaggtccttggtccgaaccaatttatttaaatagtaacggctttgatccttctttgttccatgatcttgaaacgggaaaaaaatggcttgtcaatgaactatgggattatcgtctggacacaccgaataaatccagcggtatcgtattacaagaatatgatgcagagaagaagaagcttgatggtcccatctataaaatatttgcaggtacagaattagcgaaaacggaggcaccacatttgtattttcgtaacgggtattattatttgatgacggcagaaggcggtacaggaagaggacattcagttacagtttgccgagcaaagaatattactggtccttacgagcttgatcctggttttcctatgctgacagctagtgacaaacctgcttctacattgcaatgtacaggacatgggagcttagtacaaaccccgtcaggaagatggtacatgacatatctttgtaccagaccattaaacggtgcggctattttgggaagagaaaccgctattcaagaagtgtattggacgtccgacgattggttaagacttaaagatagccagacaactccgatggaagaaataatgattgagacaaatgaagaggtacaacaagaaaaagatcatcagtttatggatacatttgaaggagagctaaagaagaactggaatgccagacgcattttgccaaatgctgattggtgtgatacaaaatgtagaccaggttttttacgtctgatttccggtgaatctcttcaatctaccttcgaacatcatttgttagctattcggcaaacggattttacttttgatgcggagacagcatttgaatacatgcctaataattttaatcagatggctggactggtactgtacttaaatgaatccaattatatttattgttatgttacttggaatgaggacaagggaaaatgcctacgtatgatagaatcagaaaacggagtagcacaaatagaagattggacgattccactcacagaaaagaagacttttttgaaagtcactgtaaagaaagagacagcacagtttcatttgaaagacgtatcaactgaagaatggaagaaagtaggtccgcaaaaaaacatgtgtatactctcaggagggtttactggaaattttatcgggatagcagtgcatgatctaaataaaaaaagaggaagttatgctgattttgagtttttcaagtatgatggaaaagatcatctgtaa

SEQ ID NO: 496 - DNA (genomic), 306 bp, Enterococcus faecium; double-stranded, circular
  misc_feature (B) LOCATION 1...306
  hypothetical: NO
  anti-sense: NO
gaggtgcagaccatgttgttatctatgaatctacaattatttgcccacaaaaaaggtggcggttctacatctaacggccgtgactcaaaatcaaaacgtctaggtgctaaacgtgctgatggacaaacagttacaggtggatcaattctttaccgtcaacgcggtacaaaaatctatccaggtgtaaacgtgggtatcggtggagacgacactttatttgcaaaagttgatggcgtagtacgtttcgaacgtaaaggccgtaacaaaaaacaagtgtctgtttatccagtagctcaagaagcttaa

SEQ ID NO: 497 - DNA (genomic), 678 bp, Enterococcus faecium; double-stranded, circular
  misc_feature (B) LOCATION 1...678
  hypothetical: NO
  anti-sense: NO
aagcagcagacggtttttcgtttgctgctttttctacataaaatccgtccatcaataaatagaagtctggtgaaaaagatggaatacaaatggaaagcaaacaacagcagtcgcgtgtctatgaaacaactgagaaaagctggacatcacttaaatgaaatgatcatgccaaatctaagtctgtttatcgcttggggaatcttgtcattagcaacaaaaggtgtgtctggcgatttgcacaccacattagaagaggtatgccattggatgatccagctgcttttacccatcttgatcagttattcaggcgggaaatcggtagggggacaaaaaggggcagtcgccggtgcaattgcttctttagggttgatcgctcgttccaatgctccacaaatcgtaggagcgatgattatcgggccgcttgccggcatcgtatatgaacaatttgtttctagattccatgtgaaattcaaggctggatatgaaatgcttgtcagcaacctactagtaggactgactggtagcgttatttgtataattggaatcgtttttattgaaccagttttaaatagtgttcacttgttgctcgcctccgttgtgtcttggctagtcacaatgaatctgttaccacttgtcagtctgatcgttagaacctctaaaagtactatttttcaataa

SEQ ID NO: 498 - DNA (genomic), 483 bp, Enterococcus faecium; double-stranded, circular
  misc_feature (B) LOCATION 1...483
  hypothetical: NO
  anti-sense: NO
tatgataagacgagaataacaacgtggggtgtttacatggaaaataagttagtcgaagaggttatcgaaaagttaaaaaaagagaacattcgaatcacacctcaacggtacgcggttttagaatatttgattgaacatcattcccatccaacggctgatgagatttataaagcacttgaacatcggtttccaaatatgagtgttgcgactgtttacaataaccttcgcttatttacttcgattggatttgttcaagaaatgaagtacggcgatgcttctagccgatttgatttcagttcaaagcgtcattatcatgtaatttgtgaaaactgcggtaagattgttgattttcattacccagggcttgaagatatagaaatggctgcaagcagactgactgattttgagattaatgaacatcggttggaattgtatggactctgtccggattgtaaagagtcagcaaaaaaggcgcaaatgtaa

SEQ ID NO: 499 - DNA (genomic), 813 bp, Enterococcus faecium; double-stranded, circular
  misc_feature (B) LOCATION 1...813
  hypothetical: NO
  anti-sense: NO
gacaaaaagacgaaaaaccgttgcaggaggggacagatgaaacaagaaatgatggaaatcgttcagcaaaaacagctggcaccaaagatttttgaaatgacattgaaaggtgatctagtaaaagaaatgcagcaaccaggacagttcttgcatattctcgtgccgcgtgcagacttgctattacgccgaccgattagcttgaatcatatcgaccacgaaacaaatacttgccgtatcatttatcgggtggaaggtgaggggactagagtcttctctactctttctgccggagaccatttagatgtcatgggtcctttaggcaatggttttgatttgtccaatcttcatacaggagacgaagtatttataatcggtggaggaatcggtgtccctcctctatatgagttatcaaaacagttagtcgaaaaaggaattaagccaacgcattttttaggttttgccacacatgaagtcgtttattatgaaaaagaatttaatcgtctaggagaaacaagaatcgctactgacgatggaacatacggtatgcacggaaatgtcggtaatttattgttaggaacgaagacggaacctacagctgtttttgcatgtggttcaaacgggttattgaagacagtggaacagctgttttcttcgcatcaaaatgtccagttatcattagaatcccgcatggcatgtgggataggggcttgctatgcttgcgtttgtcatacgccggaagatgaaacaggaacaaaaagtgtgaaagtttgtgacgaaggaccgatttttaaaataggagaggtaattatatga

SEQ ID NO: 500 - DNA (genomic), 1366 bp, Enterococcus faecium; double-stranded, circular
  misc_feature (B) LOCATION 1...1366
  hypothetical: NO
  anti-sense: NO
gtggtgaagacagaaagaagaaaagaagacggcggcgaactggtttcctcctatatgtgcagcccggaaactgccgccgaagaatttgaaatcagcaaaaaactgtacgcccagcttaccgggcgcagccagtcagaaaagcatgacattatcatgtaccgcattatccagtcattcaaacccgatgaagtcagcccggaggaggcgcacaaaatcggctgtgaattggcgatgaaatttaccggcgggcagcatcagtttgtggtggccacccacacggataagcggcatatccatacccacattgaatttaacagcaccaacctgaactgtgacgcaaaattccagaacgtgaaaaactccgcttttatcctgcgacgcatgaatgatgaactgtgccgcgcccacggcctttcggtgattgagaatccgaagaaaaaagccaggccccaaaaggaaatggcggcggcgcagtacggcgtcagccacaaaaagcagttacagcaagccattgaccggctgctgccagagtgcaatcattatgaggaatttctggcaaagatgcgggctgagggatatgaggttgtggacggcaaaaatcccggattccgtctgcccggatgggatcgccctacaagggtgaaccggctgggcgacgattataccaagaccgccttgcgcgccagaattaccagccagcgcagacgtttgacgtcaggaaaaacagcgccgaagcgaaccggcagaaaggtcaatctcctgattgacattcaggcgaaacttgccgccggaaatggcgcatgctatgaacgctgggcgaaaattttcaacctgaaagaagcggcgaaaacgctgaatttcctgattgataacaatctgaccgattatgaccaactggcgcttagggcagatcaggccgagaactgtttcaacgctgtttcacagaaaatcaagcagtgggatgcacggatggctggtatagcgcaattaaaaacgcctatcatccagtattccaaaacacgggaagtcttacccgcttataagaagtcccgcccccagaaagatttctcgcagagcatggggcggaagattgcccagcaccaaaccgccaaagaagcccttgatgccctgaatgggcaggcttatccccaaataacgcaactttcagcggattttgccccgccgctggaaaaaaaccgggaacctttttacagttcaagacattggcggccgattgattacttttcaaaccgcactccgcacctgggattaaaatttaggaattggaaccccccgaaccggggccggaaaaaaaacttaaccccccggaacgggaaacccaaaaccccggcccttttccaccggg

SEQ ID NO: 501 - DNA (genomic), 744 bp, Enterococcus faecium; double-stranded, circular
  misc_feature (B) LOCATION 1...744
  hypothetical: NO
  anti-sense: NO
aaaggagagacgtacatggagaagaaagaacttttgtatgaaggaaaagccaaaaaaatatatcttacttctgatgagaacttgatttggatagaatatttagatcaagcaactgcgttgaatggcgcgaggaaagaccagataagtggaaaaggagaattgaataatcaaatcacaagtgcaattttccgttatctgactcaaagaggaataaaaaatcattttattgaacaattgtctaaaaccgaacaattagcaaaaaaagtacaaattatccctctggaagtggttatccgaaatattgcagcaggaagtttctcaaaacgtctaggtgttcccgaaggtaaagaattcatcaaaccaatcattgaattctactataaggatgaccagttggatgatccatttatcaatgaagagcatatctatttcttacaacttgcaaagccggaagaaatcagtgagctgaaagcccaagcgttggctattaatgaaattttgaccgaattatttgctaaggtcggtttggttttagtagatttcaagctagaatttggccggtcgaatggacaaattttgcttgcggatgaagtaacaccggatacttgccgattatgggatgaacgtacgaatgaacatatggacaaagacgtttaccgcagagatctaggtgatttgatcccagtctatcaagaagtatataaccgtctatcggaactaactgaagaaaaggagcgagtatga

SEQ ID NO: 502 - DNA (genomic), 1533 bp, Enterococcus faecium; double-stranded, circular
  misc_feature (B) LOCATION 1...1533
  hypothetical: NO
  anti-sense: NO
atgatggagaccataacgtattcccctttgaacttatttacgaattttcaagaagctgcagctaacttttccgagaccccgattatctttgatgagccactttcagctttcccagaattaggacttgaaacaacttacaaaaaatgctgcgaaagtgtgttgaaacgggcttatcaattggctcatcttggagtgaaatccggagacaaagttattatttataagagttccgcttttgacacataccttctagctgtttctgtgtcttaccttggtgcagtgcctgtcatgacttcttatcatctaccaacaacaacaatggaagtatttatcgatcgtttagaagaccctttcattttatttgatgatgagacaaaaaagcgagtgagagaaatttcaaatggaacaaaatcaaaacagattcctattctttatttaatggaacaacctgctttgtctgtttctcaatcatttttagacaaaaatgaaatttcttatatgacccatacttctggtacaactggtatccctaaacttatttgtcattctgctcattctatgggatggcggacgaaatggcaaaaaacagttttcacaaaaatttcggaaaagaaattaatcgcttttcacatctctccagtgcattccagattcaatattggtatctcttctttgatgtccatgggatttcctatgatgcctttagcaaacgcacaaagttcaaaagttgttcatatgttggaagctcaccggccaattgcactagagacccatccgaataactttgttcagtggcgttttactgctaaggagcatccagaagctttttcgggtatccgatactatcactccacttttgatgctataaacaaccagacaatgaagacatttttgcgaacgtcgatggcacaggatgcggtatttcttcaagtatatggccaaagtgaatgcggaccaatgattcttaaggctcatacactagagagtttgaaaacaagtgatgcaagagatatgggcgttggactggaagacatgacaagcgctcggattacagattcagttgggaatgtcctacctgaaaacacagatggtcatatacaattactgtctaaaggacgggctttgacttattacaaggaagatgcacggttccaggaaaatgtttatggcgattggtgggatagcggagattacggttttatggataagcatggccacctatttttgaaagatcggcaagtggatttgatcgaaacgatcaatagtacattagctattgaagactttttattagattcgttagattttttggcagaagtagtgattgtaagggataaaaatcattctccacaaccgattattgctttagctcctgataaagaaatggattggaatcgatggtgggagcaagtccatgaacttcctcgcttgaacgtccctatcatccgtgattttgatgcaatcccgcgaacagctacaatgaaagtgcaacggcttcaaatcgagaaagaattaaaatcacaaaagtcctaa

SEQ ID NO: 503 - DNA (genomic), 303 bp, Enterococcus faecium; double-stranded, circular
  misc_feature (B) LOCATION 1...303
  hypothetical: NO
  anti-sense: NO
gaaaaggagacgaatgatatgaaaatttttgcagtatgtcaaagtggattaggaacaagttttatggtagagatgaacatcaaacaagcacttgcagatcttggagcagatgtggacgagtttgaagtaagtcatacggatgttggaagtgtatctagcgatatggctgattatttcttcattgagcattctttgaaagatacgctaacttctatacctgatgaaaagctcgtacctttgcaatcgatcattgacagcgaagaagtaaaagaaaaagtaacgaagatcttgtcaaaagaataa

SEQ ID NO: 504 - DNA (genomic), 372 bp, Enterococcus faecium; double-stranded, circular
  misc_feature (B) LOCATION 1...372
  hypothetical: NO
  anti-sense: NO
ttcatttggactgtatcgattcccatatggatcaaaacttcgataccatctttcgtttccagcccaattgcatgtttgctagggaaaatacttgtcacttttccagcgatcggcgcaacaacttctcttgatgttggaataacagcaaagccgtcacccatcattttttgtgagaataccggatcttttacttcagataaaggaatcacttctccagaagctgcggaaactagttcttgttctatacctaagtattgcttactacctgcttgtccatttcctgtagaaaccatttctggctctggaatctctgctcctgattgcagcagatcttcgatatctgatttcaagacatctgcttttggtccataa

SEQ ID NO: 505 - DNA (genomic), 1188 bp, Enterococcus faecium; double-stranded, circular
  misc_feature (B) LOCATION 1...1188
  hypothetical: NO
  anti-sense: NO
aacatttggacaaggagatgtaaaataatgacagttaaaaatttaaaaggtgtaacagctgcaagcgaccaattgatgaaagcttttaaagatggtaacgaagaatcttttagcgcagctatggtaagcttatctaaggaaattcaggataaaattttagaagaagcaacagcaaaaaatcaagatcaattagtattaatgaaccgtggtcagcgtgtattaactacacaagaaacaaaattctataacgaagtagtgaaaaacgaaggttttgcaggggtcgaagaattagtgccagctactgtatttgaacgtgtatttgaagatttagaacaatctcatccactattgcaaaaaattacttttgttaacacaactggtgtaacagaatggattgtgtcacgtggagtcaatccagcatggtggggtaaactttgcgaagctgttaaaaaagttttagataatggctttgatgtaattaacatgaagcagttcaagctatcaggttatattcctgtatgtaaggcaatgcttgatttaggtccagtatggttagatcgttatgtccgtactgttttagtagaatcattgagaattgcattagaacaagcaattgttgatggtactggtaaagatatgccagtcggaatgatgcgtgacatgagcaaacaaactagcggagaatatgctgaaaaaaaagcagaacctattacagctttagatgctgtaactatgggcggtttgatggcgcgactatcaaaattcaatatcgaaggtgtgaatgatccgatttatcgtaatgtgaatccttctgatgtggtcctaattgtgaatccaactgattactggtctaaagtattcccagctaagactgtactaactgctaatggagaatacgtacaagtattgccagtaccagtttcagatttgcagtcaacggctgtgccagaaggaaaagcagttattggggtagcctcagattacttcatgggtgtaggatctacactaaaaattgaagcttcagatgaataccattttgttgaagacgaacgcatttatctagctaaacaatatgcaaacggtcaacctaaacgtaacgatagtttcattgtattagatattagcgctttgggaactactactacaactacaaaaccaacaaccacaacaactacaacacaagcgtag

SEQ ID NO: 506 - DNA (genomic), 189 bp, Enterococcus faecium; double-stranded, circular
  misc_feature (B) LOCATION 1...189
  hypothetical: NO
  anti-sense: NO
cttggctggacttattattgcaaatgtaagcttttgaacaccgtttaccaagaggttgtgaatctgccgtttaactctgagtcacaaggaacaatttcaaaaaacagcttttcatgtttgatgaatattgtgacttgtgaccgagaagttggcaggagaaaaccgtttatacgaaaaaagggactgtga

SEQ ID NO: 507 - DNA (genomic), 402 bp, Enterococcus faecium; double-stranded, circular
  misc_feature (B) LOCATION 1...402
  hypothetical: NO
  anti-sense: NO
cttggctggacttattaccgcagatgcaagcttttgaacaccgtttattcgaaaaaaaaggactgtgacacggcttttgtcacagtccccttttttcgaataattattgtccccctgtcaccttcacgatcacaagtacattattcctatgaattaaattatttttcttcatttttcgttgaaccatcttcgttcaacattgcttttcttgacagatttacgcgtccttgtttatcgatttcagttactttcacaaggatctcatcacctagtttaacaacatcttcgactttattgacacgatcgtttgctaattgggaaatatggacaagtccatcttttcctttgatcaagttgacgaatgcaccgaatttttcgatacggacaactttccctagataa

SEQ ID NO: 508 - DNA (genomic), 222 bp, Enterococcus faecium; double-stranded, circular
  misc_feature (B) LOCATION 1...222
  hypothetical: NO
  anti-sense: NO
cttggctggacttattaccgcagatgcaagcttttgaacaccgttttccaagaggtcgtgagcctgccgttcatctccgagtcacaaggaacaatttcaaaaaacagcttctcatgtttgttgaatattttgacttgtgaccgaggagttgacaggagaacatcgtttattcggaaaaaaaggactgtgacacgacttttgtcacagtctctttatttgtaa

SEQ ID NO: 509 - DNA (genomic), 2091 bp, Enterococcus faecium; double-stranded, circular
  misc_feature (B) LOCATION 1...2091
  hypothetical: NO
  anti-sense: NO
aggggatggacgatggaatttgctgagttagttattgtatttgcagtaacgatcaccttatcgaacatagctagccgcattttgccaatgattccagctccactgatccaaattttccttggagtggtattaggtctgacagagtggggacaatcaatcgattttgaacctgaattgttcttagttatgattattgcaccattgttatttagagaaggagaaaaagcagatatttcttcgattctcaaaaatttcgggacaattttgttcttggcatttggaggagtcattttgacccttgtcggggtaggtgcgacgttatcattcctgttgccaagtgtcccacttgctgcctgctttgcttttggagcagcgttaggtccgacagatgcggtagcagtcagttctctttctggacgagtgaatatccctaaaaaggcgatgcatattttggaaggagaaggtcttttgaatgatgcatctggtgttactgccttccagtttgctcttggtgcgctgatcaccggatctttttcagcagtaaacgcggggatgagtctagtagtttctagtattgggggagctttgatcggctttttgcttgtctggttcaaacaaaaaataattcatttgatcgaaaaagcatcagcacaagatgtcacagggtatctgctgatcgaacttttgcttccttttctagcctatgtattggcagaggcatttgatgtatctggaatcattgctgcagtggcagcaggtattctccaagcttctggttttaggaaaatctctgtgtttgatgcagaattgtcgagcttgtcccacagtacatggacaactattgcttttacactgaatgcattagtatttatatttttaggaatcgaattgacgcaagtgttctcgccagtatggggagacggtttatatccaaacggtcttttattagcgattatcgtattaatctctgtcatgctttttgtgatcagattcatttctatcagtcttttttatgtattcaaagatggcagtaaaaagttcaaaaaacagttgaacgagatcttgatcttaacatttggcggtgtaaagggaacagtcagtttggctacgatttttattttgccattttcaatcaataatatgatgttttaccagcggtctttgcttttgtttctgacggcgggtgtcatcttagtgactttggtcatagggatcattgtcttgcctatgctgacggaaacagaggaagcgaaaagcacggatttgaatgctttgatgattttagaagaggtcgttgaagttttgcgaaaagaaataaaggaaattgatcgtaatacaaaagaatttttagccactgaagcagtgatagaaaattatcaagaacggatacgtgatctgtacttggaagatttaaccgatgatgaaaagcaagaagtacaagaaatacaagcactgattttgtcgatcgaacgggatggattggatgaaagttatcgttcgggcaagctttcttctaatggttatcgtttttactcccgttttctttctcgattcgaacattctatcacaagccagattttgtcttttatcggcttttggttcattgttgtccgtaggttaatgcgaatcgttctccatccgaaaatgttttggcaaagaagatatgctgatcgtcagacatttattagtgatgaagatatccaagaaatcagagagacatatcaaaaaaatactcagttgattattgaaagtttagataacttgactgatatttatgatgaaacgatggttcaattttttatccagcaacgcaaacttgaaggaataaaaatgaactcggggaatttgatttcttcgtggatgatccagcaagatagtctgtttacgaaaaaaatgctaagaggttattatcttgaaagaaaaatcattgatgaatacgaagttgctgaaaaaatcacgacgttttctgcgaacagctatcgcaggaatatcaatttgttagaatcttatacgatgaacaaaccatctgataacttttctttccgatttgcgtttcgagcaaagtcaaaaaaaacgagtccaataaaataa

SEQ ID NO: 510 - DNA (genomic), 1491 bp, Enterococcus faecium; double-stranded, circular
  misc_feature (B) LOCATION 1...1491
  hypothetical: NO
  anti-sense: NO
gacaggtggactgaccgtttctattacattcaaggagggatgagcgtgtatcaagtgttattggtagatgatgaatacatgattttgaatgggttaaaaaagataattgattggcaaagtttaggctttcaaatagtagcaacagcagagaatgccaaagaaggactagctgtacttgaacagcgacagattgatttagtagtaacggatgtgacaatgccagaaataaatggactggaatttattgaagcggctcaaaaagaacgtcataattttgaatttatgattttatcaggataccaagaattcgattatttgaaaggaggtatgcaattaggcgccgtgaattatttgatgaaacccgtgaataagttcgaattggttgaaagcctcaagaaaatcaaaacacggttagatcagcaaaatgaacaaaaaaatcaacaagaaatctatcaagaactgttattcagtcaatggttgaatgaagaattggatgaaataagtgaagaagaaataataggacaaataagtgagaagcagcataggatagtattgattcaactggcaagaactcatgatactcttatcaatagatggttgcaagaacggcaacaaatcttttactatcaacgaaattacggagaccgtgtattgatcacgttgttgttggaggcagatgaagttgatggcttctgttgttttgttcaagaaaactttcctgatcaggaatggctgatcagtatcggggaagagacagattctttggacaaaatccctgaaacattccaacaagcgaaagacaatctacagttgcatcaattttatggagataaagacgagcatgttttttacgcagtacaagcagaaacaaaagatcaaaccatcgatttttcaagtttcagacgcgtgctgcaaaataaacaattggaagtcgctcaaaaaatgatcactgatttttttgaacagtttcagttagcagccatgatgccggaagatatacgatattccagttttttactgtttatggagattcaacgggaattgattgatctggaagatgaggaatatttacaaggaatcgaaaaaatccatcaggcaaaaacggtgcaagaacttcagcagctacttctgtcattcatcaaaaagcatcagagacagaaaaagtacagtgacaatgtggaaaaagtaatcgtaatcctgcaccagcattatcaagaaccacttacactcaaagaagtgtcagaaaacctgcatttaaatgtcatgtatctaggacagctgttcaaaaaagaaacgaaaaaaagtttttcagcttatttgaaccatttacgtatggaaaaagcgaaacaactgcttttgcacagtaatcaaaacatcaatgagatagcaagtgagattggctacaacaacaccacgtatttctctaaattattcaagaaaatcgtcggcagatcccctaaagagtaccgagaaaacagtggagaatcataa

SEQ ID NO: 511 - DNA (genomic), 669 bp, Enterococcus faecium; double-stranded, circular
  misc_feature (B) LOCATION 1...669
  hypothetical: NO
  anti-sense: NO
atcaatcggacggaggaacaacagatgaaagtactagtaacaggttttgatccatttggtggggacaaagtgaatccagcctatgaagcagtaaaaaaaatgccagatgaaatcagcggtgctgaaatcatcaaagtggaagtaccgaccgtattcgaaaaaagcagtcaagtagtcaaagaagccatccaacagcaccaaccagatgtcgtgatctgtgtcggacaagcaggtgggcggtcagcagtctcgttcgaacgtgtcgcaatcaatctagcagaagcaagaatccctgataatgaaggaaatcagccattcgatacggctttagaagaaaacggtccagccgcttactttacctcattgccaatcaaagcaatgacaaaaaatgtacaagatcatggtctaccagcgtacatctcttatacagcaggaacatttgtctgcaatgatatcatgtatcgtttgcttcatttgatcgaaacacaattcccggcaattcgaggtgggttcatccacgtgccattctcacccgatcaagtgatcgatcgtccagtgggtacgccttctatgtctttagaagacattgcttcttctttgacttatgcagttgaagcagcagtagaaaataaagaagatatttccggaaatgccggaacaactcactaa

SEQ ID NO: 512 - DNA (genomic), 231 bp, Enterococcus faecium; double-stranded, circular
  misc_feature (B) LOCATION 1...231
  hypothetical: NO
  anti-sense: NO
gccacacggacaactaaaagtcatacaaagctatcgaatcaatcaacagaagacaatcggcaatcattagctttgtttacagcttacattgcaacgcttgagttgaaccgaaaatacgagggaggtaacgcagccattttgagttggggaatctttttagaaaattatcgggtaccttgttgtttagtcaaaattataagggggagtaatagtgaggaacaaatttcataa

SEQ ID NO: 513 - DNA (genomic), 189 bp, Enterococcus faecium; double-stranded, circular
  misc_feature (B) LOCATION 1...189
  hypothetical: NO
  anti-sense: NO
aaaatgcggactctaacgttctggataagtagaaagaacgaatacgtaaaaatgaataaaaacaactggttaaatctgttttttttgctccttatgaaaatcaaatatgttataattaaggaattagaatgggaggtaagcacagatggattctttgtcgaaaaaacttgcgatccaagtattaaatga

SEQ ID NO: 514 - DNA (genomic), 1320 bp, Enterococcus faecium; double-stranded, circular
  misc_feature (B) LOCATION 1...1320
  hypothetical: NO
  anti-sense: NO
agtttaaggaccaacgtagttatcgtacgaaaattagaagcttttttttgttgggaatccggtttctttaacaaagctaagatagcgagttgcttggaaaagttgctatcttttttctgtcaaaacgactcggaatgttcgttttttgttctaatttctccaagttgtttactttttgatactaagtttatgaaaaatcaggaaatagttgttatactaggtaatgctgacaaacgggattggcatttcatcttggttcagctttttttccaattactaggaaggagggatagattgttcaagacttattttcgtttcaataaaatacaagataatccttttcgtatcatgaatctgatgctacttatctttattgtattatggttaggttacataaatcatgattttttgatttcaagtttttcatcattagggatctttacttttttctattatcaaaacataccgatgaaatatttgctgaaacgtatgtttctgatcggttgcggactgttggttgctttcgttttggggatcttatcgacttatgttttatggcttgaaccatttgccgtagctttggttgctttttccagcagattcgtgttgcgattattccatatttctaaaccaggtggcttgttttttgcgatgctttctgccatgggaacgagcatgcagctgccaatcgctcaattaccgatcgtctcactttatttttttatgggtgtcgtttttgccctgattgcggcagtgattacaaaattactggattcacggcctgagcagacaattgaaaaagcaactttaaaagaaagatttcacgaagagcctttagtgatcattgattctgttttctacagcgctgccttatttctttccgtttatgtcagtcacggcttgaatctgcataatccttattggttgaccttgtcatgtgcatcgattttgctagcagaaaacttggatgcgatgaagcatcgacaagtccaatatctgattggatcgatgggtgggttatgtgtgtcggcattcttgtcatttgtgccgtttacgcagttgcagaccatttttctgatcacttttctatatggaatcgcacaatttctagttgctagaaattatgcagttgctaatatttttcttaatccgatggcgttgatgctatctacacttattcgtggagcatacttgatttctttgatcgaatatcgttttttagggatcgtcataggaagtttcatcggtttaggtgttgcgtgggtaatgacggttggtttgcaacattatttaacggttgttcgtcaaaaattagaatag

SEQ ID NO: 515 - DNA (genomic), 747 bp, Enterococcus faecium; double-stranded, circular
  misc_feature (B) LOCATION 1...747
  hypothetical: NO
  anti-sense: NO
aggaaaaggacgaatacgtgtgacatgcaaaacatgtggtataaaattcgaaacgaatgtttaagggagaaaagaatgaaattagtattattacgtcatggcgaaagcgaagcaaattttgaaaattactggacaggatggctagatgtcgccttaacagaaaaaggaaaagaacaagcagcagttgccggtcaaaaaatgcttgaagccggacttcaattcgatgccgtttatacctctgttttgaaacgtgcgattcttaccggacaagtcgcactagaagaaatgggtcagttatggcttcctataataaaaacatggcgtctaaatgaacggcattatggggatcttgtgggtaaaaacaaagataagatgaaagaaatatacggaaaagatcaagtaaaaacatggcgcagaggatatacggaagttccgccgttaaccgcagaaaatatatttgaccgcagatatgatcacttggatccgcatttgatcccatacggagaaagtctggaaatgacagtgaatcgggatcatttccccttatggcaagatcatctagcaccaaaactaaaagatcggcaagatttactacttgtgggtcatggtaatagcatccgagcactgacaaaatatttagaagatgttcctgaagatcaaatggatacgatcgatatcccaaatgcacaaccaatccagtatacattagcagatgatttgacaattctggacaaaaaaatactttaa

SEQ ID NO: 516 - DNA (genomic), 189 bp, Enterococcus faecium; double-stranded, circular
  misc_feature (B) LOCATION 1...189
  hypothetical: NO
  anti-sense: NO
aatagaaggacaaatatatgtgccaaaagaggttatgacaagatttttgtcacaacctctaattcaaggtgttcaaaagccagattctcagcattaagtcaaattcacacaaaaatgtggaaaggaactttcaaaaaaattttatatttattctatcaaaaaattttgtttatgatggtaactgaataa

SEQ ID NO: 517 - DNA (genomic), 1419 bp, Enterococcus faecium; double-stranded, circular
  misc_feature (B) LOCATION 1...1419
  hypothetical: NO
  anti-sense: NO
aaattgaggacttcgattaaaaattttaatttatggaaagaatggtatctatatatattttttatagggatgattattcgtgcaataaatttttatagtttattaccgtccacttttgatagtattttttttaaacttataggaatttcaggagttttgctattagggatagatttcataattaaatttaataaaagaaaagtaacttataacattttattgatagcatatatggtgattttagtaataacgagttttgttcataaagaatatggtctaggagaaaacttaaagactataatgtgggcaatcttacagtattttttgatttatcagtttgcttttgagaatagcgataataaacgattttttaaaaggataagttggggatttatttatagttggtttgttttagtatcaatgtcaatggttcttttctttggtaaattcggctatgagaaatattataatgctagacataggatcagaattggttttttagaatcaagactgtttgggacgttttctgatattaacaatgctgctatagcatctttagttgttattgtcctaatcttattttatctttataataaaaaagtgacaggattaaataaaatcatttttttaattaatcttccattacaatttatttatatagtattaagtgggtcacgatctacctatgtggtaagtataataatagttgccatatcatcttttattgttgtgttaaaacgaaatggaacaaaaaaagatttaaaaaactatatccttgctatagtatcttctattggttctgttctgattttattcgctttgtttaatgcaactaagatactttttcaagaattattacctcatttaaaagaaataaatttttttaattttacagagcgtcataaagaattaatgaataatagtcaacatattaataatactcaaacacctgataatactcttgttaggaaagacgtagctgaaaatacagatatttctaatgctagaattactatatggaaaagtgcatgggaaatatttaaaacaagttggcttatcggagtctctccgaaaaatgtagtatcttatgcacagtcaattattccagatggatatattgcgaaagtaggaattgccattcataatgcatacttgaatgtattaacatcgacaggtattctaggaataattcctttcatggcttttttaataaagagttttgtgctgaatgtttatcgaatcatctataataaatgcattggtaaagattatcattttgtttactgtttagttattttatcttatgcactatacgcagctcttaacaatgaattagtctatgaaaacactgtaggaacgtttgttttttggctatttttaggaagagttaatagcaaaaataattctagctatttttag

SEQ ID NO: 518 - DNA (genomic), 726 bp, Enterococcus faecium; double-stranded, circular
  misc_feature (B) LOCATION 1...726
  hypothetical: NO
  anti-sense: NO
aaaaggaggacaacgaaaatgagtaatgtggtttatcaactaacaacggaagatgtgtcacactttttaacaaacaaagaacatttgaatgaagtaatcagacggattcaaaaagactttagttgtatggaagaaatgaagtactttattcaaagagtcgaagaacaattgtatttggaaagtgaaacgagtcaaacgaaggtcacagtcagccataatcgtttagacgtgtataaacgtcgtcctgaaacggtaaaaaaaggaacggagcttctacgactagaaacagaaaaatacatcatgaatgtttacctagaaaggagtgagctggtcgaaaactttgtcagctacacgatttgcaggaaacactattactcagaatcagaatattattcaatttttgagagcatggaattaatggaagaagaaatggaagagctaaacagcaaagatgcgacgatagacgattattaccttgtatttactagatttttgacgtgtggaacggaatctatcgtgttaatgggaatggattatgaactcgctgtacccgaagcatttttgagggaatatgtagaagaagtagataacccaggcgacgactggtacacgactttaactgattttttagacacctatacttacgacgatacagaagaaatccaaaatgaacttgaccgtaaacgaatgccatatcaacgatttgaaaggaaaaaaaggcaataa

SEQ ID NO: 519 - DNA (genomic), 1326 bp, Enterococcus faecium; double-stranded, circular
  misc_feature (B) LOCATION 1...1326
  hypothetical: NO
  anti-sense: NO
agtctggggacagcccctttctttagtaggcgtttttttattgaggaggaattttttatggaaaaacaattaccgagtccagtgcgtattttgatgtacatgctgaagtggttggtgatcacagcgattctcggagtattcatggggaacttgtctgcttttttcttaaatagcctgacgttcgtgacagatatccgactagcacatccttggctcctttatctattgccagtcagcggcgccctttttgcttatctttatgcgtatcatggcggtctttctagtcgtgggaataaattagtgatcgatcaagggaatggaggagaagaaaagatccctttgcggctcattccattgaccttgtttggaaccatcactacccatttatttgggggatctgttggccgtgaaggaacagcagtccaaatggggggagcgttagctgataatatagcgcatttattccgattggataaagcagaacgggagattttgattatcagcgggatcagtgccggtttcagttctgtatttggcacacctttagctggaacattgtttggattagaagtgttaacaatcgggaaagtccgaacagaagcaatcttccctagcttctttgctgcactgtttgcaaatttcatgacggaaagctatggtgtttctcatctacattaccaaatgggtgtgattcctgaatggagtatgttgctgttcttcaaagtttttgttgctgggattgcttttggtttgattggttgggtattcagccgttcgattgtttttttaaaagcacggtatgcgcaatggatccctcatcctgtttggcgaaatacgataggtggagcagtagttgtagccgcagcgttgattttgcaaacacaacgttaccttgggttgagtcttccgttactgcaggaatcatttaatgaacaggcacatgcttatgactttattgggaaattattcttcacagtcttgtctttaggtgcagggtaccaagggggggaagtgacaccactgtttgagattggtgcaacacttggcgcagtactagcgcctttgctccatgtttctgttccttttcttgttggattaggttttatcggggtattttctggtgcgacaaatacaccgattgcctgttttgtgatgggaatcgaattatttggttcacaagctgctgcttacttctttatgatctgcttgatcagctttatgtgttcaggaaacagcggtatttattctgcacagcaagtagccgtcaaaaaaggaatactattcttgccaatcgtcaagagaataaaagaaaaaaacaaggtgtga

SEQ ID NO: 520 - DNA (genomic), 2544 bp, Enterococcus faecium; double-stranded, circular
  misc_feature (B) LOCATION 1...2544
  hypothetical: NO
  anti-sense: NO
tttttctttgccctgttctccatagtaactgaaattttctctaaagaaaagcttaagaactcttttataataaagatcattttctcacgttttaactcttttaaaaaagaaattcctgccaaaaacagccttgtctgtttttttgttctattatttgctataattagcgaaataaaaccattagttgaggtgacccttttgccacgcaaaaatactcgaaaaaaacagaatagaagaaaaaaagaaaaatggtttgttcctaagattatttttagagtttttcaatcattgactgtttttattactgttcttcttttgatgttcgcagctctaggtattggaataggcgctggctattttgcctatctcgtcgaaaacacacaattgccgactaaaaaagcactgcagacagaactaggaaacattacagaaacgtcaaagattgtttatgcagataatacagagatatcaaaaatccagacagatctgatgcgcacgactatttcatctgataagatttcacctttattgaaaactgcaattatcagcacagaggatgaatacttcgataaacaccaaggttacgttcctaaagctgttttacgagcattagtatctgaagctactggtattggctcttctggtggatcaactttgacacagcaattagtcaaacagcagatccttacagatgaaacaacattcaaacgtaaagcaaacgagatcattctttctgcacaagtagaaaaatacttttcaaaagatgagatcattgctacgtatttgaatgtctcaccatttggtcgtaataataagggacaaaacattgctggagtccaggaagctgcaaaaggaatctttggtgtagatgcaaaagatgtgacgctgccgcaagctgcttatatcgctggattaccccaaagcccgatcacgtatagtccatacacgaacacaggcgcgctaaaagaagatctttctgccggccttgccagaaaagattttgttttattcagtatgtatcgtgaaggccaaattacgaaagaacaatacgaagaagcaaaagcctatgaccttacaaaagactttctaccacaacaaatcgcagaacagactgacagagaattcttgtattatactgtgatgaatgaagcaacaagaatcattgcacaacaattggctgaaaaagacaacgctgatatgtctgattcatcggtcagtgacgcttattatcaaaaggcacagcaaacgatccaaaataaaggatatacaatccattcgacaatcgataaagatgtctatgctgcattgcaaaatggcgttgaaaattatggatacatgttagatgatggtgctggcagtcaagtagaaaccggaaatgtattgatggataacagaactggccgcatctacggattcgttggcggacggaattacagtcagaatcaaaataaccatgccttcgatacagaacgtcaagctggctcatcaatcaaaccagttcttgtttatggacctgcaatcgacatggggcttatcggatcagaatcccgtgtatcagattatgcaacaacttggcaagaaggagaaaatgctggcgagaaaatcgtcaatgctactaacgaaggatcgaacaccttccaaaccgtccgtgagtcactagaatggtccaacaatatcccggcttatcacttatatcaagatgtgttgaattccggtggatcgaaacaatatgcttacgagcactacttggcaaagatgaactacccggcaaatgacaattggggcgttgaatctgctcctttaggtacagtagatgtcacgacgcttcaacagaccaacggatttcaggctttagcaaacggcggcgtctatgaagaaggctatatcatcgattccatcacagataacgcaggaaatgtaatttataaacacgaaagcaactctgtccggatctattcggaagcaacggcatcgatcatgaatgacatgatgcgtagtgtgatcaatgcaaaaatcactacaccattcaaagatgccatctcaagcttaaacggaaatctaggaaaagcagattgggtcggaaaaactggttctaccaatgaataccgagattcatggctaattgtctctactccgtctattaccatcagtagctgggcagggcacgatgacaatactggaatggacagcaaagcaaggatacgttcggctaattatcttgccaatctgatcaatcaagcttaccaagcaaaacctgacatttttggcactgatgagaaattcgaattatcatctgatgtgatgaagaaaaaagtatctggatttactggtcaaacacctggaaaagttactgtcaataaaaaatccatccaaacaccaggaaaaacagttgaatcgctatgggcgaaaaatggaccgaagaaaagcgcctttaaatttggcgttggcggtaccgatgaaaactatacagattactggaacaccgcttcagcttatgcaagagcgaatcaagcaactaaagaatcagatgagaaagatgattga

SEQ ID NO: 521 - DNA (genomic), 723 bp, Enterococcus faecium; double-stranded, circular
  misc_feature (B) LOCATION 1...723
  hypothetical: NO
  anti-sense: NO
ccgcgctttgcggctttttttctgagaaaaaggagttatatcatgacacaaatcagtattgcaatcgacgggcctgcttcatctgggaaaagtaccgttgccaagatattagcaaaagaattgaattatatttatacagataccggtgccatgtatcgcgcagtaacttatttagctattacgaacaatgtatctttttcagatgaagaagggctagtttcgctgatcaaaaagtatcctatctctttttcgcaacaagaagatggacagcatgtattcatagcatcaaaagatgtgactttagaaatccgtcaaccagatgtcacaaaagctgtttctgaagtctctgcacatggaaaagtcagagaagaattagttgctgtccaacgaaaaataggggaacgcggtggcgttgtcatggacggaagagacatcgggacagctgtattaccgaatgcagaagtgaaaatctttttagtagcaagcgtaagtgagcgtgcagaaagacgtttcaaagagaaccaagaaaaaggaattccgactgatcttgaaacactgacgaaagagatacaggaaagagaccattatgattcaacaagggacgtctctccgctgaagcaagcagaggatgctgttcgtatcgatacgactggcaaatcgattccagaagtcgttgcagcaataaaagctgttgttttgaaaaaaggttatcttcttttttaa

SEQ ID NO: 522 - DNA (genomic), 705 bp, Enterococcus faecium; double-stranded, circular
  misc_feature (B) LOCATION 1...705
  hypothetical: NO
  anti-sense: NO
gcttgccttgcatgcttgttatcccttaaaaggaggaattacatgtctttaaaaaaatatagcttcctcagcattttttgctatggtctaatttttatctcacccttgatcctagcttcgataggacttgtaaaatctacgtctgaattgatcacagcaactgcagtcatgtatatactaggcgccgttgtcctagctattttttattttaagcaacgtgaacccttagcgatcgaatcagcggtaaaaaaagcttctgctccaaagattgttatttatggattggttggaatctttgtcgcattgattctgcaaagcatcgctgtcatgttagaatctgtattgtttggcaaagcaaccccttccgagaatacacaaaatatcatccagatgatcatggaagcacccgcttttattttggcgacaactgttgctggacccatcatggaagagttcgtattccgccgcagtatactggggatcatcagtcgatattcaaatttttgggtcggagcagtgatcagctctttgctgtttgcgtttgctcataatgatggtcatctgctaatctactttttcctaagtttcttcttcagcctagagtacaaagcaactggtcggatctggacatcgatgatcacacacgtaggaatgaacacattagttgttcttgttcaattagctgtccaaaaagggctagtataa

SEQ ID NO: 523 - DNA (genomic), 810 bp, Enterococcus faecium; double-stranded, circular
  misc_feature (B) LOCATION 1...810
  hypothetical: NO
  anti-sense: NO
atcacaattgcgccaaaagacgtacagttccaatcggctaaattgtggcagcgtatgctgaccaactttgctggacccatgaataactttattttggcaatcctgttattcatcattctggcatttatgcaaggtggtgttcaagtgacgaacactaatcgcgtaggagagatcatgcctaatggagctgcggcagaagcaggcttaaaagaaaatgatgaggtagtcagtgtggacggaaaagaaatccattcatggaatgatctgacaacagtcattacgaaaaatccggataaaacattagactttaagatcgaacgagaaggtcaggtgcaatctgtcgacgtgacaccgaaatctgtagagtcaaatggcgaaaaagttggccaacttggtataaaagccccaatgaatacaggttttatggataagatcattggagggacgcgtcaagctttcagcggttcattggaaattttcaaagccttaggatcactatttacaggtttcagtttagataaattaggcggacctgtcatgatgtaccaattgtcttcagaagcagcaaatcaaggtgtaacaactgttattagtttgatggcgcttctttcaatgaatctcggaatcgtcaatctgcttccgattcctgccttagatggcgggaaattagtcttgaatatttttgaagggattcgcgggaaaccattaagtcaagaaaaagaaggaatattgacattagctggctttggatttttaatgttgttgatggtgctagttacatggaacgatattcaacgattctttttctag

SEQ ID NO: 524 - DNA (genomic), 393 bp, Enterococcus faecium; double-stranded, circular
  misc_feature (B) LOCATION 1...393
  hypothetical: NO
  anti-sense: NO
ttcgtttatttttttgtctatgctatgatggagatagataaaaaggagctgatacttatgaaaacatcaacaaaagtaacaatcggattaagcgtagcagccgctgccagtgtagcaacagcagtcgttgtatcgggaaaagtaatggaaaagatccatcatatgactactcggacgaaagtaaaaaaattcgtctatgacaaatttgatggaaatgaaaaattactagaaatcgtagatggtctttcagatagtgacttggattctttgatgggaatgttagcaaaaatcaaatcaggaaaaaagaaaatctctgtttatggtgattcaatcaaagattcaaccgaagatgtaaaagaccggctaatgcattttgttgaaaaaatgatgtaa

SEQ ID NO: 525 - DNA (genomic), 246 bp, Enterococcus faecium; double-stranded, circular
  misc_feature (B) LOCATION 1...246
  hypothetical: NO
  anti-sense: NO
cgagtgattgctagtctttttatttgtcctgaaggaggaatcacagtggcaaaagctaaaacgccatttgaaaaagccgcgtctaaaatcttagaacgccgcggtgtatctgaaacacagtggaaacaagaagtccttgaaaaagcacaatttgacctattacggggaaaagacaaggacttagaaggatatatctatcaacgtgaacgtgaaaagcttgttttcgatgaaattattaaacactaa

SEQ ID NO: 526 - DNA (genomic), 225 bp, Enterococcus faecium; double-stranded, circular
  misc_feature (B) LOCATION 1...225
  hypothetical: NO
  anti-sense: NO
cggacgattgctatggaaataccaggtctgcaacgaaacgttgcttcgtccagctatagttttgtccgctttttcggtggagctttagcaccatttattgcaggtgtgattggtgaacatattggtgaaagctatgcgttttattttgcaggtgccattgttcttatcagtgtatgttgtatcatttatcaccgtaattattttgctacaaatgaagaagaataa

SEQ ID NO: 527 - DNA (genomic), 300 bp, Enterococcus faecium; double-stranded, circular
  misc_feature (B) LOCATION 1...300
  hypothetical: NO
  anti-sense: NO
agggcgattgctgcaccaatgacttctgcaatatctgttgccataatggctaattcagtcaagatccataaaatgacacctaatgtcttacttgtgcgtgctcggattgcctgtgccaaatccatttggctcacgattcctaattttgctgccatatactgtaaaagcatagcaatcagactagacatcaaaataactgacatcaataaatattggaaattttgtcctccggtgatcgaagtagaccagttacccgggtccatatacccaactgctactaacgcaccaggtccagagtaa

SEQ ID NO: 528 - DNA (genomic), 309 bp, Enterococcus faecium; double-stranded, circular
  misc_feature (B) LOCATION 1...309
  hypothetical: NO
  anti-sense: NO
gaaggagttgcttctgcttccgccgtttatacgtgtttagagcgtgagacaaaagtgttctttacttttgtcccacgctccttatttttttattttgtttggatcaattcttttaattcctctattgaaatagattcatcaaagatttctttacccaagatgacagttggaacaaatcgaatatgtgcttgctcagcttcgttgatgacagcttggctcagctgttcgtctttttgttctgtcagctttagtttatctactgcaaaatccgctacttcttggagagaaagatgtttccactcgtcttga

SEQ ID NO: 529 - DNA (genomic), 546 bp, Enterococcus faecium; double-stranded, circular
  misc_feature (B) LOCATION 1...546
  hypothetical: NO
  anti-sense: NO
ggaagggttgctatgggagttccaaaagaaggagagtttgtgacgatccaaagttacaagcacgacggcaaattgcatcgaacgtggcgagataccatggtattaaaaacaagcgaacactctatgatcggcgtgaatgatcacacattagtcactgaatctgatggacgccgatgggtaacgcgcgaaccagcgattgtttattttcataaaaaatactggttcaatgtaatagcaatgatcagagaaaagggggtttcctattattgtaatctagcttcaccttttttgctggacgatgaggccttgaaatatatcgactatgacttggatatcaaggtatttcctgacggcgagaaacgactattggatgtcgatgaatatgagatgcacagcaaaatgatgaattacccgaacgatattgacttcatcctaaaagaaaatgtgaagattctggttgactggatcaataatggagatggcccgttctcggaaggctatattgatatttggtataaccgttacaagcaattgtcgcgtaagtaa

SEQ ID NO: 530 - DNA (genomic), 216 bp, Enterococcus faecium; double-stranded, circular
  misc_feature (B) LOCATION 1...216
  hypothetical: NO
  anti-sense: NO
ctgtttcttttcataaaaaaacatgttgtgactctgagacaaatcatagtccatagtgatgtctctagagtaactacgcctaatattacgaggcatcatattaatctatcagcactagtacctaaactagcatccctttcgaatattttttcttatataataaagtttgctttcactcctctaatctcaccaaatcgactggcttgcgttgtgtga

SEQ ID NO: 531 - DNA (genomic), 933 bp, Enterococcus faecium; double-stranded, circular
  misc_feature (B) LOCATION 1...933
  hypothetical: NO
  anti-sense: NO
tcaatttctgctataataaaaaatgccaaaaaaagaaaaaaccataacaaaaaggtatggatgggatggataattatgaaattgcttcatctgcagtattttaaaaaagtattcgaaacaaaaaatgttacccaagcagccaaagaattatttatttctcaacctgccttgagccgtgcgatcaaacatttggaaaacgaattaggtgtccctttgttttaccatagcggcagaaacattgagacgaccgtttatgcagaagaattttatccatatgcagtcaagacattagacacattagaagaaggaatcaaattattgtcttcggtcaatgagaagatcgttacttccgtcatattgtatttagaggtagcctctgtttctattccgaacttggtccgaatttttatggaaaagcatcctgatatccaattaacgatcatgcaacatcatttaccagatgatattaccgatcctgtactgtacatcacttcggagatgaagcctggcatgaccaatattcctatcatgaaagaacctgtttatgtcgccattcctaagaaacatcctcttgctaaaaaagaacatctgcaattagaagatatccaacgcacccccatcttgatgctgtcaaagagcaacgccttccgtcatacactggatgcagcacttgaagcgaaaagtatcgaattgacgatcagttcgacgacagatgatcctgcgacattacgttctattgtcaagcaaggattagctgttagctttttcccaaaagtttcttggtcttacgataaaaatgatcctttcgtcttgcgggaaatcaaagatttgcccttgacacgaacaatttatttatcttctagcttcacagaagatcatcctttgatcaaaatgattgcaaaaacgatgcgggaattttatttaggaaaataa

SEQ ID NO: 532 - DNA (genomic), 225 bp, Enterococcus faecium; double-stranded, circular
  misc_feature (B) LOCATION 1...225
  hypothetical: NO
  anti-sense: NO
aaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataaacagaacagaaagaggttttcttctttctgttctgtccaaattattctaa

SEQ ID NO: 533 - DNA (genomic), 225 bp, Enterococcus faecium; double-stranded, circular; identical to SEQ ID NO: 532
  misc_feature (B) LOCATION 1...225
  hypothetical: NO
  anti-sense: NO

SEQ ID NO: 534 - DNA (genomic), 225 bp, Enterococcus faecium; double-stranded, circular; identical to SEQ ID NO: 532
  misc_feature (B) LOCATION 1...225
  hypothetical: NO
  anti-sense: NO

SEQ ID NO: 535 - DNA (genomic), 225 bp, Enterococcus faecium; double-stranded, circular; identical to SEQ ID NO: 532
  misc_feature (B) LOCATION 1...225
  hypothetical: NO
  anti-sense: NO

SEQ ID NO: 536 - DNA (genomic), 225 bp, Enterococcus faecium; double-stranded, circular; identical to SEQ ID NO: 532
  misc_feature (B) LOCATION 1...225
  hypothetical: NO
  anti-sense: NO

SEQ ID NO: 537 - DNA (genomic), 2487 bp, Enterococcus faecium; double-stranded, circular
  misc_feature (B) LOCATION 1...2487
  hypothetical: NO
  anti-sense: NO
acagattctgccggttttttcgttatatttataatagaaacaagtgttttcaatagaacaggaggacagcaaatgagttacaatcataaagaaattgaggaaaaatggcaaaaatactgggcaaaaacgaatactttcaacacccatgatgatcctgaaaagccaaaattttacgcactggatatgtttccctatccatccggtcaagggctacatgtagggcatcctgaaggttatacggcaacggatatcctttcacgtgtgaaaagaagtcaaggatacaacgtgctgcatccaatggggtgggatgcattcggtctgcctgctgaacaatatgcgctagatacaggaaacgatccagctgagtttacccaaaaaaatatcgaaacattccgacgccaaatcaattctttaggatttagttatgactggaatcgcgaagtgaatacaactgatccggagtattataaatggacacaatggatctttacgaagctttatgaaaaaggtctagcttatgaagcagaagtagcggtaaactgggtacctgaattaggaacagttatttcaaatgaagaagtgatcgatgggaaaagtgaacgtggtggctatgatgtagtcagaaaaccaatgcgccaatggatgctgaaaatcactgcttatgctgatcgcttattggatgatctagaattagttgattggccagaaagcattaaagaaatgcaaagaaattggatcggtcgttcagtaggagcaaatattgaatttaaagtggctggtacggataaatcctataccgtatttacgacacgaccagatactctattcggtgcaacttactcggttcttgcacctgaactagatcttgttagagaaattacgacccctgaacaaaaagctgctgtagaagcttatatcgaagagacagctaaaaaatcagatctaaagagaacggatcttgcaaaagaaaaaacaggagtatttactggtgcttatgcaatcaatccagttaatggcaaggaaatcccaatctggatcgccgattatgtattatcttcatacggcacaggagccatcatggctgttccagcacatgatgaacgtgactttgaattcgctcaaactttcggactagaaattcttccagttatcgaaggtggagatgttgaaaaagctgcttacacagaagatggtacgcacatcaactctgaatttctagacggcatgaacaaacaagaagcaatcgataaaatgaatgaatggctagaagaaaatggcgtagggaaaaaagaagtcagctatcgcttacgtgactggctattctcccgtcaacgttactggggtgaaccaatcccaatcatccattgggaggacggaacagtcacagctgtcccagaagaagagctaccattacggttgcctaagacaaaaaacatcaagccaagcggtactggagaatctccattagcaaatatcgaggagtgggtcaatgtcgttgatcctgtaacaggtaaaaaaggccgtcgcgaaacgaatacaatgccacaatgggcaggaagctcatggtattacctgcgttatatcgaccctcataacaaaaaagaactagcagattatgaaaagttgaagcgttggctaccagttgacatctacattggtggagcagaacatgcggtacttcatttactatatgcacgattctggcataaattcttatacgatatcggtgttgttcctacaaaagaaccattccaaaaactatacaatcaaggaatgatcttaggcgaaaacaacgaaaaaatgtcaaaatctcgtggtaatgtagtcaatcctgatgatgtggtcgaaacttacggtgcagatacactgcgcatgtacgaaatgttcatggggccattagatgcttcgattgcttggagcgaaaatggcttagaaggaagccgtaaattcttggatcgtgtatggcgtttgatcgttgatgagaacaataaaatgcgtgaccgtatcactacattgaatgatggcaagcttgataaagtgtatcatcaaacagtgaaaaaagtgacagaagactatgaaaatcttcatttcaatacagcaatctcccaattgatggtctttatcaatgaagcctataaagtggacgctctgccttatgaatatatcgaaggatttgttcaactactcgcaccgattgctcctcacatgggtgaagaactatgggcaatccttggaaatgatggtggtatttcttacgcaccatggccaacatacgatgaagcagcacttgttgaagacgaagtagaagttgttttccaagtaaacggtaaagttcgtgcgaaaagcaatgttccccgagacttaggaaaagatgagctagaaaaagcagcattagccaatgaaatagtgcaagaatatattgaaggcaaaacagtcagaaaagttattgcggtaccaaacaagttagtcaatatcgttgctaattaa

SEQ ID NO: 538 - DNA (genomic), 333 bp, Enterococcus faecium; double-stranded, circular
  misc_feature (B) LOCATION 1...333
  hypothetical: NO
  anti-sense: NO
gcggattctgctgcttttggttcattgcttggttctttaggagtagcattcatcagcgatcttttctctaaacgtttgaaaatgcccgtaacgattttcaatattcccgggatggttcctctagtccctggtggtttagcttatcaagcggttcgaaatctcgttactgaatcctatcgagaagcggctcattatgcggtccaagcaattatgattgctggagcaatcgctttaggtcttgtattatcagaagtctttaaccataacatccgtaatttcaaagtaaagcgtgacgcaatcatgatgaaacgaaaaaaacggctttttaaataa

SEQ ID NO: 539 - DNA (genomic), 834 bp, Enterococcus faecium; double-stranded, circular
  misc_feature (B) LOCATION 1...834
  hypothetical: NO
  anti-sense: NO
gacgtctctgcggaaagggtgggtgaaatgacgagactaagggcagctgatattgcagccggctacgaaaataaaaaaattattgaaaacatgtctgttacgattcctgaagggaaaatcacgagcttgatcgggccaaacggaagtggaaaatctactttattgaaaagctttacccgtatactacctgtgaaatcaggaaagatcattgtcaatgactctgatatatctacatacagttcaaaagaacttgcaaaaaaaattgctttattagcacaaactagtgaacatcctataggtatgacagtagaagaagtagtatcttacggacgatatccctatcaaaaactgtttagtggtatggatgcacaagatcatgaagcaatcgagtgggctttggatgcaacaggtttgtctggatatcgcacgcgagatatcgcaacgttgtctggtggacaaacccagcgtgtctggatcgctatggcacttgctcaggaaacagatatcttgatcttggacgagccgacgacgtttttagatccgtcacaccaattagagatcctacagttattgtctcaaatcaatcaaataaaacaaacaacgatcttgatgtcgatccatgatattaatcttgcttcacgtttttctgattatttactaggcatgaaagacggtgaattgattacggaaggtacacctgaagaagtgatcacgaaagagtgtatgaaaaaaatatttgagattgatgcaacgattgtcacactaccaaaaacgaataaaccagtttttctgacgtatgatctgttgccaaaagagcaggaggatcaattatga

SEQ ID NO: 540 - DNA (genomic), 222 bp, Enterococcus faecium; double-stranded, circular
  misc_feature (B) LOCATION 1...222
  hypothetical: NO
  anti-sense: NO
gctctatctgctggtattatgttaaataatttacttacaacagtgcaaacccctctaaaatgtattggcctactagctccacataaaccttctgttattccagttatattaacaaaagtacttgcattgtcacaatacatctcttcaacttcaggattaaatattgctgttgctctacctcttgtgcatacttctatatctctttctaagtctcttggataa

SEQ ID NO: 541 - DNA (genomic), 195 bp, Enterococcus faecium; double-stranded, circular
  misc_feature (B) LOCATION 1...195
  hypothetical: NO
  anti-sense: NO
tgttctcctgctaactcctcagtaataagctcaatggaccaggagctattttttgtttggctgtttttatcacttggtgcagggcagctttttcacgacctctccactaaacagtattcaaactgctgcttctcggtaataagcccaaccaaacgaaaaataggaggagctatttttgtttggctgttcttatga

SEQ ID NO: 542 - DNA (genomic), 894 bp, Enterococcus faecium; double-stranded, circular
  misc_feature (B) LOCATION 1...894
  hypothetical: NO
  anti-sense: NO
cggtgtcctgccgatcagccagaaaaaattgggactgaccgctcttgggattttcgctgggctagcgatcctctttctgatcggaggttacttgatatgatgaaaaaattttttttattctttcttttgctagtaagtgttggctggccggtggctactcatgcagatacagctacggtaaatgatgaggctgggttatttacaacagatcaaatccaatctttggaacaacaggcagaaaagctgaatgaaaaaatcaaaggacgagtcttgatcgtaacgactacatctaattcagaagaaccaagagactttgctgataattacttaagagacgcagtcggaaatgatcaaaatggctcagtattgctattagatatgggacagcgtgaaatctacatttcgacttctggtaatatgatcgattatttgactgacagcagaatcgattcgatcttagatgatgtttatgatcagatgacaaatgctgcctattacaatgctgcaaaagcttacctgtctaaatcagcaacatatgtggaagacggagttccaggaggacattatcgtgtagacgaagaaactggcaaaattacacgctataaggttttgacgacagtagaaatcatcattgctgttgttttggctcttatccttagtcttgtcttttattttgtgactgtttcgcgttatcaattgaaatcaggcatctacaaatatccattccgagaaaaatccagtatcaaattaactgaaaaaaccgatcgtctgacaaattcttttgtcacgacaagaagaatccccaaaagcccacctcctggaagcggcggtggcggaagtactacccattctagcggtggcgggacttttggcggtggcggcagaagtttctaa

SEQ ID NO: 543 - DNA (genomic), 1281 bp, Enterococcus faecium; double-stranded, circular
  misc_feature (B) LOCATION 1...1281
  hypothetical: NO
  anti-sense: NO
ttatcgcctgctagctatgatacatggatcgaaacagcgaaccctcgaacccttgatcaaaaccagctcgttgttgaggttcctagcaagattcataaagaatattgggaaaaaaacctggcgacaaaaatcgttgaagtcggttatatgttatcaggaaatgagattatccctcgctttattactggcgaagaagcagagcaagaagaagttatagaagaaaaaaatccaaaagttgtggcacctagtccgctaaaaaaagccatgctgaaccctaaatatacctttgatacgtttgtcattggtaaaggaaaccagatggctcatgcagcagcgctcgttgtagcagaagatccaggttctatttataacccgctcttcttttatggaggcgtgggacttggtaagactcacttgatgcatgcaattggtcatcaaatgctgcaaagtcagcctaatgccaaagtaaaatatgtaagcagtgaaacttttgctaatgatttcatcaattcgatccaaaacaaaacagcagaagagttccgtcaagaatatcgaaatgttgatttactgctagtggatgacattcaattttttgcagaaaaagaagctacgcaagaagagtttttccatactttcaatgccttgtacaatgaagggaaacaaatcgtactaaccagtgatcggttgccaaacgagattccgaaactgcaagaacgccttgtttctcgctttgcatgggggctgtctgttgatattacaccgccggatcttgaaacaagaacagcgattttacgtaaaaaagcggcggctgaacgtctagagatcccagatgacacactaagctacatcgcaggacaaattgattctaacattcgtgaattagaaggtgcgcttgttcgagtgcaagcttttgctgcgatgaatagtgaagatatttcgactagtctagctgcagacgcactgaaaacgttaaaatcaggaaaaggacatcctcaattgtcaatcctgcagatccaagaagaagtggcaaagtattatcacatccaattgaaagatctcaaaggaaagaaacgcgtcaaatctattgttgttcctagacaaatcgctatgtatttggcacgtgagctcacagataattctttaccgaaaatcggagctgaattcggtggcaaggatcatacaacggttatccatgctcatgaaaaaatccagcagctgatggattctagtgtcagtatgcaaaatgaagtatcagaaatcaaaaactttttactaaattaa

SEQ ID NO: 544 - DNA (genomic), 207 bp, Enterococcus faecium; double-stranded, circular
  misc_feature (B) LOCATION 1...207
  hypothetical: NO
  anti-sense: NO
agaaagcctgcaatcagtacaggtgcaaataacgtggaaaaaaatgttccgatcggttcgaaaataaagtttatttctgatgaaatcatgatcaatgcagctatgatcaataattcaagcgaccaaaacattagtttagactgtctaagtttttcaaacaatagatttcctcctttctttcttactagtatatattatattcgttaa

SEQ ID NO: 545 - DNA (genomic), 624 bp, Enterococcus faecium; double-stranded, circular
  misc_feature (B) LOCATION 1...624
  hypothetical: NO
  anti-sense: NO
gcagagcctgcccaatgtgccgaaagtagcggcatggctgggcttgtcggaggaaacggtggaaaccctgctggcaatggccgataccgagccggaggatgtcatggacgcgctggacgatgccatttatgcaatggctaccgctgtcagtgctgcgggggaggtggatacggaatgaaaaaagaagaagcgaaagacatccctatcggcggagaaatcgctgtccggcaaactggcgtcccctatggctggctctaccggcgcacggaacccggctatcttctggcaaacgggattgcccttttggagtgtgagcgtgacagcgcaggacgctacaaaggcggggctggcctggacgggatgtatttacagaccgggcggctgtatgtgccggtactggcgggggacgggaacgtccgcgcctttcaggaagtaatccccgaaaattaccttgccgccgctgaaatgagcgtggagggcaactataaccagattgacgggatcatcaataacgagccgcccaaaccctcggtgctggatgccctgaaccagtgccgggaagatgccgccaaaggccgtgacgcgccggagaaccccccgcgcggaccgaagtggaacgaataa

SEQ ID NO: 546 - DNA (genomic), 1422 bp, Enterococcus faecium; double-stranded, circular
  misc_feature (B) LOCATION 1...1422
  hypothetical: NO
  anti-sense: NO
aggcattattttatggttaggagtgtatatatgaataaaaatggggagtggaatgcggcacgcagaatattcattattcttatggatgtacttgtattaaatgtatcgatctatcttagttttttgctgaaattccagggagaagtaccagtgagaaacttagaaacctttcagcattcagcaatttttatttccatcatctttattgcgttgaatattttgttaggagcttatgtattctataaccgaatgatcagtgatattgtcttcattactgttattggacaagtactaatagcattggggatcatggtagttacttttgctggccgatggtttgcatttccgcgtggcgtcattttgatctcgtttatcctaggtacgatattacttagtgtttaccggatagtcgtttacaaactgtacttaagagtcagtcgtgataagaaagtccttatcgtgggtttggagaaagatgtcgcaccagctatccaaaattttcaatctaagaaaaacaataaacataaggttgaagcagtggcaatcgataattattacgaaaatacaaaaaaattgatcgatgatatggatatcgtctatttggcttctaaaatcccagaagatgaaaaaatcaacatttatcaattagtgactaaaaaagagaagaaattatttttaaatacgacttttgagaatctgacaatgataaatccgaatattatgaattttgaagatgaaagcatcattgaagcttctgggttcagaatccaaccagaatacgaactattcaagcgtctctttgatatcatcgtttcgcttattttactgatcctcgcctcaccttttatgctaatcacagcgattttggtaaaaacaacttcacctggaccaatcatctataaacaagtacgtattacgaaaaatcaaaaggaattttcaatctataaattccgttccatgagtgcgacagctgaagcaaaatcaggaccagtcttggctaaaagtaacgatgcacgtgtgacaccagtaggtaaatttatccgtgctgtacgttttgacgaattacctcaaatctttaatgtattgaaaggcgatatgtcgattgtcggtccaaggccagaaagaccatttttcgttgatcagttcaatgaagaaaatccttattattacttaagacacaatgtacgtgcgggaattaccggatatgcacaagtatacggaaaatatgtatcagattataacagtaaactacgttttgatttgttgtatatcaaaaaatattcattactattagatttgaagattttacttcaaacaatcaaaatcttatttgataagatgtcatctcaaggactagatgaagatgaaaatattagttcattagcagaaatcgacttttcacaagagaaaatttatcgctag

SEQ ID NO: 547 - DNA (genomic), 2574 bp, Enterococcus faecium; double-stranded, circular
  misc_feature (B) LOCATION 1...2574
  hypothetical: NO
  anti-sense: NO
aaggtgtatgcaagcttaataggaggaacacttttcatatctgttctatactggataggagaagtttgtaaatatccagaaaacgaaattgatcgaggtagccacatgaagaataaatggacaaatcgaagtaaaaaaaagaaaataacacaaaaatcatctgacaaagttatccgtctttttccctcgtacaaagaaggattgacagcagaacaagtcaaggaacgaatagaaaaaggtgcagcaaacgattcagtcgatcccacattcaaaacaaaccaacaaattatattggaaaatatttttacgtatttcaatttgatctttcttatcttagccattttgctttgcctagtagaatcttataaaaacttgacctttttaccagttatcatagccaatacaggaatcgctatctttcaggaaattcgatccaaaaaagtcttggatgaattgagtgtattgaatacagcaaaagtcaatgtcataagagaggggatagagcaaacagtagatatagaaaaccttgtattagatgacattgttattctagagactggacatcagattccagcagatgcagaggtcgtggaaggaaaactgcaagtcaacgaggctttattaacaggtgaagcagatgagataaccaaagaaataggtgatccattgatgtccggcagtttcgttgtttccggaaaagcttacgcccgattagacaaagtcggagcagattcgtatatttcccaattgacagtcaaagccaagacaatgggagaaggagaacagtcggagatgattgcttctcttaatcaattgatcaaatggattgggatcatcattattcctatcggtattctgcttttttctcaaagttacttttttaatggaaacacgatgaaagaaagtgtcgtcgcaatggaagcagcattgattggtatgatacctgaaggactgtacttgttaacgacgattgcattagcattaagtgcgactaaactagcaaagcaaagagttcttttacacaatatgaaaagcattgagacattggcaagagtaaatgtcctttgtgtagataaaacaggaacgatcacagaaaacaaaatgtctgtccaaaaagtgattgtctctaaaaaacaaaaaataatcagccaatcagaccaactggaagagcgcattgctgactatgcaaaagcgatggcaggagacaatgcaacaatggaagccgtcaaagaatactttacaaaaaccactgatcaatcctatcaccaagtcattcctttttcttctgtccaaaaattcagcagtgtagcgttgggagacaaggcatatgttttaggagcacccgaaatggttttgcgagatcagttgccggaatatgcggaagagtttgtttctttcgctgaaaaaggctatcgcgtgttggtctttggtgtgtacgatgggattcttgaagaaccagtattaacggaggcagtcacaccattagggtatatcctgatcgctaatcctatcagaaaagaagcaaaagccacattcaattacttcaaaaaacagcaagtagccatcaaagtgatttctggagataatccgctcaccgtatctaatgtagctgtccaagcagggatttcacatgctgatcagtacgttgatgcgtctaaattatcagaagaagaatatgaagcagctgtcgaaaaatatacagtttttggacgcgtcaagccagaacaaaagaaaatcttcgttcaattgctaaagcgtaacaatacagtagctatgacaggtgatggcgtgaatgacattctagccatgaaagaagcagactgcagtatagcgatggcttctggcaatgaagccgccatgcaggcctcacaagtggtcttgattgattctgacttttcacgcatgccggaagttgttgcagaaggacggcgcgtcgtgaacaatattgagcgatcagccagcttgtttttagtgaagaatattttctcctttttgctttcgctgttttcagtcatctttgctttgacctatcctttagaaccatcacagatcacattgattagtttgtttacgattggacttccatctttcttgcttgctctagaagaaaacaaaaagcgaatcagagggaagttcatcatgaatgtgatggaaaaggctgtgccaggtggactgacagatatgatcgtagtcggtgcgttggtgatctgcggggtgactttggatctaaataaaacagatgtttctacagcatctactatgcttttgattgcagtaggatttcttgttctctataaaatctgttcaccgctgaataaattcagaagtcagatcattcttttctgtgctagcggtatctttttttcggtcgtttttttgcataaactgttttcaatcaccggtatctcagctgtatcgcttttgttgttgagtattttatttttctcggcagattcgatttttaggcatttgactacattggtagaatatttgtttgaacgtaaaaatgaaaaagagccggagataataaataaattgcctcggttccttcgagtattcaaaagaaataaatga

SEQ ID NO: 548 - DNA (genomic), 717 bp, Enterococcus faecium; double-stranded, circular
  misc_feature (B) LOCATION 1...717
  hypothetical: NO
  anti-sense: NO
aagaagtatgcaggtgtgatgaagctcatgctttacatcctaaaattggcctttgttatccaattgattggtacggttgctttatcttttgtatttgtgcctgaatttggctggttgaaaggtatctggtacagtttgttccatgcaatctctagtttttgtaatgcagggtttgatttgttaggagacagtttagccaatcaccagcaaaaagtttatttgatcatggtggtatctgctttgatcatttctggtgggttaggcttcatcgtatggcgtgatttactggaatatcatcagaaaaagaagatgacgattcattcaaaaatcgcattaaccgttacaggtacccttttattaagcggattcgttgtgtgctttttcacagagcgcaatggggcaacgctagtggaagggaatatgtatcaactattggcaaacaccttttttatgagtgtgacacctagaacggctggatattattcagttgattacctccatatgagccatgcaggtctgattttaacgatgtttttgatgtacatcggcggaacatctgggtcgacggccgggcggattgaaaacaactacgttaggtgtgttgctgatccacatgcgttcgatgttgaaaggacgtacgagagcggaagcatttggccgtaccatccgacaaggcgcagtggttgcgggcacttactttattttttgttacgttga

SEQ ID NO: 549 - DNA (genomic), 525 bp, Enterococcus faecium; double-stranded, circular
  misc_feature (B) LOCATION 1...525
  hypothetical: NO
  anti-sense: NO
atggattatttagatatgctatgcgagagtgtggatcgggcatacgatcggtttgaacgtttgtttgaaggcgtctctattgaggaggccaatcgttttccagtggaagatagagccccgcagatcaaatcaatgacttggctggcttggcataccgctcgagaattagatttccagattgctgatttagcaggaacttctccaatttggcatagtcaagactgggaaagccggtttccgatgacgatagcagataacgaacaagattggaagcatagtctggaacaagcaaagcagatccaagctaatcaaatagaagatctgctaggatacttgcgaggagctgctgattttgctatttcttacttaagaaggctggaaccttccgagctagatgaagtaattgacgagaactggacaccaccagtcacacgaggaatgcgtctcgtttctattattgatgatgctgctatgcactctggtcaggtgatctatgcgagacgtttgttgggattaagagattaa

SEQ ID NO: 550 - DNA (genomic), 258 bp, Enterococcus faecium; double-stranded, circular
  misc_feature (B) LOCATION 1...258
  hypothetical: NO
  anti-sense: NO
tcggacaatgcaaaaaatcattttgccgcaagcgatacgcatcatgatcccatcattcgtcaatcagttcgttatctcattaaaagacacacgatcatttccgcaatcggtgtagtcgaattgctgcaaactggtaagatcattgttgcacgtacaacacaaagtacgtatgtttacttgatcattgcgatcatgtacttgattttgatcacagcattgacaaaattagcaaaagttttagaaaagaaggtgaagtaa

SEQ ID NO: 551 - DNA (genomic), 876 bp, Enterococcus faecium; double-stranded, circular
  misc_feature (B) LOCATION 1...876
  hypothetical: NO
  anti-sense: NO
atggcaaatgcgcttgaaataaataatttgaaaaagatctatggaagtggggtcgaagcattgcggggaatcgatctttcggtgaaagaaggagatttctatgcgctattagggccaaatggagctgggaagtctacaacgatcgggattattacttctttagtcaataaaacatctggaaaagtgaatgtcttcggttatgatctggacaaggatctagttcgagcaaagcaacagattggattggttccacaagagttcaattttaacccttttgaaacggtccagcaaatcgtcgtgaatcaagcaggctactacggtgtctctcgcaaagaagcgatgaaacgcagcgaaaaatatttgaagcagtccaatctttgggaaaagagaaatgtccgtgcacgtatgctttccgggggaatgaagcgaagactgatgattgctagggcattgatgcatgaaccacgtttgctgatcttggatgaaccaacagcaggagttgacatcgagttgagacgcgagatgtgggagtttctacgagaattgaacgaaaatggtacaacgatcattttgacgacgcattatctagaagaagctgaaatgctttgtcgcaacatcggaatcatccaatcgggtgaactgatcgagaatacaagtatgaaagagcttctgtcaaaactgcaatttgaaacatttatctttgatttagcgccatatgataccaaacctgtgattgaaggatatgcttgtacatttgaagatgagcagacaatcgctgtcgaagttgaacgtcatcaaggggggaccggatttttgaatcggctaacaagacaaggaatccaatttctttctatgaggaataagtcgattcgttga

SEQ ID NO: 552 - DNA (genomic), 882 bp, Enterococcus faecium; double-stranded, circular
  misc_feature (B) LOCATION 1...882
  hypothetical: NO
  anti-sense: NO
agaagaaatgctttttgctatggatttgctagccaaatatcaattgccagtccaatcagtccagatggaagaacctacgctagaaaaactctttttggaggtcgttcaatcatgagacaactcattgccttcgccaaaaaggagctaatggaaaactggcgtactggaaaaatcatcacgctaagtgcgctcacagtgattttcggtataatgaatccattgctagctaaattgactccttatttagtgcaaactatgtcaacaactctggcagagtcagggatttctgttcagaaaatcacagttgatgcaacgacttcatggacacaattttataaaaatattccgatgttgctgattttcttccttcttttattcagcgggatattgacaagcgaataccaaaacggaacaatcatcaacttactgacaaaagggatgaagcgctggaagatatttctgtcgaaatggatcatgggtatactgttttggagtgtcagctattggtgctgttatagtattacgctagcatacacgatttattattgggaccagtcgattatctcccatcctttatttatcagttttacttattatttttttggctgttggctttattcattgattttattttattcagcttttctttcttccaattatgcggttctgttggctagtgggggaacggttattctgagttatggtgctgggttgttctctaaagtagcagaatatgtaccgacttatttgatttcttcctcaaattatcttacgaaagaaatccaccttacagattatactcagtcattagcagtgacatgttgttctatcgtcatatccatcgtagctgggtggcttgtttttaacaaaaaagaagtctaa

SEQ ID NO: 553 - DNA (genomic), 603 bp, Enterococcus faecium; double-stranded, circular
  misc_feature (B) LOCATION 1...603
  hypothetical: NO
  anti-sense: NO
ccaaagaatgcgaccgtgaaaatatcggcttccatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 554 - DNA (genomic), 771 bp, Enterococcus faecium; double-stranded, circular
  misc_feature (B) LOCATION 1...771
  hypothetical: NO
  anti-sense: NO
cttgttgatgctggtagtagctgtgttaggcgcactattttctgttcggacaatcgtaaaaatcgatccgttgaaggcaattggataagaaggaggaagagcatgaaagcaatagaatttaaagaagtagaaaaaagtttccaagatggcgaccaagtagttaaagcattgaaagaaacaaccatgagtatcgataaaggggaatttgttgcaatcatcggtccttctggttcaggtaaaagtacttttttgactttggcaggcggattgcagacgcctagcagtggctctgtatttatcaatgatcaagaattcagtaatcaaaaagaaagtgaacgcgttaaactacgttttaaagaaattggctttattttgcaagcttccaatctggttccttttctgacagtaaaaaagcagttattattagtagataagatcaaacatgaacatcgtcaaaaagaagcaaaagaattatttgagcagcttggcgtggataagttgatcaacaagtatccagaagaactatctggtggagaacggcaaagggtcgcaatcgctcgtgcattgtacaatgatccgtccattattctagcagatgaaccaactgctagtttggattcagaaaaggcacgagaagtagtcgatatcttggcaaaagaatcaaaagacaaaaataaagcaacgatcatggttactcacgatacacggctgattgacaaatgcgatagaatatttatgatggaagatggtgtattgaaagaaaaagaataa

SEQ ID NO: 555 - DNA (genomic), 1176 bp, Enterococcus faecium; double-stranded, circular
  misc_feature (B) LOCATION 1...1176
  hypothetical: NO
  anti-sense: NO
ggaggagatgcggtgaaaaaaagaaaaaagatcgattggtggattttgggtccttatttgactttgtccatgatcggtcttttagaagtatacagtgccagttcttatcgtttattgcaagccgatgaaaatacaaaaagtctattattgcgtcaactaattttcatatttttgagttggagcgtgatcttcttagctcgttcagtcaaactacactatttacttcaccctaaaatagcaggatacggtttagccttatcgattttctttttagtattagtaagaatagggatattcggtgtcactgtcaacggcgcacaacgttggatctctctgtttggcattcaattccagccttctgaactggcaaatctttttttgattttttatttaagctggttttttcgtgacggaaatagtagcccaaaagatctaaaaaaaccattcctgattacagtaggtataacttttctgattttatttcagccaaagattgctggagcattgatgatcctttcgattgcgtgggtcatattttgggcagcggcggttccatttaaaaaagggatctatctaatcgttactttttctgcattgctgattggagcagcaggcggggtattatatttaggaaataaaggttggcttccacagatgtttaatcatgcttatgaaaggatcgcgactttaagagattcttttatcgatagtcatggtgcgggctatcaaatgacccattcgttttatgcactatataatggtggcatatttgggcggggattaggaaatagtatcacaaaaaaagggtatcttccagagacagaaacagattttattttttcgattattacagaagagcttgggctaatcggtgcattgtgtgtgcttttcttattgttctcattatgcatgagaatcttttgtttaagcagtcgctgtaaaaatcagcaagctggattgtttcttttaggattcggaactttgctattcgttcagacgataatgaacgtgggaagtatcgcggggctgatgccaatgactggtgtgccattgccatttgttagctacggaggaacaagttatctgatcctttctttaggaatcggaatcacgttgaatatttcttcaaagatacaggccgaagagttgccgctctatcgacctgaaaaacaataa

SEQ ID NO: 556 - DNA (genomic), 582 bp, Enterococcus faecium; double-stranded, circular
  misc_feature (B) LOCATION 1...582
  hypothetical: NO
  anti-sense: NO
tttgganatgctcatcattactttatggcggctcctcaaaaatcgattcgtggaagtgatgtggatgctgcacttcattatctcgcccgtttagttgaggcaggtgatctggcaagtatttgccggcgtctgatggttatcggttatgaagatataggtttaggtaatcctgctgctgcggctcgtacagtgaacgctgtattagctgctgaaaaattgggattgcctgaggcacgtatcccactagcagacgtcgtcgtcgatctttgcttgtcgccaaaatccaattctgcctacatggcattagatgcagcacttgctgatattcgagagggcaaagctggagatgttcctgatcatttgagagatagccattacaaaggtgcgaaatcactcaaccgtggcgtgggttatcagtatcctcatcattttgatcaggcttgggtcaatcagcaatatttaccagataaactgaagaatgctcagtattatcagccaaaagatacagggaaatatgaacaggctctgggtcaacagtattaccgtataaaagagtggaaaaagcatcctccaaaaaactag

SEQ ID NO: 557 - DNA (genomic), 1059 bp, Enterococcus faecium; double-stranded, circular
  misc_feature (B) LOCATION 1...1059
  hypothetical: NO
  anti-sense: NO
ggcggttatttaaagatgaaaaaaaagctattttcacaattatggatctattttgctagtattgtcttcatttcgatcttagtgacactgctgtgttttctcggttttattttcttattgtctcgacattctatctcgcctgctgaatcggctggaaaaccaacgttatacccgttattcgtctttgcggggttcagtatggtcgtgggtacaggaatatcgatttttgttgggcggcgtatcctgcatccaatcagtgcgctagggacaaatatgagtctggtagcaacgggagatttttcgattcgaatggatgaacagcagaaagtagcagaagtacagcaactgtataaagatttcaacgttatggtccaagaactcaatagtatcgagacactgaggaatgactttgtgtccagtgtatcccatgaattcaaaacaccactagcaacaatccaaggatatgttcaattgttacaagccccaaatctctctgacgaagaacgccaaatatttttatatcggattatcgaaagtatcacgcagctttcacaattaacagagaacatcttaaaattgaacaaactggaaaaccagcgtatccaactggaaaagaaagagtatcgattagatgaacaaatcagagaagtaatcgttttttttcagcctaaatgggagaaagaacagctagaattggatatcgaacttgctgcagtaaattacacaggcaatgaagagtttttgtaccaagtgtggctgaatatcatggataacgccataaagtacaatcaaatcaatggacagattcatatcaaactatttgagacagccacagagattgtactggaagtgaccgattcaggtgtaggaatgaatgaagagaccagagatcgaatgtttgaaaaattttatcaaggagatacaagtcgtcaaatttctgggaatgggctaggactttcactggttaaaaaaattctagaactgcatgatggacgtattgattatagcagtatcgaaggagtaggaacgacagcaatgatacggttaagtaaacaatag

SEQ ID NO: 558 - DNA (genomic), 933 bp, Enterococcus faecium; double-stranded, circular
  misc_feature (B) LOCATION 1...933
  hypothetical: NO
  anti-sense: NO
tccagttgtgccatttgcagaaagcgcagaagcttacatgcgttatgtagaccagcacccagaagaaagtatcaaaatgggcgttcaagtccgaggaggagaacaatgaaattcggtacgcaagatcaagcatttttcccaagagacattttagaaaaatttagatttatcaaagactgtggatttgaagaatacgaaatcgacggtaagttgttaatagaaaatatcgacacagtcaaacaggcaatcaaagaaacagggatcccagtagtgacagcttgtaacggctacgatgggtggatcggtgactttatcgaagaacggcgtcttaatggtgtacgtcaaattgctgagattttgcgtgcactaagcgaggttggaggcaaaggaatcgttatcccagcagcttggggaatgttcacttatcgattaccgccgatggtttcaccccgaagcaaagaaggagactataaagcagtcagcgaatcacttcgttatttagataaagtagccgaagaaacaggtacggttatttatttggagcctttgaaccgataccaagaccatatgatcaatttgttagcggatgcgcgtcattacattgactctaatcaattgaaacatgtgcagatcatcgctgatttttatcatatgaatattgaagaagatgatatttcaaaagcattgactacgcaaaaagagtatgtgggtcatatccatttagcagataatcatcgctaccaaccaggatctggcgcaattgattttactcgccattttcaaacgctacttcaaaatgagtatgaaggttatatggtatatgaatgtcgtttgcgaggagaaaatgaagtgaaaatttatcaggaatcattgcaatacttgaaaaactgtctggaaacagcgcgtcatttaaatgatttagagaaagaatag

SEQ ID NO: 559 - DNA (genomic), 222 bp, Enterococcus faecium; double-stranded, circular
  misc_feature (B) LOCATION 1...222
  hypothetical: NO
  anti-sense: NO
gtaattagtgccgcaaacacagggatgactaaccaacaaagaacaacaagaaagccatttagccctgcatttaaagaagccaacggaccaacaagtccgaccacgccgaaaccagcagaagcaggcgtacctgaaatagaaaatagagcgacangaatagttgtattgatgatcacaaatacgatcgcccgacgttttgatagcgattctgcattattctaa

SEQ ID NO: 560 - DNA (genomic), 519 bp, Enterococcus faecium; double-stranded, circular
  misc_feature (B) LOCATION 1...519
  hypothetical: NO
  anti-sense: NO
gtaattagtgccgcaaaaacagggatgactaaccaacaaagaacaacaagaaagccatttagccctgcatctaaagaagccaacggaccaacaagtccgaccacgccgaaaccagcagaagcaggcgtacctgaaatagaaaatagagcgacaggaatagctgtaatcactgcactaactaaacaaggaataagaatcacaggttttctaaatagattaggcatcatcatcttcatagcgcctaaagcaatcgcaattgtcacacctgacttattaaccttccaagagttcactactaaaacaaaagtggttgcagctacgcccatcgcagccgcaccagcagaaacaccatctagttggattgccattccgattgctactgttgaaataggagagataatcaaaaaggcaaaggaacaaccaatcaagatagacattaacagcggttgtaaggtagtgaagttattaatcaatgatccaattgcagaagtaattgctgttacaaaagggaataaataa

SEQ ID NO: 561 - DNA (genomic), 918 bp, Enterococcus faecium; double-stranded, circular
  misc_feature (B) LOCATION 1...918
  hypothetical: NO
  anti-sense: NO
tcaagtagtgcgcctgaaacgatggcttggcgcgtgatgttagggctcgctgctgtccccgcgctgattttatttttcggtgttttagctctaccagagtcaccgcgttttcttatgcaatctggccgcttggaagaggcaaaaagagtattgaactatattcggacaccaaaagaagctgaacaggaattcgaacaaatccagctgaatgtcaaacaagaaaagacaaccggaacttcttggcatactttgtttttagaaaaatatcgttccttagtcattgccggtattggtgtagcagtattccagcaatttcaaggagctaatgctattttttactatattccgctgatcgtagaaaaagcgactgggcatgcagcgagcgatgcattgatgtggccgatcatccaaggaatcattttagttgctggttctttgctctttttggttattgcagacaagttcaatcggcgaactttattgaaaataggcggtagcgtgatgggactttctttcatcctaccagctgttttaggaactgtactggatgctcatacaaattcgttgttgattctcttgtttttatgtatttatgtcgcattttattcttgcacatgggctccactgacatgggtaatcgtaggcgaaatattcccactagctgtccgcgggcgagcatctggcctagcctcttcttttaattggattggttctttcctagttggcttgctttttcctgtgatgactgcttctatgtctcaagaaatcgttttcggcatttttgggatcatctgctttttaggggttttatttattcaagagatcgtaccagaaactcgtgggaaatctttacaggaaatcgaacaaagtgcatctaaaaaaacttatcctaaacgtatttctatccatcattcttaa

SEQ ID NO: 562 - DNA (genomic), 705 bp, Enterococcus faecium; double-stranded, circular
  misc_feature (B) LOCATION 1...705
  hypothetical: NO
  anti-sense: NO
gataacagtgcgatcttattttttggaggtgaaagagtgtcaaaaatcaatccgttaaccttgattactttaaatattttttttccggtcattatttttttaggaaagggaaatatatttcaagtggggtgtttcattattgctacagttttagtattgatgtttcgtaaaataaagacatgtatttatttcatcttgatttattcagttctgtttttagtaatgaaaattattgatgctatcaagatagagttttttactatattttttgggacatccttatatattgtatttcgaatgttgccggtcgtaatgatctcatggttgttggttagtgtctatactagcaatgaattattatcctctttagaaaaaatacatttaccgaaaaaaataatgttaagtattacagtagtgatcagattctttccgacttatcgttctgaaataagaatgattaaagaatctttaaaaatgagaaacattcgcttgtctttttttcagcctctgcaatatttggaatttctgttagttcccgttcttatacgtgcaactatgattgctgaagaaatgaccgctaatgcaataacaaaggggatagaatctcctgtgaaaagaagttcttactataaaacaaacatgagcttattagactatatcatcctgttttccgttactatttttttcttaagtattttgatttga

SEQ ID NO: 563 - DNA (genomic), 1698 bp, Enterococcus faecium; double-stranded, circular
  misc_feature (B) LOCATION 1...1698
  hypothetical: NO
  anti-sense: NO
cgcaacagtgctatactaaaactaacaaatcaaggaacggagagggatatgggccaaagagaatttatcgttttaattattattgcagttgttattttattagttgttttagacattttttcacgtttgaaagtaaaggaaacagttcgtagtaattggggaaaaattccttatcaaccgagatttgataaagaagaaagtttgaaggatgcgtggctcacggagaaaaaattccgttcatgggatagtgaaatcgacgatcttacttggtatgacttggatatgttcgaagtatttgaagggatcaacagtacctattctagtgtaggttcagaagcgttgtatcagcgtttacgtagctttgattttggagaagattatcagttagaaaaactaattgctttttatcaggaaaatcctcaactgagagaaagaatccaatatcaattcgctcgtttaggaaaaaaagatcataattttgcaaaacaatatctagcggatggaaaaagtaaaaagattggacgcgtaggtttatttatttttcttggcttgcttccgctggtgggtgtaggtttgcttcttttagggcaagtactaggaatctatctagcaatcggtggcttagtattcaatacggtctattatctagtgaagaaacaaacactagaaacagagctgaatagcatgagttatttggtttcaacgatttcagccgccaatcagttagcaaaaatgacgacaccacttcaaaaagagctgaaacagcaaactaaaccattaagagacatccctaaattaggtttttcatttcgaatgaagagcgggagtgaagcagaattgatttttgaatatgtcaacatcatgttcatgctgccatttatctcctatcatttcgttctcactaaattagaaaagcattcaactgaagccatcaagctgtgggaattgctgggagaattggaagttgcagcagccgttttgaattatcgcacctatatgccgatcacttgccgaccagagtttactgagggcggtgtgacagcgaaagatatctatcatccattgttaaaagaagcggtagttaatccagtcaactggcagaagaatacattagtcacgggttccaatgcatcaggaaaatctacgtatgtcaaaagtatagccatcagctgtattctagcacagacgatccaaacagcgattgcagaacagtttaccctgcaacctggacatgtgttgacttccatggcaatcgaagatgatttatttgaaggcgacagttattttgtttcagaaatcaaatcgatcaaacgtttgctggaccaagtggcttccaaagaacgctgctactgcttcgtagatgagattttaaaaggaacaaatacgatcgaacggattgcttcttccgcttcagtcgttcggtggcttgcggagtatccatctttagcatttgtcgccacacatgatatcgaattgacagagattttaaagaattattgtgagaatgtccactttgaagaacaagtaacagaaggaaaaggaatcagttttgatttcaaattaaaagaaggaccttcaaggacccgaaatgcgattgccttgctgaaagttttgaattatcctaaatccatagttgaacaggcccaaaaagaaagtttgttgttcgatgaacagcgtcagtggtatccgtttgattaa

SEQ ID NO: 564 - DNA (genomic), 477 bp, Enterococcus faecium; double-stranded, circular
  misc_feature (B) LOCATION 1...477
  hypothetical: NO
  anti-sense: NO
gtaaaaagtgcaaaacaaggagtgagaagactaatgttggaaatcatgatcgttacacatggtaagttgagcgaaggactgaaagatgcggcggaagtaattgtcgggacatcgagccatattgaaacaatgtgcttagagtctggggaggacatccaaacattcggagagaaggtcaaagaaaaattaactatgatcaacacagcagaacccatgctagtatttgttgatctaattagcgcaagtccgtacaatcaagcgctcttggcagtcaatgaactgactgaagaaaagaaagcagccacttatgtcatagggggcgtgaatctgccaatgttgttagaagcaatcaatcatcagatgcttcacacaccgatagaagaagcggtggaacaaattgtcaaacaaggaaaagataatttaactgtttggcatgcttcagcggaagaaaaaaaattagatgaggacgatttttag

SEQ ID NO: 565 - DNA (genomic), 2148 bp, Enterococcus faecium; double-stranded, circular
  misc_feature (B) LOCATION 1...2148
  hypothetical: NO
  anti-sense: NO
ttaagaagtgcagaaaggaagattatcttgaaatatataaaaacacctgcctttttgaataagaggctcggatttttttctttactagtcgttttactttggttgaaaacgatttttgcctatttggttgatttccatctcggaattgaaagtggcattcaatactttatcttatttatcaatcctattgcaactacactgttattacttggaattgctctttatatcagacgccctagagttgcttatatcacgataatggtcatttattttcttttgacgttgcttgttttttcgaatgtcacttattatcgagaattcacggacttcattacgatcaacacgattttaggtgctgggaaagtagcaagtggtctgggagaaagtgccattcgactgtttcgcccatatgacgtgatctattggatcgatttcattatcttgactgtcctactgatcgccaaaaaaatcaagttggaccctcgtccgattcgagcaagaatggcttttgcaatctctacattagccgttatgattttctcaggaaatctttttatggcggaagctgatcgtccagaattattgactcgtacattctctcgggattatttggtcaaatatcttggcttgaatgctttcatggtttacgacggcgttcaaacttaccagacaaaccaagtgcgggcagaagcaagccccaatgatatgaaagaagtagaaaattatgtaaaagaacattacgcagcaccaaatgatgatttgtttggacttgctaaaggaaaaaatgtgatttatatccatttagaaagcttccaacaattcttgatcgattataaattgacagatgagaatggtgtccaacatgaagttacacctttcatcaatagtctttatcacagcaatagcacgttcagttttgacaactttttccatcaagtaaaagcaggaaaaacaagtgatgcggaaacgctgatggaaaattcattgtttggcttgaatcaaggctccttgttcacacaattaggcggaaaaaatactttccaagctgcacctgatattttaagtcaaacagaaggctacacaagtgcagtgttccatgggaacgccggcacattctggaatcgaaacgagacctataagaatttaggatatgattatttcttcgattcttcttattatgacgttaatgatgacaattcgttccaatacggtttgcatgataaaccatttttccaacaatctgtacaatacttggaacgtctgcaacaaccattttattcaaaattcattgctgtatctaaccattatccttattcgaaattcaccaatgacgaagctggattcccgttagccaatacaaacgatgaaacgattaacggttacttcgcgacagctaattatttagacactgccgtacaagaattcttcaactatttgaaagaaagcggcttgtatgataattcagttatcgttctttacggtgaccattatggtgtctcgaattctagaaataaaaatctagctgaactagttggaaaaacaagttctacttggactaattatgacaatgcacaaatgcagcgtgtcccttatatgattcatattcctggacaaacacaaggcgggatcaatcacacttatggcggccaagttgatgctttgcctacgctgctccatttactaggtgtagatacaaaaaattatattcagttaggacaagatctattctcgaaagatcatgaacagcttgtttctttccgtgatggcgattttgttactccaaaatatacttactacggtggtaccatctacagtaacgaaactggtgaggccattactgaacctactgaggaagtacaaaatgaaattgattcactcaaagaaaaagttgataaacagttagctgtttctgatcaaatcaataacggtgatcttcttcggttctatacgaatagtggattagacccaattgataccagtgattatgactacaagaatggcttagagaaattaaaagaagctgaaaaatctctaggtgacaaatcaactagtgtctttagtcaacacaacggacaatcaactgttgatctttataaaactcaaacgtatcaagaacttcacggaacgaccacaagttcttccgaatga

SEQ ID NO: 566 - DNA (genomic), 648 bp, Enterococcus faecium; double-stranded, circular
  misc_feature (B) LOCATION 1...648
  hypothetical: NO
  anti-sense: NO
aggggaagtgccatggaagttttagtttttccaaaaaatgaggaaaaagcgttacaaatggaaaagtacatgaaaaatcttttttcctttgctggagtacctaagccggaacgcgctcttttacaacaaccgttactggatgagagcaaaaatttatctatttctgaagttttagcttttgttcattattattatgaacaaatcgaaagagagtatcagtatgtagcgatcgatttagtccagaaaaacatcaaacggcttacatttgaagacttagtcgtattgttgccactagttcagaaaaaagaatggtgggacagcatcgactcttggagaaaagtatacagcacatggtgtaaagcctacccagagcagcgtgaagaagtctttcaattgtttgaaaaaaaggaagatttttggctacgtcgaatagcaatcacgttgcaattaggttataaacagcaaacagacacaggactattgatccgagcaatagacgaagatcgtcaaacaaaggaattctttatccaaaaagcaattggttgggcattacgcgattatagtaagaccgatgccgattgggtaaaaagacagctgacaacagatttgagtaagttagctgttcgagaggcaagtaagtatttataa

SEQ ID NO: 567 - DNA (genomic), 201 bp, Enterococcus faecium; double-stranded, circular
  misc_feature (B) LOCATION 1...201
  hypothetical: NO
  anti-sense: NO
ataaagagtgcgataatcgcaggtaatttacctacgccaaatagcgggatcatcaatgccaataaagcaagagaagggattgtctgcaaggcactggttaagccaatcacaatcgtggcagcttttggaaaacgtgtcagtaagacaccaagcggtacagcaatgatgataccaatgatcaaagcaagtcctgaaatataa

SEQ ID NO: 568 - DNA (genomic), 519 bp, Enterococcus faecium; double-stranded, circular
  misc_feature (B) LOCATION 1...519
  hypothetical: NO
  anti-sense: NO
gcagtcggtgccgtttctggaaatacttacgtcaaattaaatcgtgggttattgacagtggatcaaatcaattactttttagattcgatgccgatggaattaacttttgcagataataataaccaatttttatattataatttgcgccaagaagcgaaagagatgttagctgctcgtgtgcccggtcaggtagggaatccattagccaactgtcacccagaaaaatcgtataaaaatgtagagtgggtaattcaacaactgcgaagcggagcaacagatgcggtacgtgttcatgtaccaaaacaagtgccagaaaaatatattgtgcataattaccaagcaatgcatgatgaaaatggagagtatgctggaatcaatgaatacattcttgatttcaaaccaatcattgagtggtatttacaacaaacgggtcaacaacttgttggaaatgaagatgcggttatgaatatcagtttgatttcagcaataaacaagcgcaagaaacatatcaaaagttag

SEQ ID NO: 569 - DNA (genomic), 531 bp, Enterococcus faecium; double-stranded, circular
  misc_feature (B) LOCATION 1...531
  hypothetical: NO
  anti-sense: NO
atgaaaggtgcaatatttgatttagatggtttgttagttgacacagaaaaaacgtatcgtgatggctggctttggggatttcagcaatttgatatccatatcccaaaagaaatcgttgacgcttggggcggaaaaaactggaaacaaagttttgatattttagtgaaagcagcaggtagccctgaaaaagtacaggaagtccgagcgaagcgtgaagaatatttttatcaacagctgacaagcggagccatccacttaaaaccatatgcaaaagaaatattggcagacttaaaagaacgtcatatgaaactaggcattgctacgaccactgttacgaaaagagcaacagatatcttggatcactttaaattagctgattacttggacacgtttacattcggagacgaagtgtcggagaacaagccttcaccgattccttatctgacagctttggaacgtacaggattagaagctagttcagcctttgcagtggaatgttctagacgcgttcaccacgggattgcccccacc

SEQ ID NO: 570 - DNA (genomic), 267 bp, Enterococcus faecium; double-stranded, circular
  misc_feature (B) LOCATION 1...267
  hypothetical: NO
  anti-sense: NO
caatcgggtgcacgcctgcaaatgagtgtgccggctttcgtgaaagccaaggcacaaaacgcgcgtctggtgacaccgaaagtggcgccagacattgcccaggcaatcgcgcgcgatttagccaaagctggagggaatatcaatcaaattgctaagtggtgcaatacacaccaacatgacgttgcttctggtgacgctcaacgtttatccgaaaacctaaaaatcatgcaaaaggagctacaaaagatatggcaacaattaaggtaa

SEQ ID NO: 571 - DNA (genomic), 918 bp, Enterococcus faecium; double-stranded, circular
  misc_feature (B) LOCATION 1...918
  hypothetical: NO
  anti-sense: NO
cgtatctatttattgaatgtggaaaaatttaaattaaaaaggagaactattatgtatgatggtgaattgatcaagaaacttcgagtcaacaagaagttgacacagtcccaattagcggaaggaatctgttttaagacttctctagtcgggattgagacaaattcagtgaaaaaaatgtcatttgtaacattgagatcatttttagagcgaatgaacatgacacttgcagaatatgaatggatgcgaaaccagctggatgaaccaataaagttaaagaaaaaaagacgaatgctagatcgggtacaagaagacagctttgatccttataaagagatcagcaataaccgtaggcattttaagaaaacagaagatctgtattatttggttttgaatcttcacatggtcgaaaaaacagaagtatctgagacagaatttgaatttttacgttatgaatgccgaatcattgaagaatacttgatgcagataccagactatggtcaatttgaactatctattctagctgattttccttggatattcagtgatcggttcattgagaacaattatttgaaaatcaaaaaaagaatgcgacgattagcacagttgaacaatcatgagcagtatctctttacttttttaatgaacctgacttcgttttatatagaaaatggtcggttgaaaaaggcacgtagtgtgaatgaagatatgaaacggagcttagcacataaagaaagaagtacagtgatctatgaaacattgatggcagattattatcaaagattgatttctgctgctttaggggaagaaaagacgaaagactaccaagaattcttcacagtgctcgaatatatgttaggaaagaatcaacggaggtccttagagaaaaaactgctggccattgctgaacccagcaactag

SEQ ID NO: 572 - DNA (genomic), 342 bp, Enterococcus faecium; double-stranded, circular
  misc_feature (B) LOCATION 1...342
  hypothetical: NO
  anti-sense: NO
gctgttcttttgctaatgcttcttggaactttttcccgttttgttggatcatttctaacttctcttttgtttcagttaaagatgattttagctgcgcctgcttttgtgtcaattcttctttttgtaacatcaatcggtctactgatgcttctacttccgattgcttggctaacgtctgcttgctttttgctgtttcttgtatatattgacgttctagatacttcagttcgtttcctacagctgcttgttcttgcatcaaatcaacatattgatctcttaattctgccaataattctttcgttgatttttggtatttttctaattcttgctgtgtttttatga

SEQ ID NO: 573 - DNA (genomic), 333 bp, Enterococcus faecium; double-stranded, circular
  misc_feature (B) LOCATION 1...333
  hypothetical: NO
  anti-sense: NO
tgttttttcgccacgggcctgacctcctgcaccgccatgctgtcaggcttccagtcctcgtacatttccgcgtcttacatggctaatgagcaggaaatctgccagagcgacctttattacacggaaaaggaaacggatttgcagattgatattgacaaaactgaggaaaattaccccggctatgatgaataccgctacaacatcggtgaaatcagccataacccttatgaactgttaggctacctctccacggcgttcaatgcttttacctttgcagaagtccagcccgaaattgaccgcattttttcnccggcagtacaccctcacccgtga

SEQ ID NO: 574 - DNA (genomic), 183 bp, Enterococcus faecium; double-stranded, circular
  misc_feature (B) LOCATION 1...183
  hypothetical: NO
  anti-sense: NO
tgtttgttcgctacgctccaaactgactcgcccgctttcacggtatacatcgtattaccagtggatgatgtacttgtcgtagcagacgtattcggtgtatttggtttcgctgcagaagtagttgaacctgtatttgtatttgccgaagttccacctttaacgatcaattgctgtcctggataa

SEQ ID NO: 575 - DNA (genomic), 204 bp, Enterococcus faecium; double-stranded, circular
  misc_feature (B) LOCATION 1...204
  hypothetical: NO
  anti-sense: NO
aactatatcgctcattccgagaagaagtgccggatgaagcttacgaagttcctttggataaagcagcagttactcgtgagggaacagatgtatctattatcacatacggagcaatggtgcgtgaagcaatcaaagcagcagacaatcttgcaaaagaaaatatatctgttgaaatcattgatcttcgtacagttgcgccattag

SEQ ID NO: 576 - DNA (genomic), 666 bp, Enterococcus faecium; double-stranded, circular
  misc_feature (B) LOCATION 1...666
  hypothetical: NO
  anti-sense: NO
cgtcgaatcgcttgggaaatgactggctcgttggcatttctttcgctaaaggtcaaagttgccaaacggccgcttggattttctttgatgagttcagctaatagttctgtcgaatcagcttctggttcgatgtcttgttgtacaaagcgtttggttacttcttttttcggttgtctgaagacagtcaatacgtctccttcttctacgactttccccaactccatcacagcgactttgttgcagattttgcggatcacattcatttcatgtgtgatcaagacgatggtcaaattcaatttcttattgatcgctaacaataagtctaatacttcttctgttgtttgcgggtccaatgcgctagtagcctcatcacaaagcaggatctcaggatcatttgccaatgctcgtgcgataccgacgcgttgtttctgtccgccggaaagttgtgaaggatatgcttgtccgcgtccttctaacccgactaaacgcaacagttcttctgcccgttctttacgtttgctctttggtacgccagctaattccagcggcagctggatattttcaagtacagttcttgaccataacaggttgaaatgctggaagatcataccgattttctttcggaatgtacgtaattctttgttttttaattttgtaatatcttga

SEQ ID NO: 577 - DNA (genomic), 1095 bp, Enterococcus faecium; double-stranded, circular
  misc_feature (B) LOCATION 1...1095
  hypothetical: NO
  anti-sense: NO
cggttgatcgccaatgaatatatgcaggcaaaaggctacgaagataaaaacatctatatcattggtgatttagtcttttatgaagaattcccaggaacaccgacaccgcagatcgttcaagctgctgaacaaacaggacacacagccgcagcgaatatcgtggcttcgatcaaaggcggagaaaagcataaatttaaaggaaactatcaaggatttatggtttctattggtgccaaatggggggtagctaacctatttgataagatccatttaagcggatttttagctatcgtaatgaaacatatcgtgaatttgaaatacttctttgatattcgttctggttattatatgttccaatatttaatgcatgagtttttccatatcaaagatgatcgcaacgtgactcgaggacattcttctcgttacggcaatgtcttatggagtgtgccacttcgtattttctatggtttagtttggttcgttgaagcttccaaaaaaatcattgggaatggtgaagtgttcaaaccaagtacttggtttggtgaaggatcatggttcactggaaacagtgtgttcccttggacatgggaatacaatgtaacagatgttgccagtggtgcttctgctgctggtgatgcaaccacagctgccagcggagcaggggcaagtgccggagaagcagcgactcaagctgcacattttggtttgagttatgcatacggtgaagaaccaatggctgtgattgagaagtcaccagactggttcacaaagatcatgcaagtgatcatgccaaacaatgatgtagcaatgttcttccaaaaattcatggtattctttgaaattgccttggcattagcattgattgctggattattcacatggctatgcagtgcgacaacgattgtattggtgatcacgttctgcttatcaggcatgttttactgggtaaacatttggttcatttttgttgctttcgcattgatgaacggttccggacgtgcgattgggttggatcgctgggtaattccatggctacaacgtacactaggtaattggtggtacggtagaccaagttcccagtacggcaagaaataa

SEQ ID NO: 578 - DNA (genomic), 351 bp, Enterococcus faecium; double-stranded, circular
  misc_feature (B) LOCATION 1...351
  hypothetical: NO
  anti-sense: NO
ggagtggtcgctatacaaaaagaattgaataaaacaggatttgttttgttggagtcccttacagcgcttatgatcgcttctgtctgtgtctacttagtgagctttggccagctgtttttgcttcaggcagaaaagaaaagtggggaggaactgctatttattcgaatgatttatgaagatatcaagacgcagcggatgtatcacaaaagaccagagcgaagggaagaaatgatcccatacgatatccaaattgtcgataataatggagtaatcgaaaaagtgtttgtcaatatggagaaagaagcgatcagtattgaaaaaacaagtaattccagcatttacgctgattga

SEQ ID NO: 579 - DNA (genomic), 648 bp, Enterococcus faecium; double-stranded, circular
  misc_feature (B) LOCATION 1...648
  hypothetical: NO
  anti-sense: NO
tttgactattttgagataaaatttaaagggataggggtaataaatttgacaaacgttgccgatatgacgaacgttgaaaagattatcgtattagactacggtagtcagtataaccaattgatcacaagacgtattcgtgatcttggagtcttttccgaattattgagccaccgcattactgcagaagaagtaaaagcgatgaatccaaagggaatcattctttctggcggaccaaacagtgtatatgatgagaatgcatttgggatcgatcctgagatcttcaatttaggtattcctgtattagggatttgctatggtatgcaattgatcacgtacaaacttggcggttccgtagagcctgctaaaaaccgcgaatatgggaaagccttgttagaagtaacaagcgatcaagctgtcttgtttaaagaaacaccaaaacaacaaacagtatggatgagccatggtgacttggtaactaaagttcctgaaggctttgaaacagtcggaacaagcaaagattgtccgattgcttctatccaagacacaacacgtaatttttatggtatccaattccatgcagaagtacgtcattccgaatacggaatcgaattgctgcgccactttgcctttgatgtttgtcactgttga

SEQ ID NO: 580 - DNA (genomic), 1545 bp, Enterococcus faecium; double-stranded, circular
  misc_feature (B) LOCATION 1...1545
  hypothetical: NO
  anti-sense: NO
tgcgactatttgggtcatagtatcaacagagggcaggttaattgtcgttttagacgttttcccgctctcttttttttaggaagaaagggtgtggaaaggatgaacgttgaaaaaggcgggaaaaaagcaccgctattacagcagtcatttattcggcacgggaatgaacaaggattctggcaacaaggatcgagaattttagcagcggtatcaggtggtgttgattcgatggttttgctccatttacttttacaagtgcaacgccaaatcggtttttctttaggtatcgtccacatcaatcaccaattaagagaagaatcagcagaagaagctgcctatcttcgctcatattgtgaagagaagaatctccctttatatgtaagtatttgggaagatccagccaaatccgccatagaaacagaagctcgtaactttcgttatcaagaattcactcgcgtgatggaagaaggacaatatgacacgttgatgactgctcatcacggagatgatcaaatcgagacggtgttaatgaaaatcgttcgtgggggacagttaaatactttttctggaatcaaagaagtacaaccatttgctacgggcagactgattcgtccgttgctgagttttagcaaagaagacctatatacttatgcagcggaatcgcagcttgtttactttgaggatcagacaaaccaattgttagatatccagagaaatcggcttcgtcatttggtagttcctcaattgaaacaagaaaatacacaggcgttgagacatttccagcaattttcgcaacagatccaatgggcagaccaagtcattcaaaaatatatgggacagttgatcgaaaaggaagtcgaacagtgggaggaacaatttcgattttctgcagaaatgattgaagaaatgacagatgctgaacgatactattttttttactcctttttcgacaaagcattctcaaaaacaggaattattttgaaagaacaacaaatggagtcgattttagaccagtggcaacagaaaaaaagccaatggcaactcagtattggcaataattggatactgaaaagagagtatcattttgttgtactctctaaaaaagaaaaacaagcaactagccagacagaagaccagcgcttgttgctgattccagaacaaggaatatatttgaatgaaacagaatggattggtctggtcaaacctgaaaatgcaggggacatcaaagcaacagattcatggtctctattttctcatgacatttggattcctgctgatgtgcaactgtatgtcgaaaaaagaaaagcaggagaccgcattaaattaacagagaatctcacaaaaaaagtatctagatattttatcgatcagaaagtacctaattcacaaaggcagcatgcttggatcattacagatgccaaaagaaatatatatagcttgataccttttgccttttcatatttgagtattcgtgaagaaactgataaaatacactacatacttctttacaaatatcaaaaagaagcaattggaaggagaacctga

SEQ ID NO: 581 - DNA (genomic), 333 bp, Enterococcus faecium; double-stranded, circular
  misc_feature (B) LOCATION 1...333
  hypothetical: NO
  anti-sense: NO
ttatctgccgcagttgagaatacttgtgatttacttgttggaatcgttgtattgcggtcaatcaatttagtgaacactccacccattgtttcgatacctaatgacaatggtgtaacgtcaagtaaaacaacatctttcacatcaccagtgatcacgccaccttggatagcagcacccatagcaactacttcatcagggttaactgatttgtttggttctttacctgtttctttacgtactgcttctacaactgcagggatacgagtagatccaccgactaaaataacttcgtcgatttctgattgtgataaacctgcatcttttagcgcttga

SEQ ID NO: 582 - DNA (genomic), 1065 bp, Enterococcus faecium; double-stranded, circular
  misc_feature (B) LOCATION 1...1065
  hypothetical: NO
  anti-sense: NO
ctttttcacgccctcttttttcgtgtaaataaattcttagacgtaaataagttcagagggagaaaaatgctgcttgcaatgaatgaatataataagtgctgttttgctaaacatgcagaaaaaggaaagaaatattattgtcgtggctgtcgaaaaagagtgattttgaaaaagggaaagaaaaaatgtgctcattttgcccatcaaaaatcagataactgttcggtctttagtgaaagagaatcaaaagagcacttacagttaaaggaatgcttcatggattggctgggacagtcagtagaaccagtatttttggaagcctatttgccgaggttgcggcaaaggccggatattttgttggcgaatctagcaatagaaatccaatgttctagactgtctcaccagagatttattgaaagaacccaaaattatttgaataacagttaccaagtatggtggatacttggtaattcttttcttggacaatcgcaattctcattgatagaaaaaagttgctgctactataatagaaaaagaggagtgcattgctggaaagctgatctcaagaaacaaaagctttatttgtatcatcatattacagagactgtatcagggcatatttccttttgcagtagctgctggactttttctagtagggaccttaaagaaatattcactagtaacgaaattaaaatgaaccaaatgaaaaaaatagaaaaagtgagtgaagatgggaagaaatggctgacacgccaacttattcacaagcaaaagaatacagtatccatacaagaacaatgctacttgcgtcataaacatcttttgcatctatcatcgtggatctatcaaaaaagtcggtttttcttttatttacaagaacaggtttttctttatcgaatgttgtacgaagaagccttggaaaaccagaaagttcctgatttcaactcatggctttgccaaataaaagaacataaaagggaatggctttttcctatgattgatgaagagatggtctatcagcagttttttaacgaatgcatacacttgtcttctttgaaaaaatag

SEQ ID NO: 583 - DNA (genomic), 273 bp, Enterococcus faecium; double-stranded, circular
  misc_feature (B) LOCATION 1...273
  hypothetical: NO
  anti-sense: NO
aagtcgcacgctccgtgtgaatggggggaaaagtttgagatatttataatatcaggaacttacctatccatatatcaatggtttttaaccaatgcccaatccttagtcttactggcaattgtggtcattggtttgtttttaggatttaagcgggagttttccaaactgattggctttttggtgattgctttgattgcggtcggattggtctttaatgcttctggggtgaaggatgtcttactcagtttgtttaaccgaattgtcggtgcgtaa

SEQ ID NO: 584 - DNA (genomic), 1011 bp, Enterococcus faecium; double-stranded, circular
  misc_feature (B) LOCATION 1...1011
  hypothetical: NO
  anti-sense: NO
tttgcaaacgctattttaactggtgaattacctgtagacagccaactaccaactgaaaaagaactttcacgtacctataaagtaagcagaatcacttccaaacgtgcattgactgaattagagcaattaggacttatttatcgcgttcgcgggaaaggcagtttcgttaaatccgcttctccggaacagattcttgcttctcctacaaaaacacgacggattctgtttcttcttccatatgtcgctgatttgtctgttggtgattttagcaagggattgaaccctgtgatgcaagataaacagattgatgtcatgatgacgacgcttgactttctacaaaataaaacagcaaaagagctaatcaatgaatttgacggattgatttattatgctcttgatacagaacaacatcttgacttactttttgagctttcattgaaagaattccctgtcgtcatattagataaaaaaatctatgagttaccttttcctaccgttctttccgataatttccaaggcggtgcgcttgctgcctcttatttgatcgaacagggacattcaaaaatcgcttatttgtttggtacgcagactcatccacaatccgttcgacagcgttaccttggttaccttgaagcattggacaaagctggtttgactttccacacttcactggatgacaaaagcgcgacattagatgaattgctttcttatatcactaagtatgaagtaactgcttttgtttgtgaaaacgatgttgtcgctatccagaccatgaatctcttgagacagcatggttatcatatccctgaagatttttcaattatcggatttgatgatatccaagcagcagctcttgttgacccgccactgacaaccatcgcacaagattttgaacagttaggtaagcttgcgggagatgctttggtcacttggttagagacaaaagatcgaccatccgatagtaaatttccagtttcattcatcaaaagacaatcaacaaaggagaaataa

SEQ ID NO: 585 - DNA (genomic), 1686 bp, Enterococcus faecium; double-stranded, circular
  misc_feature (B) LOCATION 1...1686
  hypothetical: NO
  anti-sense: NO
gagaagaacgctatggatggaatcattaaacaaatcgaaaaagggaaaccattttttgaaaaaatctcacgtaatagttatttaggagccgttcgtgacggatttttaacagcgatgccagctattttattttcaagcattttcattttgattgctgcggttcctgagatttttggttaccaatggcctgaatctgtctccacatggctatggaaagtctataattattcgatgggtgttgtagggttactcgtttcagcaaccactgctcgctgcttggctgattcgatgaatcgtcgcttaccgaaaaacaaagtaatcaacaccacctctgtgatgctggcctctgtggtaagtttcctgttgttaagcgtctctccgattgaaggtggattttcaacggaatatatggggacaaagggactactggcttcctttgtcgctgcatttttaacagttaatttatataagttttgtgtgctgaaagatattaccattaaaatgcctaaagaagttcctggaacgatttcgcaaaccttccgagatatttttcctttctctttttcagtatttgcggccgttttaattgatttaggcattcgacaaatcttccaaatctcatttgcagaagcaatcattacggtgctgcagccgctatttacagcagctgacgggtacttaggaatcgctattatctggggagcgatggcgctgttttggtttgtcggtgttcatggaccgtcgatcgtggagccggcaattgcggcaattatctatgccaatgtggaaaccaatctgcaattgttcaattccggtgaacaagcttctaaagtactgacggtgggtttagggaattttgtaggaactatgggaggaactggggcaacattggttgttccttttatcttcctactctttgctaagtctaagcagttgaaggcagttgggaaagcttcctttattccagtaagtttcgctgtcaacgaaccattgctatttgcggcacccatgattttgaacccttatttttttattccatttttgttaacacctgttgtaaacgtttgcctgttcaagttttttgtcgatgtattgggcatgaacagctttatgtacgttttgccttgggcaactccagcaccgatcggtttggttctaggaacgggcatgggtatcttagcttttgttctagcagcggttctaatcgtcgttgacttcctgatctatctaccattttgcaaagcatacgatgctgtcttagtagagaaagaagcacaaaaagcagaggtgatcgcaaccgaggaaggtgcttctgccgatgtacgtgaggaagtacctgtggcagcgagtcaagttatcagcgatgcaaataaagaaatcaatgtgttggtactttgtgctggcgcagggacaagtgcgatgttagctaatgctttaaaaaaaggtgcatctgaatcgaaagcaccgatcagtgcaatggcgggtgcttatggttctcattacgaaatgctgcaggattttgatatggtggtcttagcaccgcaagtcaattcttactatgatgatatcaaagaagacaccgatcgcttaggaatcaagctggttgcgacaaaaggagcagaatatatcggattaacgagagatcctgaaaaagctgttcagtttattctgaaccaatttcaataa

SEQ ID NO: 586 - DNA (genomic), 468 bp, Enterococcus faecium; double-stranded, circular
  misc_feature (B) LOCATION 1...468
  hypothetical: NO
  anti-sense: NO
ggaatatatttcatggaaagttggctttttttaggaattattttacttgtagcaattttagctaaaaatcaaagtctgatgatagcggcagcttttgttttgattatgaagctcataccagcctcccgttcctttttcccttggcttcaaggcaaaggaatcaatattggggtgacgatcatcacagcggctattctaatccctatcgcaacaggagaaatcggtctacgtgatctattagaagcctttaaatcccctattggctgggtagctgttttttgcggtgggctagtggctgtcttatcttccaagggtgtaggattgattgcttctgatccacaaatcactgttgcacttgttttcggcacgattttaggtgttgtcttcttaagaggaatcgccgccggaccggtcattgcttctggtatcacttactgtatcttacaagtatttgctttaggaaaatag

SEQ ID NO: 587 - DNA (genomic), 423 bp, Enterococcus faecium; double-stranded, circular
  misc_feature (B) LOCATION 1...423
  hypothetical: NO
  anti-sense: NO
tactctcttttatgtatggagtgtatagaactatttttacttgtgtcttttcccttaatccacgtgtacggaatacagcttataactgcgtatgcagttatgtttgaaggaggaagattttctttggtaattaagaaatatgtttactcacacccgatcaatgtatttattatcggtaagctaggtttatctgttgaggtgttttgtgagttatatggatttaaacaaggaactctatcgtcttggattactagagagcgtgaggtagctgatttgcctatttcttttttgtatgctttgtctctagcttcaggagggaatatgaatgaggtttatgattgcttgtgtgagtatgaaaaagagtataaagagtatttgaaaatttcagccccaaaacggaataaaaaatatattgaagattag

SEQ ID NO: 588 - DNA (genomic), 216 bp, Enterococcus faecium; double-stranded, circular
  misc_feature (B) LOCATION 1...216
  hypothetical: NO
  anti-sense: NO
gctatgggcgcatatttgaaatgccgaggaccggaatcgaaccggtacggtgatcactcaccgcaggattttaagtcctgtgcgtctgccagttccgccaccccggcgcgattgctttggcaaagcggaaaacggggttcgaacccgcgacccccaccttggcaaggtggtgctctaccactgagctatttccgcgtgtttaaagatgccggctaa

SEQ ID NO: 589 - DNA (genomic), 330 bp, Enterococcus faecium; double-stranded, circular
  misc_feature (B) LOCATION 1...330
  hypothetical: NO
  anti-sense: NO
aggaggggcgcacggtggggctgtttcaccaaagtttccccggaagaaaaggcggcgattgaccgcaaaatggaattgntgggaccttccacctgcggngcttacctacgcaagatggcggtggacggctacatcgtgcagcttgacatgggcgcggtgctggaactggtaaaattgctgcgttccgtttccagcaacgtcaaccagatcgcccgccggtgcaacagcacccacaacctttatgagcaggatgtggaggacttgcggcagggctactctgaaatctggcagggcgtgaacgacctgctgaagaaatttgaagcactgtaa

SEQ ID NO: 590 - DNA (genomic), 879 bp, Enterococcus faecium; double-stranded, circular
  misc_feature (B) LOCATION 1...879
  hypothetical: NO
  anti-sense: NO
gactttttagcactaacattagcaataacattgaatgtaccttttgcaatcgcagatgcgacaagtttgacagaagctggttatgtgggggaagatgtagaaaacattttgcttaaattgcttcaatctgctgattacaatgtggaacttgcagaaaaagggatcatctatattgatgagatcgataaaattgcgcgtaaaagcgaaaatgtatctattactcgtgacgtttccggcgaaggtgtccaacaagccttgctgaaaattctagaaggaactgttgcaagtgtgccacctcagggcggacgtaaacatccacatcaagaatttattcagattgatacgacgaacatattgttcatcgtaggtggtgcatttgatggcatcgaaacgattgtgaagaatcgtatgggcgaaaagacgattggatttggtacacaaaaccaaaaactttctgaagacgaaagtgtcatgcagcatatcattcctgaagatttactaaaattcggattgatccctgagtttatcggacgattacctgttatggcagctttagagaaattgacaacagatgatctggtacggatcttgactgagccgaaaaatgcgctagtcaaacaatatcaaaaacttctttctctagataataccgaacttgaattcgaacctgaagcgttgagagccattgcgaaaaaagcaatcgaacgcaataccggtgctcgaggacttcgttccatcattgaagaaatcatgatggatgtgatgtttgatatcccttcaaatgaaaacatcgaaaaagtgattatcacaaaagaagcagctgaattgtctggtgagccaacagtaatctataaagattcagagaaaaaagcgggttga

SEQ ID NO: 591 - DNA (genomic), 1071 bp, Enterococcus faecium; double-stranded, circular
  misc_feature (B) LOCATION 1...1071
  hypothetical: NO
  anti-sense: NO
atgtttttagcattaaatgaaattatgcattcaaagttacgttatgcgttagttgcaggggtgatgtttttgatcgcctacctggtattttttttgactgggttagcttatggcttagctcaagataatcgaacagcagtcgacaagtgggaggcagattcgattgtgctttcgaaagatgcaaattcaaatctagggatgtccatgattactaagaagatagcagaagaagtcgaaggtgggaaagtggcgtatcttgcccagacacctggagtcgtgactagtaaagacagtacagaagaaggaaaaatcaatgttagcttcttcggtatcgataaaaatcaattcatcatgcccaatcttgttgaaggaaaagcttttgataacgatgatgaggcagtaggcgatattagtttgaaagaagaatatggtctagccgtaggagatacagttaagttatctggtagtgacaagacgtttaaactaactggctttacggatcatgccaaattcaatgtctcaccagttctctatacaaccatcaatgcttaccaagagatccgcttcgaaaaagaagatacaagtgaaaatgcacggattaacgcaatagttgtcagaggtaaaatcagtaatttacctgaagatttagaacagatcaaaatttctaaattcatcaatgaattacctggatataatgcgcaagtattgacttttggatttatgatcggatttttgatcgttattgcggctattgtgatcgggattttcatttatgtactgacgatgcaaaagattaatatctttggtgtaatgaaagcacaagggatcacaggaggatttattgcgcgttctgtagtggcacaaacattcattttatcatttgttggtattcttcttggtctattaggaacagtgggaacatcccttgttctacctgatgcggttccattccaaagcaattggctgttttttggcgtcattagcttgttgatgctggtagtagctgtgttaggcgcactattttctgttcggacaatcgtaaaaatcgatccgttgaaggcaattggataa

SEQ ID NO: 592 - DNA (genomic), 597 bp, Enterococcus faecium; double-stranded, circular
  misc_feature (B) LOCATION 1...597
  hypothetical: NO
  anti-sense: NO
agtgatttagcattcttatttttaaaaataactgtgttatatattaaaaaaggcataatagttataagcttttttaaagaatatttagaaattattaattttcgtctgaaaacaaaaaaagaaagcgttattattttagtctattttcagggggggaaccttatgataaaaaaactatttttactatcaatattaacgctagcaatggcaggttgttctgactctggcttagcaactgaactgatcacaaaatcaactgaagccacgacagaggagttaaaatgtggaaacgatcacagtgactacagaggcttaaatcgacgatgcatgggaatattaggcagaagcaattgtaagcatcgatgtagtaatcgaagaaggtgtagaagaagcaacagaaaaatcaaaagaaagatcaaaagaagcaatctgtgctgtgcatcgtatacagacgtcgaagatgcggtacttttaaaccacgtcaggagatgttcatttatgtctagggaagttggcgatgaaccaaaactagagtacgcttttagttttgcacgtgaggatgaagataaccctaaaacttacgacattttagcttga

SEQ ID NO: 593 - DNA (genomic), 885 bp, Enterococcus faecium; double-stranded, circular
  misc_feature (B) LOCATION 1...885
  hypothetical: NO
  anti-sense: NO
ttgcccttagcgttattggattcacattatttatttaggagggaaaatatgctgcggtttttgattttatctgggtatttcgaattgatgatgtacttgcaagtttctggcaaactcgatcaatatatcaatgtccattatcgctacttagctattctttcaatgattttatctgctcttttggctttagttcagctgtatttgtgggtcaaaaacggaaaagcagaagaaaaggcacacgagcacgatcatgaccatgggttgtcaaaaccttatcaacgtggaatcgcttatgtactgctagctttgccagtaatcgtggggacgttgtttccaacagttagtctcgacactacgatcgtagaagccaaaggatttaatttcccagtaagtaaagaatcagtaggggatccggagatgcagacacaatacttaaagccggataccagtatttatttcaacaaatcagactacttagaccaaatgaatgagttgaaagaaaagtatggggataagcaaactatcaagatcacagatgaaaactatttagaagttatggagctaatttataattaccctagcgaattcattggcaaaaaaatcagctatgaaggatttgtttaccaaacaccgaacgatagcaatacagatatcttcttgttccgattcggcattatccattgtgtggcagattcaggagtctttggtttgttgacgcatatgccggaaggagtaacggttaaaaatgatgaatggtataaaatagaaggaaccatccaatcagactattatcaaccattcaagcgtgaaatcccatctgtagttgttacaaacgctgagaaagtctctgctccgaaaaatcagtatgtgtatcgttctttttaa

SEQ ID NO: 594 - DNA (genomic), 315 bp, Enterococcus faecium; double-stranded, circular
  misc_feature (B) LOCATION 1...315
  hypothetical: NO
  anti-sense: NO
ntnagcttagcgcgtgaggctaanaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 595 - DNA (genomic), 243 bp, Enterococcus faecium; double-stranded, circular
  misc_feature (B) LOCATION 1...243
  hypothetical: NO
  anti-sense: NO
caaaggttagccaaaatgtgccttgcatcaattttttattcatttaaattccctcaactattctttcataaaataaacatcttccctattatagcaaaaaatcatagaaggacaaatccctctctaattcctaaaataaaaaagagcttgcatcataagccaacactaatcttttttatccctacgaataaacttgcatccagaattgactgttgcaaatgcagttcggatagatcagtttga

SEQ ID NO: 596 - DNA (genomic), 633 bp, Enterococcus faecium; double-stranded, circular
  misc_feature (B) LOCATION 1...633
  hypothetical: NO
  anti-sense: NO
ggagaatattttatgatattatcagttgagaatttcaccctgtcaattaataaaaaaaagatcaaacaaaattggaacttttcaatatcagaaaaagattttattatagtaacaggaaaaagtggtagtggaaaaactactctgttaaataatttaagcctaatagataaacaatataccggtaacttattctattttgaaaagaaagtttctaaacatgatatacaacgtctacgaagaaatcatattagctatttatttcaaaactatgctcttcttgaaaatcaaacagtacaatacaatttcgaattagcaaaaaagtttaacagtaatatttccaatgatcatatttataatttattaacagatttttctttgccaaaagatatcttaaaagaaaaaatctttctcttaagcggtggagaacaacaaagaatagcattaattagaaatatgttaaaaccatttgatatattatttgcagatgaacctacaggaaatttagataaagaaaactcaacttttataatgaactttctgaaaaatttaacagaaaaagaaaaaaaagccgttgtactagtaacacatgacttaaatgttctaaactatggaactaatattatagaattataa

SEQ ID NO: 597 - DNA (genomic), 423 bp, Enterococcus faecium; double-stranded, circular
  misc_feature (B) LOCATION 1...423
  hypothetical: NO
  anti-sense: NO
tatatgctagcatgcttttgtaagaaaaagaaagagggcgtattagttatgtatcttaaaattacggaacaagcacaagaaagattacaaaaatatattgatgaaggcgcaacagttatattggatttagatgatggcgttggggaatattctaaaatgggtgtttgctctttagatactagttttcgtttacttcttcttgataaagaacagagaaaaaatgattataaactccaattagatagtgatattggggatgtttatataaaagattattcaaaaatgtacatggatgaacatatgaccctttctttagatccacgtctaggtgtatttactcttgaaagcccaagtggttctttagacagtcatgttcaattagtagatctacgaccagaaaaattctctggaataaaacaataa

SEQ ID NO: 598 - DNA (genomic), 285 bp, Enterococcus faecium; double-stranded, circular
  misc_feature (B) LOCATION 1...285
  hypothetical: NO
  anti-sense: NO
aaatcaatagcatccaagatgttgagccagattatcaatttcataaagaaggctgctcggaagaagaatcaaccccattcaatgagccgaagcaattttacaaaagggggaaaagtaggggcaaatctcaacgctatcaatgtaaggcgtgtaagaagttcactaatgttctaccaaaaagagaagaaaccactacttatcaccaacaaaagaacaccattcttccaatgttcgctaagatggttgttggaagggtttcagtcagtcgtacttgtgatattttag

SEQ ID NO: 599 - DNA (genomic), 705 bp, Enterococcus faecium; double-stranded, circular
  misc_feature (B) LOCATION 1...705
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatatatgaaaacccgaaaagaaggcactctcttcgggttttcggtctgtactgaaatcaaggtattattgggaatcccagcttaa

SEQ ID NO: 600 - DNA (genomic), 705 bp, Enterococcus faecium; double-stranded, circular
  misc_feature (B) LOCATION 1...705
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaa

SEQ ID NO: 601 - DNA (genomic), 705 bp, Enterococcus faecium; double-stranded, circular
  misc_feature (B) LOCATION 1...705
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattatatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaa

SEQ ID NO: 602 - DNA (genomic), 705 bp, Enterococcus faecium; double-stranded, circular
  misc_feature (B) LOCATION 1...705
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcgagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcaatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccatccgaggattatataagaaaacccgaaaagaaggcactctcttcgggttttcggtctatactgaaatcaaggtattattgggaatcccagcttaa

SEQ ID NO: 603 - DNA (genomic), 390 bp, Enterococcus faecium; double-stranded, circular
  misc_feature (B) LOCATION 1...390
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagtttgccgtttgcgacatatacttctaatgtag

SEQ ID NO: 604 - DNA (genomic), 705 bp, Enterococcus faecium; double-stranded, circular; identical to SEQ ID NO: 601
  misc_feature (B) LOCATION 1...705
  hypothetical: NO
  anti-sense: NO

SEQ ID NO: 605 - DNA (genomic), 189 bp, Enterococcus faecium; double-stranded, circular
  misc_feature (B) LOCATION 1...189
  hypothetical: NO
  anti-sense: NO
aaaaagatagcaggaggaatgacgatgagtcattttaaaggaaagcaatttcagcaggatgtgattattgtagccgtggactactatcttcgttataaccttagctatcgtgaagttcaagaaatcttatatgatcgtggcattaacgtttcggttctgttgcaaagttttaaatctactatcaaataa

SEQ ID NO: 606 - DNA (genomic), 705 bp, Enterococcus faecium; double-stranded, circular; identical to SEQ ID NO: 600
  misc_feature (B) LOCATION 1...705
  hypothetical: NO
  anti-sense: NO

SEQ ID NO: 607 - DNA (genomic), 705 bp, Enterococcus faecium; double-stranded, circular; identical to SEQ ID NO: 601
  misc_feature (B) LOCATION 1...705
  hypothetical: NO
  anti-sense: NO

SEQ ID NO: 608 - DNA (genomic), 705 bp, Enterococcus faecium; double-stranded, circular
  misc_feature (B) LOCATION 1...705
  hypothetical: NO
  anti-sense: NO
aaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatgcgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccatccgaggattatataagaaaacccgaaaagaaggcactctcttcgggttttcggtctgtactgaaatcaaggtattattgggaatcccagcttaa

SEQ ID NO: 609 - DNA (genomic), 711 bp, Enterococcus faecium; double-stranded, circular
  misc_feature (B) LOCATION 1...711
  hypothetical: NO
  anti-sense: NO
ccggagatagcaaaggagaagtggctgatggcagaacaatttacgccagaaatcatgacggaattgagaaaagatatcgtaagagtaccggaaatcattttagaagcaagcgggatcaagatatttggaaaattgatccgttcgatcatctttactacggatattgcgatcatacgtaatacaaatgcgaatgcagtaattgctgtgtatccttttacacctcatccagcgattactaaaagcattattgaggcagctgacattccagttttctccggtgtaggtggtggtttgacacaaggtgctcgttcttcctacatgagcatgttcgcagaagcgcaaggttcgttaggggtcgttttgaacggtcctacgcctttagagacagtaaaagaagtttgtcgagtagttgatattccagttatcagtacggtaacgtcgaaatatacagaaatagatgaaaagttagcagctggtatttcgattatcaatatcagtgcaggtaaagaaactgcagaagcagtacgccattttcgtaaaaaatatcctgaacttcctatcattgcgacaggtggtccaacggaaggaagtattgctgagaccattcaagcaggagcaaatgccatcacatatacgccaccaagtagcggagagctttttagtcgtaaaatggaaaaatatcgggaaactgagaaaaagaatcatgaataa

SEQ ID NO: 610 - DNA (genomic), 330 bp, Enterococcus faecium; double-stranded, circular
  misc_feature (B) LOCATION 1...330
  hypothetical: NO
  anti-sense: NO
attactgtagcagctgcttgtaccaagctagtgattgtattcttgatactgttccaaatactagaagctgttgcactaattgaattccaaatatttgaagccgtagtactaatagctgtccatataccattccaccatgccactactggatcaaatatagtatggaatgtagttacaatcccattccaagcgatacttatccattgtgtcatagtatcccaagtatttttaaggaaatcagaaataggtgtccaaacagcttgccaagctgcgcccaataactgtccagctacatcaaaaatacccacgataatattaataccagcttga

SEQ ID NO: 611 - DNA (genomic), 396 bp, Enterococcus faecium; double-stranded, circular
  misc_feature (B) LOCATION 1...396
  hypothetical: NO
  anti-sense: NO
atgcaggtagcccgttttttgaaacgaaaaaacactttggatgcggaggtaattgtcatgcaattagacaatagtgaatttgaaataacaaaacgacgcgggctgatcgtatgggtctacagcttaaaacaattaaagaatctgaaaaagttcggcttgttgcattatgtctcaagaagaatgaaatatgtcgtgctttacttaaatgaagagacattggaagaaacagaagaacgaatccgtaaattacattttgttcgaaacgtagaacgttcttaccgaccggatatcgaaatgaattttgccgaaaaaataggaaacaaaacagtattaaaagacgaaggtttcgaaattgaagagctaaatacagaaatccgattagctgaacatctttaa

SEQ ID NO: 612 - DNA (genomic), 213 bp, Enterococcus faecium; double-stranded, circular
  misc_feature (B) LOCATION 1...213
  hypothetical: NO
  anti-sense: NO
tcaacttcagcgcctgctatcttaatgaaagtaaaaggatcaaaccttttaacgctagtgaattttaacgaaaaaaaaggcggaatgcaagatgtttttcccacaactttatacaattacttcttattctcttttacaaagtacgatacgtattcgagaatatgtacaagaagcaaaaaaacaaggctacacttcattagccataacggataa

SEQ ID NO: 613 - DNA (genomic), 2742 bp, Enterococcus faecium; double-stranded, circular
  misc_feature (B) LOCATION 1...2742
  hypothetical: NO
  anti-sense: NO
agtaattcagctgaaaaaagaagaagggggagaagtatgcagtcaatcaaaaatacgcttcgattatatttgcttgactggaaacggattttcaaaaacccgattgcaacacttctgatcatcgcgatcatgatcatcccttcgctatatgcgtggtttaacatcaaagcattatgggatccatatggaaatactggagagctgccaattgctgtttacagtgcagacaagccagcagagtttcaaggtaaagaagtggccattggggagcaagtcatcgaatcgcttcataaaaataaacaattaggatggcaattcgttgattcaaaagaacaattagaagacggagtccgttccggaaagtattacgcaggtatttacttgccaaaggatttctcagaagatctgctgagttttactagtggtgatatcaagaaaccaaaaatcgaatatacggtaaatgaaaaaatcaatgcgattgcaccgaaaatcaccgataaaggagcaagttcgatccaatcgcaaatcacaaatgaatttatcaaaacagccagttcgactttattgaaagtattcaatgagataggttacgacatcgatacgaacctagtaagtatcaataaagttaaagatatgattttatcaacagatgaaaatttggacacgatcgacggctacacaaaacaagtcctcgaattacaaagtcaactacctgaaatcaaggaaaaactgaataaagcaaatgaattcgtggattacatccctaaagtagatgagatgggtgaaaaagtcgttgcattgaatgacaaaatgcctgagttgaaagatcaagcaaaaatcatccttgatttgcaagaaaaaatcccagagatccaaaatgccggtaagcaactagcagagatcgacggcgattttgcttcgatccaagagacaatgaaccaaggaatcgatgaagcaaaacaaggcttgacgatcatccaacaagtacaagatatcttgccagatgtgaaaaatttagaaaatcaggcaagtgatctagcaaaccaaacaaaatcaggtgcctctcagctgaaagatgcgataccaagcatcacaaacagtgtagatgttacattgaagtcaattggacaagtggcaacaacgacaggttcgttaatagatactgtaagaacagctattgaagatggtaagctgactgatgatgaaaagaaaaacatcagcaatgtattgaacggctttattgacggaatatctcaacaacaaaatgcaatcgataaactggtcgagttcctgactaaattgcaaacaagtgctggaaatacgaaattacagccaattattgatcagctaaatcaattaaaacccttgctaagcaatctgcaaaaccgcctatctgctttgaacacagctgttcaaaatgaagacacgaaggctattgatgaattgctagatcaaattgatgccgttgttaataatatcaatggcatcattgctggtatcaatacaggtcaaatcagttccactgtcacttctctactagaccaagtcatcgatacgattgggactgcacaaggcgcactgagcaaagcggaccagatcgactttgattcgcttctcagctcaacgaaagcaactgtaacgaatgcagtggcaattttagaaaaatatcaaaaagaaatgcctgcaattggacaagaaatccatgatgccaatacaatgctgaatggaaatatggataccatcgtcaatggcatcaatgaaggggcagacctatacaacaatgaattaccgatcattcagcaaaaattaggattggccgctgattttatccaaaatgattggccagcactaaaaaatgaaatcaccggtacattgacaacagtaaatgaaaaaatgccagaagtcgaaacagctgtgaacgctgctgcggacttgatcaacaatgactggccaaatatcaaagctggtatccaaaaagcagcagacgcgatccgaaaaggcgaacaagaagtcgatctaggcgaagtcatcaaattattgaaactagacgcaacaaaagaaagtgacttctttacacaacctgttgagctacaaaccaatgcgctttatccaatcgcaaataacggttcagctagcaccccgttttatactgcactatgtctgtgggtcggcgctgttcttctttcaagtgttgctacgacagaatactatttaggaaagaaagaccgaaacaattttacgaaacgagaacaattcgttgctcgtatgctgacatttttgacaatggcgattgcgcaaagcttgatcgttacattagggaatattttcttactaggagtagatgtccaaaatccggtctacagcgtgtcatttgctgtcttgatcgccttagcgttcatgatgatcgtctatgtcttggctgcattattcgataatgtcggtaaagggatcgctattatcatcttagtactgtcgatctctggcggaggcgggaactatccgatccaagtctcagggaaattcttccaaatgatcaatccgttcttgccatttactcatgcggtaaacttgttacgggaatctgcaggaggaatttattggccaaatgctacgaaagcaatctggatcatgatcggtttgtttgttgtctttggaatcgtaggaacggcaatctatccgttcatcgaagaaaaaatgacgaaattcaaagaagcggcgcatgagagccatatttttcattaa

SEQ ID NO: 614 - DNA (genomic), 1038 bp, Enterococcus faecium; double-stranded, circular
  misc_feature (B) LOCATION 1...1038
  hypothetical: NO
  anti-sense: NO
gaggaatcagctcatatgatcgaaaagataattttaggaacctatacgcgtcgcgaaagtaaaggaatctatacgatcgaccttgatacagaaaaagaagaattagccaacctttcattagctgttgaagaaaatagccctacctatgtagcaaaaagtaaagctggcaatctttacacagttactagtgtggatggattaggtggtgccggtgcgtacgataaggattttcattttttgaatgcggtaacagagtctggcgctcctttgtgttatgtagcggttgatgaagcacgtcaattactatacggggcgaactatcataaaggtgaagtaaatgtctaccatatattaggagatggcgaactgaaagcagcagattcaatattccatcaagaagcgacaggtcctcataaaaaccaagatcatgcgcatgtccactatacggatctgactcctgaccaacgattagtcgtatgtgatcttggtacagatcgtgtgtatacttatgatgtgtccgaaaacggcaaattgaatcttgtaactaccttcactgcagagccaggaacaggccctcgccatcttgtctttcatccaaatggacaattcgcttatttatttggtgaattagacagcacagtccgcgtgctttcttataataaagaaacaggtgcttttgaagaattacagaaaatatcgaccttgccagaagaattcgacggtgaaaatggaggggcagctatccgcatttcaaatgatggcaagttcctttatgcttctaaccgaggacataactcgattgctgtattcgcagtttttgaagatggttcccacattcaaaacaagcaaatcatctcaacagaaggggattttccccgcgatttcgcactagatccaagcaataattttgtcgtgtgtgccaatcagaacaccgataatctgacattatatcgccgtcatcctgaaacaggattactggaattactgaaaaaagatgtctatgtaccagaatgtgtctgtgtttattttgatcgttag

SEQ ID NO: 615 - DNA (genomic), 492 bp, Enterococcus faecium; double-stranded, circular
  misc_feature (B) LOCATION 1...492
  hypothetical: NO
  anti-sense: NO
agagagccagcggaacacggcatcatggatcagccacccattccgaaaaatgaagggatctttgctcgaggtttattgcgtaaaattgccataaatgcaggggtcttcaccatcgtaaccttgtttggttattatttaggtagttatgtcgatactatcagcccatgggtagacgcaagtcagcatgtcggtcaaactgttgcattcttgatcttagcttattcatcgattctgcatgtgttcaatgtacgcagcagccaatcgatcttcaaagtcaatttagcgaccaataaagctttggtagaaatggcgttactggcattagctattacaacggctgttgctttgctgccatttacgcaagaactattcggcctagtacacatcagtttgaatcactggttcttggtagggattttatctatcgtaccaatcgcggtgaatgaactgatcaagttccatcgattaccggaagcagaagaagaggaatga

SEQ ID NO: 616 - DNA (genomic), 186 bp, Enterococcus faecium; double-stranded, circular
  misc_feature (B) LOCATION 1...186
  hypothetical: NO
  anti-sense: NO
gcgaatacagcgacattttctgtgaaaagtaaactttttttatctccatcgcgctctcctttttcttcaagtataccagtacgtcataaaaaggtcatgagtctcgtattcgactttgtagattccataagaaaacaattcataaaacatcctttaaataaaaaatacaaaaatcacaaaaattaa

SEQ ID NO: 617 - DNA (genomic), 996 bp, Enterococcus faecium; double-stranded, circular
  misc_feature (B) LOCATION 1...996
  hypothetical: NO
  anti-sense: NO
atatgtacagcaaattcaagcaatcgaagaataaataaaaggaatgaagaaaatatggcatttgaaagcttaactgaacgtctccagcaggcgatgggaaaactaagaaaaaaaggaaaagtatcagaagctgacgtaaaagaaatgatgcgggaaatccgccttgccttactagaagccgatgttaacttgcaagtagtcaaagactttactaaacgcgtacgcgaacgtgcggtaggggcagaagtgctggaaagtttatcaccagcacaacaaatcgtaaaaatcgttgatgaagaattaacaatcacacttggttctgaaacagcagagttaaataaatcaccaaaaataccaactgttatcatgatggctggtctacaaggggcaggtaaaacaacttttaccggtaaattagcgaattatttaaagaaaaatgaaaatgctcgtccgctcctaatcgcaggggacgtatatcggccagcagcgatcgaccaattgaaagtattaggtcaacagctagatgttcctgtatttgatatgggaacagaagtcagcccagtagaaatcgttcgtcaagggatggagctagcaagagaaaagaaaaacgactatgtattgatcgatacggcaggacgtctacacatcgatgaaacattgatggatgagttgaaacaaatcaaagaattaactcaaccaaatgagatcttgctggttgtcgatgccatgactggtcaagatgccgtcaatgtagctgacagcttcaatcagcaattagggattactggagtagtcatcactaaacttgatggggatactcgaggcggggcagcattatcgatccgctcagtgacaggcgcaccaatcaaattcatcggttctggtgaaaaattgactgatttagaagtattccacccagctcgtatggctagccgtatcgtcggtatgggggaaatggtgacattttttgaaaaagcgcagcaagaatttggttga

SEQ ID NO: 618 - DNA (genomic), 567 bp, Enterococcus faecium; double-stranded, circular
  misc_feature (B) LOCATION 1...567
  hypothetical: NO
  anti-sense: NO
agaatgacagctatttataaagcactaaaaaattctaacgtatcagagtacgttaagtcgagagtattaaataataatttagattacattttagaaaatggtgttgctgatttaatcagtaaattaagtgatcctatagatatagatcatttggtggtatggcaagatggtactttagaagtatcaatatatggagaattttatagtagaaataaagtaactacattcaaaaatagtattagtggtcgagaagatttaaaaggaatcaataaaaatagtaaattctatagaacaaataaagaattgctagaaaaaatttcaaagcgtgtttttgaattggtgaatccattttcaaaaaaacgtagtaaagaactttttggaattttttatgatggttttagtgcaaaaagtaatgtagaaaaatttttttattttaatgattcagcttatattgcggttaaagacagtaaaagaatccctgaagcaactttagaatatttagagccaattaaattgtctgttttttattcactttatgagaaagaaatcgctgatgaagcggtttaa

SEQ ID NO: 619 - DNA (genomic), 705 bp, Enterococcus faecium; double-stranded, circular
  misc_feature (B) LOCATION 1...705
  hypothetical: NO
  anti-sense: NO
aaaaagacagcaggaggaatgacgatgaatcattttaaaggaaagcaatttcagcaggatgtgattattgtagccgtggactactatcttcgttataaccttagctatcgtgaagttcaagaaatcttatatgatcgtggcattaacgtttctcatgcgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccatccgaggattatataagaaaacccgaaaagaaggcactctcttcgggttttcggtctatactgaaatcaaggtattattgggaatcccagcttaa

SEQ ID NO: 620 - DNA (genomic), 924 bp, Enterococcus faecium; double-stranded, circular
  misc_feature (B) LOCATION 1...924
  hypothetical: NO
  anti-sense: NO
atgactgcagctgcagaaaaaaaagatcatcaaaaagttattcttgttggagacggcgccgtaggttctagctatgcctttgctctagttactcaaaatatcgctcaagaagtaggtattgtggatatcaatactgctaaaactgaaggagacgcaattgacttgtctcacgctttggcatttacttcacctaaaaaaatctattctgctacttacgcagacgcacatgatgctgacttagttgttattacagctggcgcaccacaaaaaccaggtgaaactcgtttagacttagtaaacaaaaacctaaaaatcaaccgcgatgttgtcacacaaatcgttgaatcaggatttaacggtatctttttagttgccgctaacccagtagatattttgacttactcaacttggaaattctcaggtttccctaaagaacgcgtaatcggttcaggtacctctcttgactcagctcgtttccgtcaagcacttgcggaattagttgacgttgatgcacgtaacgtccatgcttacatcttaggtgaacacggagattcagaattcccagtttggtcacatgcaaatgttgccggcttgcaaatctatgaatgggtaaaaaacaacccagaaatcgatgaagaagctatggttaacctattctttggcgtacgtgacgctgcttacacaattatcgagaaaaaaggcgctactttctatggtatcgcagtagcattagcacgtatcactcgtgccatcttagatgatgaaaatgctgttcttcctttatcagtattcatgaatggcgaatatggattgaacgacatctacattggtgcacctgctgttatcaaccgtcaaggtatccaaaaagtaatcgaaattcctttaagtgacagcgagcaagaccgtatggctggcttctgctaa

SEQ ID NO: 621 - DNA (genomic), 2289 bp, Enterococcus faecium; double-stranded, circular
  misc_feature (B) LOCATION 1...2289
  hypothetical: NO
  anti-sense: NO
tttgctgcagcaaggaatatgacgatcaaggtagaaggaatcgaagttgcttactcagatcctgcgacagatcctcctgggcaagaaagacctactcgcttgattgatccgatttacactgtgacctctagtaatcattcaggaaaccaagatcatactatgtcctttagagcaaatgctgacggattattgacaattaaaaataaagcaacaggagaggtgcttaagaacgcaaaaaacttggctatcactgcgaatcgggaatttgattatcagacaaaactgatggaaggaacgaacgaatttactttcagttttacgccagataaaaactatccgccagaagaatacgtagagatgactagttatgaaacaaaagagattcttcatacagtggactaccgtaaacctaaatattcgacagtttatgtaacaccagaagggtcagatgcaggaaacggaagcagacaaaatccattatctctgacacaagcattgagatacgcatatgctgggcagacaatcgtcatggcgcctggaacttattccttcgaaagaggattgacgattccaaaaggcgttaacgggacaagagaaaacccgattcagttgattgcagagaaaaatccagaaaacaagcgtcctgtacttgattttaaaggaactggaaatgggatgacactgttcagtcactactggggtttacgagggtttgacattacaaatagtgcagctatgcaaaaaggattacagatttctggaaatcataatttgatcgaagagattcatgcttatcggaatggaaatacaggaatccaaatcagcggtagctcaaatgatcctttcgaagcatggcccgcgcataacttagtcaagaactgtacatcttttgaaaatgccgatccaggatttgaagatgccgatggatttgcggccaaactgacaataggagaaggaaatgtatttgacggttgtatcgcgtatcataatgcagatgacggttgggacctttttgctaaaaatgaaacaggttcgatcggaaaagtaatcatcaaaaactcagttgcttatcgaaacggctgggtaccaggaattgagggagaaggtaacggtaatggattcaaaatgggcggttcttctttaacgggccctcatgaattgatcaatagtttgtctttcgaaaatcttgcgaaaggaatcgattccaatagcggaacagatattatcgtcaatagcagtacaagttttaataacggttcatataatgtggctctttatacctcttcagcaggaaacacagactaccatgcttctggtatcttatctttccgaacagagaatcttgagatgagagagcagatccgcccattgaatcaaaacgaagatcaaatctaccactcgttgaactactattggaatgaacgagagaaacaatcagaaaatactcttggacataccatatcaaaagattggatcgagtctctaaatacatgttcgaaagaaggtcagcagcctgttacgcgctatgaaaatggaagtatccatgttcatggactgatgcagattaaaccggggaatcgtcaaacagaaaaggaaagagtggatggtcttccattatctgtaggtgctatttttgacggagaaacctcaccgtcttcggaatatccagagtatgcaatcgtacaagaaccaaatcagacaaaaccaaatgaacaaaataatccgattattatacaagaagcaaatggtgtggcggagaatgcagaaggaaatatcattgaactgaagccttttacagtttttgtgtcaactttcacaccaaatcaaggaacgcctgtctttgaagatatgcgttatttcccagaaaagatccaaatcgttgaaacacagtcaagtgctcaattttctaatcataccgctattttttcagcaccttcaaaaggagaatatacgctagaagtcacttatcgttcggaaatatttgatggggaaaaatggtctgctcatacagaatctgttacccagcaaaaagcgatcactgtgcgagaaactgccgatgtgcccccgggaaatgacaaaccagaaagagaaaatccaggaaatgaatcaccaaatggaaaaccaaatggaaaaccttctcatccggataggacagcaaaagaaagtgaaaaaaatggcactcaaggactcccaaaaacgggagaatttaataacccgttgctagcattagctggaggaattttgttaatcggtgtagttgtttatgtcatgaaacagcgaaaaaaataa

SEQ ID NO: 622 - DNA (genomic), 1068 bp, Enterococcus faecium; double-stranded, circular
  misc_feature (B) LOCATION 1...1068
  hypothetical: NO
  anti-sense: NO
gcaactcttttagaaccttttcttatttgctatatagtttcttctgagtatggtaaaataggaaagaatgaatcgaaaaaaaggggatgtctatttttgacggaagagtctagttctttagagattagattgacggctgctgatgatgtcagcatgcttttaggtgcacacgacaagcatataaaactgattgaagaaacaacagaaacaaccatccatacacgtggagaaatcattcagatcattggcgaacaatcccagatttccttggctgcctcagtcattcggacattgcaggaattgatcaaacgaggaatccatgtaagtacaccagatgtcgtgacggcactgaaaatggggcaaaaaggcacattagattattttgttgaaatgtatgaggaagagatcgtcaaagaccgtaatggaaaaccaatacgggtaaaaaacagcggccaaaagaaatatgtcgaatcggtagccaaacatgatatcgtatttggcgtaggaccagccgggacaggaaaaacttttcttgcagtagtattagcaatcgctgccttgaaaaaaggtgaagtgcaaaaaatcattttgacgcggcctgctgtggaagcaggggaaaatctaggctttcttcccggggatctaaaagaaaaagtagatccttatctgcgtcctgtttatgatgctttataccaaatttttggattagatcatacgaaccgattgatggaacgaggcgtgatcgaaattgctcctttagcttacatgcgggggcggacattggatgatgcattcgttattttggatgaagcacagaacacgacagttgctcagatgaaaatgttcctgacacgtcttggttatcaatcaaaaatgattgtcaatggagatacgagtcagattgatctgcctcgagggacaacaagtggtcttgttcatgcagaacgaacattaaagcaaatcaagaaaatcgattttgttaattttgaagcaagtgacgttgttcggcaccctgtagttgccgaaatcatcaaagcttatgaaaaggcagatctccatcaagaataa

SEQ ID NO: 623 - DNA (genomic), 1191 bp, Enterococcus faecium; double-stranded, circular
  misc_feature (B) LOCATION 1...1191
  hypothetical: NO
  anti-sense: NO
tttaatcaagcccttttaagtcaatttacattgatacggttggttaattatagtacgtcaccattgaacttttggagcggattggctttttcatctactttcttggtgactacgcttatctctccttggtggggaaaattagccgaccaaaaaggaagaaaattgatgctgttgcgtgcttcattaggaatggcaatcgtcatttctttgatgggttgcgtgactagtgtgtatcaattagtcgcattgcgtctgcttcaagggattttttctggttatatcagtaatgccactgcccttgtcgcaactgggacgccaaaagaaaaaagtggtcaagttcttggaaccttagcaactggttctgttacaggaacattacttggaccgcttcttggcgggatctctgcttcagcgtttggctatcgccctacctttttcattacagggatcatcttatttttcgtcttcttgttgagtctgtttttcgtccatgaaaaatttgtcccagtgaaaaaagaaaacatggtttctgccaaacagattttcaaagacttgaaatatccacacgtcgtcatcggtatgttcgtcacaacgatgatcatccaagcatccaacaattccattagtccaatcatcagtctgtacattcgccaattgctgcatggacatgggaatgttacgttgatcagcggaatcattgcttcgatacctgggattgccactttgatagccgctccaagatttggtcgcttaggtgacaagattgggagtgaaagaatacttgcgattggtttgggttttgcgattctggtttatatcccaatggcattcgtcacgaatgtttggcaattagctgccttacgttttttgattggtatctctgatgcttgtctgctccctgctgtccaagcattgatcacaaaatattcgcctcatcaagctgctggacggatcttcagttataaccaatctttccaagcaactggtaacgtagtagggcctatgatcggctccagtgtttccagtgcatttggttatcgcggcgtctttctttcgacttctcttcttgttttggtcaacttcttgcttgtacgacacaatacacaagagatccatcagcaagaaactgcagaagaaaaagcttcaggagtctccatagcttcagggcactctccttctcatagacaataa

SEQ ID NO: 624 - DNA (genomic), 183 bp, Enterococcus faecium; double-stranded, circular
  misc_feature (B) LOCATION 1...183
  hypothetical: NO
  anti-sense: NO
aatatgtatttttatggaaaaatttttctattaggtgtaaatttcttttttgtacaaaaaaaaggctgtgacaaaagtcttgtcacagtcccttatcccgaacaagcggtgttctcccgccaactcctcggtcacaacctccattttaacaataaacctgtaaatgtgagggcaatactttga

SEQ ID NO: 625 - DNA (genomic), 918 bp, Enterococcus faecium; double-stranded, circular
  misc_feature (B) LOCATION 1...918
  hypothetical: NO
  anti-sense: NO
tattttaaagcaagcggcgctgatattcggacgaaaagacaagtaattgatgccaacaagcataaatattccatatcagcgatgtgcaaaattctaaatatttctcgtcaaacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtggggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagaccggggaaaggaatttgataaccaaaccattcatgagattctgaatggttttggaattactcgttcattgagtaggaagggttgtccgtatgataatgccgttgtggaatcaacctataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaa

SEQ ID NO: 626 - DNA (genomic), 918 bp, Enterococcus faecium; double-stranded, circular
  misc_feature (B) LOCATION 1...918
  hypothetical: NO
  anti-sense: NO
tattttaaagcaagcggcgctgatattcggacgaaaagacaagtaattgatgccaacaagcataaatattccatatcagcgatgtgcaaaattctaaatatttctcgtcagacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtgaggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagactggggaaaggaatttgataaccaaaccattcatgagattctgaatggttttggaattactcgttcattgagtaggaagggttgtccgtatgataatgccgttgtggaatcaacctataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaa

SEQ ID NO: 627 - DNA (genomic), 726 bp, Enterococcus faecium; double-stranded, circular
  misc_feature (B) LOCATION 1...726
  hypothetical: NO
  anti-sense: NO
tattttaaagcaagcggcgctgatattcggacgaaaagacaagtaattgatgccaacaagcataaatattccatatcagcgatgtgcaaaattctaaatatttctcgtcagacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaaagggcaacgaacagcttgtagagcagatgattatatgacaaaacccatcgatgtcaatgagatgatcctacgtgtggaagcattgcttcgacgttcaaagatcaattacagcagtagcttgataatcggacaaacaaaattagagctagatgcttatacagtgttacaagatcagcattcgttgattctgcctcaaaaagaatttctgcttctgtataaattactgtcttatcccaacaagatcttcactcgccaacagttgatggatgatatttggggattagatacgaatacagaagaacgaacgatcgatgtacatatcaaacgtttaaggacccgttttgaaaagacggaagattttcaaatcatcacagtacggggactaggctataaggcggttatttaa

SEQ ID NO: 628 - DNA (genomic), 264 bp, Enterococcus faecium; double-stranded, circular
  misc_feature (B) LOCATION 1...264
  hypothetical: NO
  anti-sense: NO
tattttaaagcaagcggcgctgatattcggacgaaaagacaagtaattgatgccaacaagcataaatattccatatcagcgatgtgcaaaattctaaatatttctcgtcagacctactattatcaagcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaa

SEQ ID NO: 629 - DNA (genomic), 918 bp, Enterococcus faecium; double-stranded, circular
  misc_feature (B) LOCATION 1...918
  hypothetical: NO
  anti-sense: NO
tattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagctgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgctgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaa

SEQ ID NO: 630 - DNA (genomic), 918 bp, Enterococcus faecium; double-stranded, circular
  misc_feature (B) LOCATION 1...918
  hypothetical: NO
  anti-sense: NO
tattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagaaattggcgcagcgaatccttgataatgagctcggatgtgctaacgctagcgaggcagtctaa

SEQ ID NO: 631 - DNA (genomic), 918 bp, Enterococcus faecium; double-stranded, circular
  misc_feature (B) LOCATION 1...918
  hypothetical: NO
  anti-sense: NO
tattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaa

SEQ ID NO: 632 - DNA (genomic), 918 bp, Enterococcus faecium; double-stranded, circular; identical to SEQ ID NO: 631
  misc_feature (B) LOCATION 1...918
  hypothetical: NO
  anti-sense: NO

SEQ ID NO: 633 - DNA (genomic), 627 bp, Enterococcus faecium; double-stranded, circular
  misc_feature (B) LOCATION 1...627
  hypothetical: NO
  anti-sense: NO
tacaataaagcgtttacaatgtggttatcaaatgaaggaggtttctacatgaaaaagattagtacgttattgtttattgggttagttagtttagggttgttcggttttagcattccaggttttgcgcatggttatattacttctccaggaagccgtgcatacctaggaacatcagcagcaggaaacttaaatcaaaatgtcggaagagcacaatgggaaccgcaaagtatcgaagctaccaaaaatacattcattgatggaaaaattgctagtgcaggagtcagcggctttgagcctttagatgaacagacatctaacagatggcataaaaacatggttaatccaggaacattaaatattacttggaatttaacagcacaacatcggacaagtacttgggattactacattaccaaaccaacttggaatcctaatcaacctttgaaatttagtgattttgaattgatcacaaaaatagacgacaaagcaactgttccaccaaaaacagtcaaccaaacgatcacacttccgcaggatcgaaaaggatataatgtgattttagcagtatggaatatcagcgatacgacaaatgcattttatcaagtgatagacgtgaatatccaataa

SEQ ID NO: 634 - DNA (genomic), 195 bp, Enterococcus faecium; double-stranded, circular
  misc_feature (B) LOCATION 1...195
  hypothetical: NO
  anti-sense: NO
gtaaacaaagcggtaaaaatatcttttattcccttagttaatccgcttactacctactgtacaaagcaaattgttgttcaaactgctgatcagaacgctgcttggatttttctttgcgatacatcatacctcttttatcaattggaacaattatttatttctaacaaaatcacttcatttttgtcagataaataa

SEQ ID NO: 635 - DNA (genomic), 1011 bp, Enterococcus faecium; double-stranded, circular
  misc_feature (B) LOCATION 1...1011
  hypothetical: NO
  anti-sense: NO
atgctaaaagcttttaaattccgtatgtatccgacagaagaacaaaaacagcaattgattcgtacttttggatgtgctcgatttacctataaccatttgctgaaaaagcggcagaaaagttggcaacaaacaggagtagccaatttttcgctcacacccgctacattaaaaaaagaatacccattcttaaaagaagtagacagtcttgctttagcaaatgcacagcttaatttggatcgggcttttcgcaattatttcaagggacgtgccagcttcccaaagcttaaaacgaaaaaaagtatgtggcaatcttatacgaccaacaaccaaacccgtacgatctatctggaaaatggctacttaaagttaccaaaacaaaaagaactaatcaagataaatcagcatcggccagttgaaggatcgattcgctccgctacgatttctgctcgatataatgaagaattttatgtcgcactactttgtgatgtttcgccagtaaaaaaagaatctttagctaaatggatcgggatcgcctatcatccgaagacattgatccaaacatctcgacctctagaagtaactttaccaaaatttcaccagacagaagaaaagctgcaacatgcacagcggaaattgaatgtgaaagtccgctccgctcaccatagaaagatcaggttagatcaggcaagcaattatcagaaacaaaagagaaaagtaatggatctttatctgaaacaaaagaaccagcgagaagattatcttgaacaattatctgggaaattggtcaaacaatatgactacttatttgtagaatcttttccaaaagaagaggcacatgctgatttttctattcacgactggcataaattaataacaaaattgcgttataagtcccaatggtataataaaaaatttcttttgatcaataccgacggagcagaagaaagcaattccgtaagaaagagccaagtagtagaaaaaatgggcagacattcggttatcaagggataa

SEQ ID NO: 636 - DNA (genomic), 387 bp, Enterococcus faecium; double-stranded, circular
  misc_feature (B) LOCATION 1...387
  hypothetical: NO
  anti-sense: NO
acgccaaaagctgaaggaacaaactgtaccacagctgctggcggctccattgttttgctggttattaggaattgcaccgtcagagaaaatgcaggacattcaagaattgatgaggggatgaaagagatgaaaaaacgcttggttctggttcctgcctcctttatcttctgtgcatttttactgctgccgctgctttttatggttctgtgcagcttgcacagtgatttaactaaccagtggacattggccaattacagtgatattttcagcaacaaatattacacacaggcctttgttaacagcgtactgattgctgtcagctccagtgtgattgggttaatcgggacgtttattaaatgtttatgctttatgaatctgtgggactaa

SEQ ID NO: 637 - DNA (genomic), 207 bp, Enterococcus faecium; double-stranded, circular
  misc_feature (B) LOCATION 1...207
  hypothetical: NO
  anti-sense: NO
ggaaaaaaagcttcaaaagtaaaaattccaaagctcttagttgaaacgtgggtcgatgtctattcgatgttgaccgacgttttttctatgccttcagatttggttttaagcgatatctgtttagatgacattttgcaaatggcttacaacaagagtgcttatgaaggatggaaaaactatgcaataaaccaatcccagaaaaactaa

SEQ ID NO: 638 - DNA (genomic), 1101 bp, Enterococcus faecium; double-stranded, circular
  misc_feature (B) LOCATION 1...1101
  hypothetical: NO
  anti-sense: NO
tggaaaaaagcgtgcaaagaaagagggagtttcattatgatgctacgtgtagaaaaattgcgcaaaaaaatgcaagaagaaaatttggattcatttttggttaccagtccgtacaatcttcgttacttaacgaactttacaggtacgacaggattagctgttattactttggaaaaagcattttttattactgattttcgttataccgagcaggcggcagcgcaggctcaagggtttgaaattattaaaaatgtcggacctatttttgatgaggtagcaaacttagtacgcaaagaagaactgcactcattagcttttgaggaaacaacagtctcatttttagaatattcggttttagaagaaatcatcgatgcggaattagtacctgtttcacagatgatcgaagaactcagagaagtgaaagatgaagaagaaatcgctattatcgaaaaagcatgtcatattgcggatatggcatatgatcacatcctgaaaatgatccaaccgggcatgactgagattgaagtcgcaaatcaactagacttttatatgcgttctcttggcgcttcaggtgtttcttttgatacgatcgttgctagcggattgcgttcggctatgccgcatggtgtagcaagcaaaaaaatcatcgaacaaggtgacttgatcacattggactttggttgctattacgaagggtacgtttccgatatgacacgtacattcgctattggtgatcctggggaaaaattaaaagaaatttatcaaatagtcttagatgctcaattagcagttattgatgctgcaaaaccaggaatgactggtgtccaattagatgcagttgctagagattatatttcaaaacatggttacggggaagcatttggacattctacaggacatgggatcggtttagagatccacgaaggaccaaacgtttcttctcgtgcagaaaagcaatttgtaccaggaaatgtgatcactgatgaaccagggatctacttaccaggaatcggtggagtacgtattgaggatgacttgttgatcacagaagatggaaatcgtgtgttgactcgttcaccaaaagaattgatcatcttatag

SEQ ID NO: 639 - DNA (genomic), 708 bp, Enterococcus faecium; double-stranded, circular
  misc_feature (B) LOCATION 1...708
  hypothetical: NO
  anti-sense: NO
aggaaaaaagcggactttaccgttttaaagaaaaggggaaaagaaatggaactaaaccgaatgatcgaccatactattttgaaagcagacgcatctaaagaagctgtgatgcaaattatcgaagaagcaaaaaaataccatttttattctgtctgcatcaatccagcatgggttgcgctagcgaaagaacaattacaaggtgagccagtagccgtatgtacagtaatcgggtttcctctaggagcaaacacacccgagacaaaagcatttgaaacaacagatgccatcaataacggtgcagatgaagtcgatatggtcatcaatatcggtgctttgaaatcaaaggatgatcaacaagtccaaaaagatatcgaagcagttgttgaagcagcaaaagatcgtgcgcttgtcaaagttattattgaaacatcgttattagatagagaagaaatcatccgagcttgcgaaatagcaaaagctgcaggcgctgattttgtcaaaacatcaactggtttctcaacaggcggagcaaaggtagaggatgtccgtttgatgcgtgaaactgtaggaccagaaatgggtgtcaaagcttccggcggtatccataacgaagaagaagcaatggcaatgatcgaagctggtgctacaagaatcggaacaagcgcaggagtagcaatcgtatctggttcaactggtgaaggctattaa

SEQ ID NO: 640 - DNA (genomic), 267 bp, Enterococcus faecium; double-stranded, circular
  misc_feature (B) LOCATION 1...267
  hypothetical: NO
  anti-sense: NO
gaaatgaaagcacgtaaaaaaccagttactgtcgagattgtgcaacttaaaatgctatctgcacgttcatatcgcaaatgcaaagaattcgttggtgaagcatgggttgatcataataatatgccgaatggattacctggtattgaaacattagaaggcacgatggaaatatctgatggtgattacatcatcaaaggcgttcatggtgaattttatccgtgcaaaccagatatctttcttgagacctacgaaatcatcgaggagtga

SEQ ID NO: 641 - DNA (genomic), 393 bp, Enterococcus faecium; double-stranded, circular
  misc_feature (B) LOCATION 1...393
  hypothetical: NO
  anti-sense: NO
aacgcgaaagcgaagaaaggagcatacaaaatggcagaactggcatacaagaggacgggcgactacctgattcccgacttggtgatggacggggaggacgaaatggaggaaatgccgctgggcaagtacggcaggctgcggcagacctttcttcaggaacaccacaaggggacatacacctcgatgctgctgaccgggcggctggaaccccacctgcgggagatcgaccggcaggcgcaggaacaggcagaccggatcgtggcggaattaaagaaacagaacggcgtggacgaggggatgaaagcccgcgaccagatgggatgggtgcaggcagtcaacctgtttctcgcccaggcggaggaaaccgtactgaacgagatcgtttacaagtaa

SEQ ID NO: 642 - DNA (genomic), 372 bp, Enterococcus faecium; double-stranded, circular
  misc_feature (B) LOCATION 1...372
  hypothetical: NO
  anti-sense: NO
aaaaagaaagcatgtacctcttttttaaatcgaaaggaagtgaagcaagtgttagaagctttggaacaaatccgaaaagcagaagaagaaaatgagaagcgtgctcgaaccctacggcagcagttgaagacctatgcagaagaaaaagagcaagaattggagataatccaaacgaacagtcggcaacagctgaaacagttggtagaagaaaaagaacaattcgaaaagcaagaattagaaaaagaaaaaatgaaattgaaagcagaagcagacaaggtgcaagcaactttgaaagaccaatatcaaaagcatcagagtcaagcaatcggtgcaatcattgaaagggtgaaagaaacttatggccgtcactaa

SEQ ID NO: 643 - DNA (genomic), 1206 bp, Enterococcus faecium; double-stranded, circular
  misc_feature (B) LOCATION 1...1206
  hypothetical: NO
  anti-sense: NO
gaagagaaagctaaagcaggtgaaggaatgaaagtacaagtaaaaaaaagagcaagcagtcgattgaaaaaaggctatccattgatccaaaaagaagaccttgcacatcctcaaaaagaaaccacgcaatgggtggaattagttgatccgcaaaatcaatttatcgcaaaaggatatttaggaaagcagaataaagggatcggttgggtactgagccagcaggatatcccatttgatcaatcattttttgaagaactttttgtgaagtcaagagaaaaaagaactttctttttttcagatgattctactaccgcttttcgtatattcaatggagaaggagacggaatcggcggtctgattattgattattatgcaggttatgctgttttttcttggtataacgagacgttatatacacatcgtgaattattgattcaagcttttcgtgaaatctatccggaaatcatcggtggatatgagaaaattcgttttgaatcagtgaatctgcctgagagccagttcatttacggaaaagaggcaccggagcccttgatcgtaaaagaaaacggaataaaatttgccgtttatttaaatgaaggattaatgactggtatctttctagaccaaaaagaagtacggggatcattggcagaaggtttcgcttctgggaaaacagttttgaacatgtttagttataccggcgccttttctgttgctgccgcaatgggaggggcaatcgaaacgacaagtgtcgatctagcaaaacgcagtttgaaaaaaacacaagaacagtttgaagtgaatggcctggatgtcgatcagcaaaaaatcattgttatggacgtattcgagtatttcaaatacgcaaaaagaaaacaatttttatatgacatgattgtgttggatccaccaagttttgccagaaacaagaaaaaagtctttcgcgtagcaaaagattatggggaactggtcaaggatagtctggatattttagcagaaaatgggatacttattgcgtctacaaatgctgcaaatgtctcgatcgaacaattccaaacaatgatcgaagaggaattccatgccaagaatgtttcttttgaacaacttgctttatatcgtttgccaaaagatttccagacgacggatacctttttagaaggtaattatctgaaagtgtttgtttatcaaattaaaaataaccattag

SEQ ID NO: 644 - DNA (genomic), 1950 bp, Enterococcus faecium; double-stranded, circular
  misc_feature (B) LOCATION 1...1950
  hypothetical: NO
  anti-sense: NO
agtattgaagcagtccaaaaagcaaactcaggacatcctggattgccgatgggcgcagcacctatggcatatgcgttatggacaaaacacctgaaagtaaatccaacgacatcaaaaaactgggctgaccgcgaccgtttcgttctttcggcaggacatgggtcagcaatgttgtatagcttgcttcatttagctggctatcaagtgacaatcgatgatttgaaacaattccgtcaatgggattctaaaacaccaggacatcctgaagtacatcatacagatggtgtacaagccactacagggccattaggacaagggattgcaatggctgtcggtatggcaatggcagaagcgcaccttgcagcaacgtataacaaagaaaactttaatgtgatggatcactatacgtatgcaatatgcggtgacggagacttgatggaaggggtatctcaagaagcaagttcgatggcaggtcatatgaaactagggaaattgatcgttttatacgattcaaacgatatttcactagacggtccaacttcaaaagctttcacagaaaacgttggtgctcgctatgaagcatatggctggcaacatatcttagtgaaagacggaaatgacctagaagcaatctctaaagcgattgaagaagcaaaagctgaaacagacaaaccaacattgatcgaagtaaaaacagtcatcggctatggtgctcctaaagaaggaacatctgctgttcatggtgctcctcttggtgaagatggcatcaagatggctaaagaagtttatggttgggagtatccagatttcactgttccagaagaagtagctgcccgcttccatcaaacgatgatagaagaaggacaaaaagctgaagatgcatggaatgaaatgtttgccaattataaaaaagcttatcctgaattagcacaacaatttgaagatgcttttgatggcaaactaccagaaaactgggatgcagaattgccaacttatgaagttggaagcagtcaagcaagccgtgtttcaagtaaagaagtcatccaagaattatcgaaagctataccaagcttctggggtggttcagcggacttgtcaggttccaataatacaatggtggctgcagataaagatttcactcctgaacattatgaaggacgcaacatctggttcggtgtccgcgaatttgcaatggcttcggctatgaatggtatccaacttcatggcggaactcgtatctacggtggaacattctttgtctttgtcgattatctaagaccagcagttcgtttagcagcaatccaacatactcctgttgtttacgtcttaacacatgactcggttgctgtcggagaagacggaccaacgcacgaaccgattgaacaactagcatctgttcgctgcatgcctggtgttcaagtgattcgtccggcagacggaaatgaaacacgtgctgcttggaaagtagcgatggagacaacagatgcgcctactatccttgtattgagtcgtcaaaaccttccagtattgccttctacaaaagaagtagcagatgaaatggtgaaaaaaggcgcgtatgttctttctccatcacaaggagaaacaccagaaggtattttgattgcaacaggttctgaagttgatttggctgtgaaagctcaaaaagaattggctgaaaaaggcaaagatgtttctgttgtttctatgccaagctttgacctctttgaaaaacaatcttctgaatataaagaaagtgtacttcctaaatcagtgaagaaacgtgtggctatcgaagctgctgcatcatttggatgggaacgctacgtaggaacagagggcgcaacgattacaatcgatcatttcggtgcatctgcccctggcactaaaattttagaagaatttggatttacagtagaaaatgtcgtgaatacgtacaatcaactatcatag

SEQ ID NO: 645 - DNA (genomic), 243 bp, Enterococcus faecium; double-stranded, circular
  misc_feature (B) LOCATION 1...243
  hypothetical: NO
  anti-sense: NO
ttctccgaagcatctgctgttgcaacgaaagacgttatgtttgggtgctgtgacaaaagtcatgtcacagctccttttttccgaataaacattgttctcctgccaactcctcggtcacaagtcacaatatccaataaatataagaagctgttttttgaacttgttccttgtgactcggagttaaacggcaggctcacgacctctttcttaaacggtgttcaatcagctgttcctcggtattag

SEQ ID NO: 646 - DNA (genomic), 720 bp, Enterococcus faecium; double-stranded, circular
  misc_feature (B) LOCATION 1...720
  hypothetical: NO
  anti-sense: NO
ccccgcgaagcacaaacttctacaggtcttggtgatggaatcgccatgcctcacgcgaaaaacagtgcagttaaagaagcaacagttttattcgcaaaaagccaaaaaggagtagattatgaagccttagacggacagccaacttatctgtttttcatgatcgcagctccagaaggcgcaaacgacacacatttgcaagcattagcagcactatctcgattgctgattgatgcagatttcgtaggaaaattaaaagaagcaaatacaccagaagaagtccaagacttgttccaaacagctgaagagcaaaaagaagcagaagaaaaagcagaacaagaaacacaagctgcagaagcttctgctcatccagaaagaaaattcgttgttgccgttacagcttgtccaacagggatcgctcacacttacatggcagaagatgctttgaagaaaaaagcgaaagaaatgggtgtggagatcaaagtcgaaacgaacggttcagaaggaatcaaaaaccgattgactgctgaagacatcgcccgtgcagaaggtgtaatcgttgcagcagacaaaaaagtagagatgaatcgctttgacggaaaagaactgatcaatcgtcctgtcagtgatggtatccgtaaaccagaagagttgatcaatctagcccctagtggtactgcaccagtattccatggtgatggaaaagacagcagttcagaataa

SEQ ID NO: 647 - DNA (genomic), 657 bp, Enterococcus faecium; double-stranded, circular
  misc_feature (B) LOCATION 1...657
  hypothetical: NO
  anti-sense: NO
aagaaagaagcaaaggaatggaacaaaaggaacatgaaaaattatatatgggactttgatggtacattgtttgatacgtatcccgcaatggtagatggtgcatggcaagcactaaaagattttggtatcagtatggacaaaaaagaaatctacttcaaaatgaaaaagtattctactagttatttgatcaatgaatcaaacttgaatgccagagagtttaatgaattatttcaccgatatgaaaaagaaagtacggaagtttcccgtccatttccagaaacgaaacaagtactggaaatgctaaaagacaacggcggtcgtcatttcatcctgacccaccgtttgacagaatcaacatggggcctgttaaaagaacatcgattggcacatctgattgaggaagtagtagggatcgatcaggactttcctcgtaaacctgatccagcatctttaaattatttgatcgatacttttcatttagaaagaacagacacgatgatgatcggcgatcgtcgtttagatatcgaagcagggaaaaatgcaggagtcgctacttgtctttacgacatcgatcattttctgggtgagatcccggcagattatgtggtaggaaatctgaatgaaatccttaccttgcagagcatcattaaaaagtag

SEQ ID NO: 648 - DNA (genomic), 534 bp, Enterococcus faecium; double-stranded, circular
  misc_feature (B) LOCATION 1...534
  hypothetical: NO
  anti-sense: NO
aaggaagaagccgtgaataaatacgaaattcgaaaaatgacgccttcagatgtagacttactacaacaaattagtatcgaaacatttacagatacatttggaaaagataattcaccggagcatttagctgattacttgacacaagcttatgcactagaaaaacttacagaagagctaaaagataaagaaaccgattttttcctagtgagtatcgatcaagagcctgcgggttacctgaaactaaatacaggaacgagtcaatctgaggaaatggctgatcattttttagaaatcgagcgaatctatgtacgaaaaaaatttaaacatcaaggtatcggtacatttttactagatacagctattgaaaaagcaaaagaaaagcaaaaaacagccatttggctcggtgtttgggaacacaacgatgttgcgctcgctttttatcgtaaaaaaggatttatcaaatacagcgaacatgttttttatatgggagatgatccccaaacagactatctattcatcaagcaattattctaa

SEQ ID NO: 649 - DNA (genomic), 204 bp, Enterococcus faecium; double-stranded, circular
  misc_feature (B) LOCATION 1...204
  hypothetical: NO
  anti-sense: NO
tataaggaagcatcgattcctaataatcgggttaactcagataagaaggttattcgtttattcagagaatcaacgatcgttatctgcagttctggaaaggcaatttttaaaggtatgctaggaaaccctgcccccgaaccaacatcgcataaagataaaggttgcgtaaagtctacttcaaatgctaatgtaagtgaatcgtaa

SEQ ID NO: 650 - DNA (genomic), 1920 bp, Enterococcus faecium; double-stranded, circular
  misc_feature (B) LOCATION 1...1920
  hypothetical: NO
  anti-sense: NO
tgcgattttttaccggttattctcctgaaatatcttctgttaaacccaaaagatatcaatagagcagggggtgaaaaaatggctcaacggattcctcaagaggttatcgaaacagtacgcagtcaaacgaatatcgttgaggtgattggacaatatgtccagttgaaaaagtctggtaaaaattacttggggctgtgtccttttcatgaagaacgtacaccgtctttttctgttgcagaagacaagcagatttttcattgctttggttgtggtaaaggcggaaacgtgtttacttttcttcaagaactagaaggtctaagttttccagaagcagtggtaaaagtggcagacttcgaacagataccgttagaagatcaatggcgtcagcgtactatagctgtccaaaatcctgaatctgctacggggaaactgattgctgctcatgaaaaagcagcggaaatctatcatcacatgctattgcatacaaaagctggacagccagctttagaatatttgcaaagtcgtgggttgtctttagaattaattgaagaattcaacataggttttgcacctaatgagcgttcttttcttcagcaagtattcaagaatgaatcaatttcaaatgaattgttagaacgctctggattgtttgtcacgcatgatgatggccgtatgtctgatcgtttttatcaaagagtgatgtttccacttcgtaattctcaaggccagacgatcggtttttcaggacgctggcttgcacctgaaaaagggcaggaaaaagatcagcccaaatacttgaatagtccagaaacagaactgttcaataaaagacaagttttatttaatcttgataaagcaagaagcgatatccggaaaaacggagaaattttgttgttcgaagggtttatggatgtgattgctgcatggcaggctggtatcaaaactggattagcttctatggggacaagtctaacagctcaacagatccaacaaatggaaaagctgacgaaagaattggtcttttgctatgacggagacaacgcaggttttgaagcaaccaatcgagggattgaattgcttcggcaaaacagtcgattagcactttctgtcgtagtcgttccagaaaagcttgatcctgatgaatatctccgtaagtatggagaagcatctttccaagaattagtggctcatgggcgcgaaacagtctttacttttaaatcacgttatttaaaacaagggaaaaatttagataatgaaaaagacaagatcgaatacctcgaagaattactagttgaacttagccgagttgtttcaccaatcgaacaagatatgtatctatctcaactgtcaacagagtttcagatcggcagagagacgatacaaaaacaactgcgcgatcttcgaaggacaaatcagcaaaatcgtcaagaacctcaggaaagtcaacacactcaggttacgagacaagaaactgcacggaaaaagagacctttgacgcaagtagaaaaggcagagcagattctattatatcgtgcatttaaagaagtttctgtccgtaatattttaaaagaacgagaatttcagtttattcatgatgcatatgcagaagtttattttttattcgatgcatatgtctcacaacattatgaattcaaccttgcagagtttttagactttttgcaagatgaaaatttaaggcggttggtggtggaaatcgaatatttaccggtggcagaagaaagttcgccacgagaaatccaagacttgctagatgtgatcagcaaatctggcttagctgatgaaataacattaaaaaaacaaatgcagcaagaagccagacgaactggaaacaaacagcttgagcttgaattgacgattgaaatcatcaatttaacgaaacagttaaaacaagccaaatag

SEQ ID NO: 651 - DNA (genomic), 363 bp, Enterococcus faecium; double-stranded, circular
  misc_feature (B) LOCATION 1...363
  hypothetical: NO
  anti-sense: NO
aatcacagagccttacattggaaaatggctagcaaagaaaaagaagaaagagtgaatgagttgacggagatcaatattaaattagatgtattcgagggtcctctcgatctgctgcttcatctgattcagcaaatggaaatcgatatatatgatataccgatcgctacgatcacggagcaatatatgaattatatccatacaatgaaaacactcgagctagctgttgcaggagaatacttagtgatggctgctacattgatggcaatcaaaagcaagacattgcttcctgtccaagaattcgtcacagacgatgaagattatgggaagaagatcctcgagaagaattggtcactcagcttttag

SEQ ID NO: 652 - DNA (genomic), 231 bp, Enterococcus faecium; double-stranded, circular
  misc_feature (B) LOCATION 1...231
  hypothetical: NO
  anti-sense: NO
ggcaaaagagcagatcgaagacttgacctttacactgcaagaaatgaaaggaacttcattatgacaaatgattggctgatccaacaattagatgaattaagcgaaaaatcagaatatcaagaccgtgcgctcttatatgaaataaagaaactgatggctgagatagacgaacgaacaatgcagctgcaaggagaaatcgacggacaatcttggaatcatctcaactggtga

SEQ ID NO: 653 - DNA (genomic), 327 bp, Enterococcus faecium; double-stranded, circular
  misc_feature (B) LOCATION 1...327
  hypothetical: NO
  anti-sense: NO
cagaagagagcagaagcatttatcttcgaaaaacgtctgcctcgttcaggcgcagtttttcaaaaactttctgatttgaatatcgatcctgcttcattaatccaaaccggaaagcttacaacaaaacgagctgaattccctattgaagaaggacttttagctattgatgaaagctggggagacaatctacacgattttgaactggaactagaggtaggggatgcatctgtgggaaaaattgcttttataaattttttaaaacgtttttctttaccttatcgtcctgctaagaacaagatccaacgtatgcttgaagctaaaaattag

SEQ ID NO: 654 - DNA (genomic), 1386 bp, Enterococcus faecium; double-stranded, circular
  misc_feature (B) LOCATION 1...1386
  hypothetical: NO
  anti-sense: NO
agacaaggagcgatacgtatgaatgaagtgtggcaggatcgaatcccaccgcaaaatattgaagctgaacaagcggttttaggctctgtttttcttgacgcagaaacgatcattgatgccatggagtacatagagccaaaagacttttatcgtcgtggccatcaaattatttttgagacaatgatcgagttaaatgatcgtaatgaagcgattgacgtggttactgtcaaagaccggctggaacaagccaatttgttagaagatgccggtggtttaagttatctctcagacttggcattagcagttccgacagcagcaaatatcgtctactatgcgaaaatcgttgaagaaaaatcattgctgcgtacattgatccagacagcaacaggaatcgttacgaaaggattcgagcaaggagaagaagttcaaacaattttagatgatgccgaacgcagtatcttggaggtttcggaaaaaagaaatcgaagcggctttttatctattgctgaagtactgaactccacgattgaaaatatcgatcgactagctcaaaacaatgaagaaatcacaggtctaccaactggctatcaaggtctggataaaatgacagcaggtttccagcccgaagaactaatcattcttgctgcacgtccagcggtaggtaaaacagcgtttgcattgaatattgctcaaaatgtaggaacaaaaacagatcgttctgttgcgatatttagtttggaaatgggggcagaatctcttgtaaatcggatgctttgtgcagaaggttcgattgaggccagccatttacgtacaggtcagctttcggaagaagaatggtcgaatctgatcgttgcgatggggagtctttctcgagcaaatatttttatcgatgatacaccagggatcaaaatctctgaaatccgtgcgaaatgtcggaaactagcgcaagaaaaaggcaatctaggcttgatattgatcgattatttgcagttgattgaaggtaacggtaaagagaaccgtcaacaagaagtatcagatatctctcgccaactgaaaaaactggcgaaagagctgaaagtacctgtcattgctctttcacagttatctcgtggagtagaacagcgacaagacaaacgaccagtgctaagtgatattcgtgaatccggatcaattgaacaagatgcggacatcgtagccttcttgtatcgagatgattattatgaaagagaaggcggagatgacgatgatggaaacgagccaaaaaatgacaacgtcatcgaagtcatcatcgagaagaaccgaagcggtgcacgaggaacagttgaactactgtttatcaaagaatacaataagttttcgtcgctttcgccaagagaagaattttaa

SEQ ID NO: 655 - DNA (genomic), 273 bp, Enterococcus faecium; double-stranded, circular
  misc_feature (B) LOCATION 1...273
  hypothetical: NO
  anti-sense: NO
agaaaaggagcgagtatgatgtatttcgtaaaagtatatgtaacctataaagattcagtgttagatcctcaaggggaggcagtaaaaaaagcagtccatcgtatgggatatgaaacaatcgaagatatccgaataggaaaatactttgagatacaacttgctgatgcagaagaaccaatcgatacagtgattgaaacgatttgtgacaagctgcttgcaaatgtaaatatggaaacataccgatatgaaatcaaaaaaatggaggaagtataa

SEQ ID NO: 656 - DNA (genomic), 519 bp, Enterococcus faecium; double-stranded, circular
  misc_feature (B) LOCATION 1...519
  hypothetical: NO
  anti-sense: NO
atgcggtatttagtagtaagtgataatcatggagacagagatatcctcgttgacttagtagatcgttatcgttctgaagtggatatctttttccattgtggtgattcggaattagaagcttctgacccattatgggatacattccaagtggttcaaggtaattgtgattatggaccaggattcgaacagaaaaaagtgatccaaactggtcaggatacagtattcatgactcacggtcatttatcgaatgtccgatttggtttgacacagttagcaatcgaagctcgagctgcaactgccgatatggtgttttttggtcatacccatcaaataggctgtgagatggatcagaaaatcctgtttttgaatcctggtagcatttctcagcctagaggcccgatccaaatcccatcatatgctcttatcgaaagtttagatgaccaaatttctgttcaatactataaccgtgcccatcaggcagttgaagagttggccttttctttttcgagagagcgctga

SEQ ID NO: 657 - DNA (genomic), 492 bp, Enterococcus faecium; double-stranded, circular
  misc_feature (B) LOCATION 1...492
  hypothetical: NO
  anti-sense: NO
tattttttggcaaagaaaaaaatagtaaaaacgaatgcgatccgtatggtcgaacaaaaaaagattccctatacagaacacgaatatgaatgggacgaaaaccacctaagtgcgtcctctgtcgcagaacagctcccagagagccaatctcgtatatttaaaacactggttgctgtgggcaatgtgacggggcctcttgttgctgtgataccaggagaagccgaattgaatctaaaaaaattagcaaaagtttcagggaataaaaaagtagaaatgcttcatttgaaagatttggaagcaacgaccggatacatacgtggtggctgctcgcctataggaatgaaaaaactgtttcctacttatttagatcaaatcgcagaaaactatgatcaaatcattgtatcagctggcagaagagggctacagatggaattagctcctcaagatatctgtgcattaacgagcggacaatttgcagatataaaacaataa

SEQ ID NO: 658 - DNA (genomic), 1128 bp, Enterococcus faecium; double-stranded, circular
  misc_feature (B) LOCATION 1...1128
  hypothetical: NO
  anti-sense: NO
attatcttggcaatgagaatcctaataatcaatctaatgaaggaggttccgagtatgaatgaacacgatgaagcagaatggacaaaaaatgaagaacaaacagaagatcatgaagaaacgaacacttcattggaagaacaaacaagtaatcctctggatgacacagaagaaatccctatgctagaggaaacaaaaatacatgaaaaagaaaaagtaactccgacgaatacgaatactgcagaaaacacccatgcttacgaaataactgaaaatcccgggtatttagaaggaaaagagcaagatcatcaagatatcgtcagtttgattgaaacagcggaagcagaattagcggatttacgtatgagaaaagatttgatcgaatcagattttccacaattattagaatcatatgatcgttttatattgaatgaagaaccaatctccacgatcggaaagacaagcctgatcgaatacttcacgtatgaattactgaaaccgttgaatgatattggtctggaacggtcaaattcagcttatgacacatggaaaacaagacatttttcgatcaattatacgttgaatggacaaaacgaattagtcttttcctttgtattaccgaccatcgatcaacgataccaagtggaatcgatgagtctcctaaacgtatcaccagagacaatggaaatcaatgtccaagatgaccgggtgctttctttgatccgacactggtcagtggatcgagtattctctgcagggcagatcacgatattcaatcacaaattgaatcaattattagcccatgcaagaacacttggttttaccgttaatcagacattactagacaatacgaagccacttcgtttgaatcttcagagcgaatttgaattgacgaatgaagtattggatgatatttttatcgtggcaatgaaaaatccatcctacgatatggaaaagatcaacgaaactacttatcaagtacgattagataaaggacagtctttaacgataacaacaaacgaaaaagatcaaacagtcttgtcgatctcatctggagactacccacgatctgtcattgatttctttatcaattacgaattcttggtcccattaatggtgagaaagtcctga

SEQ ID NO: 659 - DNA (genomic), 858 bp, Enterococcus faecium; double-stranded, circular
  misc_feature (B) LOCATION 1...858
  hypothetical: NO
  anti-sense: NO
aaaatattggctgacaacaaacgatactactatttaaaactaaaagagaacttcttcgatagcgacgagatggttcttttagaaagtatgccagatggatacatttattctaatattcttctcaaactttatttaagaagtctgaaacatgaaggcaaactaatgtttaatgacaggattccattcaattctacaatgcttgcgactattacaagacactctgtgggagttgtagaaaaagcagtacaaatatttcgtgatttacaacttattgaggtattagataacggagcaatttatatgtctgatatacaaagttttattgggaaatcttcaactgaagctgataggaagagaaaatacagaaaagaaattgaggaagcaaaacagaatttaataacaagtggacaaatgtcggacaaatgtccggacaaaactacaccagagttagagatagagttagagaaagatatagagttagagaaagatatagagaatgtaacgcctccgaaaaaatcgaaggctaagcccatccgtcataaatacggagagtataaaaatgttcttttgtcagatgagcagatggagaaactcaaaacagaattccctaatgactaccaagagcgaatagaacggctatctgagtattgtgaatcatcaggtaagacttataaaaactatttggcaactattcgaagttgggcaaggaaagaaaaaagtgagcctaagaatgcaagtggtgcatacaaacgcacaggacgacgagagaagcttccagaatgggcaatcgaccaagaagcctatcaaaagaaaaaagcgctagaacgagctaatagacaatcaaaagcaccattctaa

SEQ ID NO: 660 - DNA (genomic), 390 bp, Enterococcus faecium; double-stranded, circular
  misc_feature (B) LOCATION 1...390
  hypothetical: NO
  anti-sense: NO
ccaacgttggctatatctcaacaaaaaaatcttatcttgatggttcttaaaattcctattatccttactaagaacggctttccgattacttactcaatcccgaatccatgtgttaatcaagttaaagtgtcacacactgtacggatgaaaccgatttcttcccatatcctatgggaacaaggatatttgttccttaaaatcatcaaaaacttgccccttaaagccattaccatttcccttccgccccctttaaaccttggtatgatttctaaaaactcagaccccatctggcctgggaaacaaaacaaaaaccattggaaaaggtttttccctcccctaaaaaaattaagtagttcaatattccaactcccttccgttttatggggttga

SEQ ID NO: 661 - DNA (genomic), 261 bp, Enterococcus faecium; double-stranded, circular
  misc_feature (B) LOCATION 1...261
  hypothetical: NO
  anti-sense: NO
ttcattctggccaacaaatcaataaagaaagaactaacgaaaggaagtaaaacctttcctaagaggaggcagaatcaatcatgcgaaagaaatttgattattggggtgttcccttcagcgaattattcccaaactaccatgcgccacatactatcgaatgcgactgtggagaaagagcgaaatgtatcaaaagctatcgtttgtaccaatgtcaaacatgcggaaaaaaatacaccttgtcttatggcgattatattttga

SEQ ID NO: 662 - DNA (genomic), 261 bp, Enterococcus faecium; double-stranded, circular
  misc_feature (B) LOCATION 1...261
  hypothetical: NO
  anti-sense: NO
ttcattctggccaacaaatcaataaagaaagaactaacgaaaggaagtaaaacctttcctaagaggaggcagaatcaatcatgcgaaaggaatttgattattggggtgttcccttcagcgaattattcccaaactatcatgcaccacatactgtcgaatgcgattgtggagaaagagcgaaatgtatcaaaagctattgtttgtatcaatgtccaacatgcgggaaaaaatataccttgtcttatggcgattatattttga

SEQ ID NO: 663 - DNA (genomic), 726 bp, Enterococcus faecium; double-stranded, circular
  misc_feature (B) LOCATION 1...726
  hypothetical: NO
  anti-sense: NO
aggaggctggctatgatgtcttgtgaagaaaaaattgcagcaatgaagcaacgtgtccttgaagcaaatctggcattgccgcgatacggattagtcaaattgacttggggcaatgtgagtgaagtggaccgtgagctaggagtcatcgtcattaagccaagcggtgtcagatatgaatgcatgcaagcagatcaaatggtggtaacagatttgtcgggaaatataatagaagaagatagcttaaaaccatcttcagatctccccacacatgttgttttgtatcaaacttttgaagatataactgctattactcatactcattccacgcactccgtcatgtgggcgcaagcaggacgcgatttgccagcttatggcacgactcatgctgatgctttttatggtaaggttccttgtacacgccaattaacgaaagaagaagtaagagaagcttacgaagttcatacagggaatgtgattgtcgagacgtttaaggaaagaaaattagatccaaacgaagtccctggagtacttgtctatggacatggaccgttcacatggggggattcacctatgaaagcagtagaaaacagtttgatcttagatgaaatttgtctgatggccaaagaaaacgagctgatcaaccccaatatatgtgaaatcccgcaatatttactagataaacattattttcgcaaacatggaaagtatgcatactacgggcaatag

SEQ ID NO: 664 - DNA (genomic), 1134 bp, Enterococcus faecium; double-stranded, circular
  misc_feature (B) LOCATION 1...1134
  hypothetical: NO
  anti-sense: NO
tatgggctggcgaggtggaatcgaatgacagaagaattacaatgtatcggctgtggtgccgttatacaaacaaacaaacccggtgaattaggatacacgccgcaaacggctttggaaaaaggtttagcttccggggaagtctattgtcagcgttgtttcagattacgccattataatgagatccaagatgtctcattgacggatgacgactttttgcgcttactgaatgaattagggcaaaaagatgcattgatcgtcaatgtggtggatatttttgacttcaatggttcactaatcccaggactacaccgttttgtcggtgacaatccagtacttttagttgggaacaaagtggatatattacctaaatcattgaaaaaaactaaattaacacaatggatgaaggaacgtgcttacgaagcaggaattcgtccagtagatgtattattaactagtgctaagaaatctcatgagatgacggaactattagaaaaaatcgaagaataccgcgatggacgggatgtctatatcgtcggagtaacaaatgtcggaaaatcgacgcttatcaatcaaatcatcaaaaatacagcgggagtacaagatgtaatcacaacttcgcagtttccaggaacgaccttggataaaatcgagattcctttagatgacgggcattttttgattgatacaccgggaattatccatcgccatcaaatggcgcactacttaggtaaaaaagatttgcggatcattgcaccgttaaaagaaatcaaacctaaagtttatcagctgaatgaagggcaaacacttttcttgggcggacttgcaagatttgattttatcagcggcaatcgtgcttcatttattgcttatgtgtcaaatgatgtaaatattcatcgaacgaaactggaaaaagcagacgaattttatcaaaaacatgtaggtggattattacagcctcctcgtcctgatgaagtcgaggcatttccggagcttgttcgttttgagttttctgtgaaagaaaaaacagacatcgtttttgccggtctaggctggatcactgtaacagcgccagtagtaattgcgggctgggcgccaaagggtgtagatgtattgaaacgcaaagcattgatttaa

SEQ ID NO: 665 - DNA (genomic), 357 bp, Enterococcus faecium; double-stranded, circular
  misc_feature (B) LOCATION 1...357
  hypothetical: NO
  anti-sense: NO
ctgattatggcgcaaaatcgtatttttacgacaagttttgcaagcgtttatcctatgtatgtagcaaaagcggagagaaaagatcgtataaaagaggaagtagatgaaatcatttgttggctgacgggttattcccaaacagaactagaatatcaactacaaaaacaagtgactttcgaacaattttttgcggaagcccctgtccccaatccttcacgttccttgattacaggtgttgtttgtggtgtacgagtagaagacatcgaggataacttgatgaaagaaattcgttatttagataaaatgatcgatgagctagcaaaaggcaaaaaaatggaaaagatcctcagaagttga

SEQ ID NO: 666 - DNA (genomic), 276 bp, Enterococcus faecium; double-stranded, circular
  misc_feature (B) LOCATION 1...276
  hypothetical: NO
  anti-sense: NO
aggtatatggcaaaaaagtcgaaaattgctaaagcaaagaaacaaatggcgatgattgaaaagtatgcagataaacgtcaggaattaaaagccgcaggagatcgcaccgctctcgctaaattgccaagagattcaaatccgaatcgtctgaggcttcgtgatcagacggatggtcgtccaagagggtatatgcgaaagttcggtatgtcccgtattaagtttagagaacttgcccatcaagggttgattcctggagtaaaaaaagcaagttggtaa

SEQ ID NO: 667 - DNA (genomic), 228 bp, Enterococcus faecium; double-stranded, circular
  misc_feature (B) LOCATION 1...228
  hypothetical: NO
  anti-sense: NO
gtgaatatggcagtaaagatttcaggagtcctgtcagacggcacaggaaaaccggtacagaactgcaccattcagctgaaagccagacgtaacagcaccacggtggtggtgaacacggtgggctcagagaatccggatgaagcctgcttttttatactaagttggcattataacaaagcattgcttatcaatttgttgccacgcacaggtcactatcagtcaaaataa

SEQ ID NO: 668 - DNA (genomic), 936 bp, Enterococcus faecium; double-stranded, circular
  misc_feature (B) LOCATION 1...936
  hypothetical: NO
  anti-sense: NO
gaatgtatggcatcgatccgtgatgtggctaagatggctggtgtttcagtgggaacagtttcccgttacttgaatggtcagcaactgaaggaaaagaacatgaaaaaaatagcagaagcgatttcagcgttggactataaagaaaacatcattgctaaagggttgaagaataatcgaagcttctctattggacttttgataaacgggatttccagccgttttgggtcggaagttgtctcagggatcgaaagagtagctgaagaaaatgggtatagcttattattaagcgggtttgccgatcagccagaaaaaattgaacaaaaaattgaatacctgatgaagcatgtgatcgatgggctgattgtcttcttatccgaagaagagtggtctggatttgaaatgctcacaaaaatgagtattccagttatcgcattgaattgtccagaaggaccagcaggtattgatacaatattagtgaatgatcgagaaagtgtagcaaaagtgatcgctcatcatggtgaacaaggacataaaaaaatcggatttattgctgccactcaaacagactacgtagcaagagaacgtttagcaggagccaaagaagcggtccaaaatgatccatcgatccaattagaggtctttacaggagactattctagaaaaagcggctattacggggcaaaagcattattagaaaaaggggcaactgctatttttgtcagcaattacaatatgtcgattggtgccatcgaatgtttcaatcaagaaggtgtcagaatcgggaaggatattgcgttcagtcactatgattatttagataaaaacgatctgagtatccttccgaaaatcacgatcacgccaccaacagataaaatcggggaacgagcagcagaacagctgttaatacgaatccaaaaaagaagaggaagaaaatga

SEQ ID NO: 669 - DNA (genomic), 396 bp, Enterococcus faecium; double-stranded, circular
  misc_feature (B) LOCATION 1...396
  hypothetical: NO
  anti-sense: NO
aacttcatggcagcaaaaaaagtgaatcgtaaacgccgtgtgaagaagaatatagaagcaggtattgcacatatccattctacattcaataacactatcatcatgatcactgatactcacggaaatgcattagcgtggtcatcagctggttcattaggtttcaaaggaagcaaaaaatcaactccttttgccgctcaaatggcagcagaaactgctacaaaagcagcaatggaacacggattaaagactgttgaagtaacagttaaaggacctggttctggacgtgaagcagcaattcgttcattacaagctacaggtttagaagtgactgcaattcgtgacgtgactccagttcctcataatggtgcccgccctccaaaacgccgtcgtgtttaa

SEQ ID NO: 670 - DNA (genomic), 420 bp, Enterococcus faecium; double-stranded, circular
  misc_feature (B) LOCATION 1...420
  hypothetical: NO
  anti-sense: NO
tcaaaaatggcaaatgtacctagcattcgcgacatgttccctgatttcaatgacgtgtttagtccagcattcaatgattttttaggtgtttcaagttatccaaaagtagatttagtcgaaaatgaaaaagaatacaaactaactgctgatatgcctggctgtgacaaagaagacacgacagttgaatattcagataatactttgacgatctccgccaatcatgagtcccatacagaagataaagaagatggcaactatgtacggaaagaaagacattcggtctcttacaaacgttcattctatcttcctaatgttgatgaagaaaaaatcactggaacctttaaaaacggtgtgctgaaattggtattacctaaaacagcttatcagccaaaagaaacaaaaaaaattgagttaaattag

SEQ ID NO: 671 - DNA (genomic), 312 bp, Enterococcus faecium; double-stranded, circular
  misc_feature (B) LOCATION 1...312
  hypothetical: NO
  anti-sense: NO
gttctgatggcacgattgaatgtgaatccgacccgcatggaattgactcgattgaaaaaacagttgacaactgccacaagagggcataaattattaaaagataagcaagatgaactgatgcgtcaattcatcctgttgattcgaaagaacaaccagctgcgtcaagaaatggaagagtctatgacagaagcaatgtctgattttgtattggcaaatgcttcgatcacggaacctttcatcgaagaattatttgttttgccggcggaaaacgttgatttgtgctatagggacaggatccgtattcaacctcat

SEQ ID NO: 672 - DNA (genomic), 843 bp, Enterococcus faecium; double-stranded, circular
  misc_feature (B) LOCATION 1...843
  hypothetical: NO
  anti-sense: NO
ctggcgatggctgatacttgttggagtcattcttattggcttatttgctggattatttattttaaaagaaagaaggaaaaagaaatgaaaaaaacaattgcattaagtaccgttctagctggaagtctattattatgtacacaaagtgtttttgctgagaataagagctcagccactacagaaggaacgatttctgtgaccaaaccagatgctgcaaatcctgaagacgttgttccagttcctcctgttgatccaaatgatcctgatactccttttacacctgacgaaccaaatcagggaacatccggattactgacgattgaccaagctccagatcttgattttggaacaatcaagttaggtacagcaaaaacagtatatgctgcattacaaagcggaacggacagtactggagcacaaacacaagtacagaatttcgtacaagtaacggataaaagcggaaattatgccggttggaaattatcagtcaaacgaacagaatttattggtacaacatctgatacgaataaactaactggttcaaaggtgaaattcaaaaacgccgtgattcgaaatagcgcaactaatagcagtggaatgccatctaccgtttctggaactggcgctgaaggaatcgaaatcccagcagatcaggcagtagatctagtaactgcaggagcaaatgaagggattggcacatggatttattcattaggagagaatgtggaacaagggagacaatcagtggaattatttgttcctgtatccaattatgctgtagacaactacgtttcaacattcacatggtcgttaacagatgctcctacagaagaggaagcgtaa

SEQ ID NO: 673 - DNA (genomic), 744 bp, Enterococcus faecium; double-stranded, circular
  misc_feature (B) LOCATION 1...744
  hypothetical: NO
  anti-sense: NO
agtaagatggcagaaaaaatcttagttgagcatttagtcaaaaaatacggcgataacacagtattaaacgacatcaatgtatccatcaacgaaggagatgtcgtctgtatcattggcccttcaggttcaggaaaaagtacattcttgcgttgcttgaatcgtttagaagaaccttctgacggtgaaattattattgacggcgcccacttgatggataaaagcacagatatcaacttggtgagacaacatatcggaatggtattccaacactttaacctattccctcatctttctattttggaaaacatcattttagcaccgatggacctgaagaaagaatctagagaagaagcagagaaaaaagcaatcaaattactgcagacagttggtctagaagataaaaaagatatgtatcctgaaatgctttctggtggacaaaaacagcgtgtggctattgctcgtgctctagcgatgaaccctgacatcatgctttttgatgagcctacttctgcactcgatcctgaaatggtcggtgatgtcttgaacgtcatgaaaaagttagcagaacaaggtatgacgatggttatcgttacgcacgaaatggggttcgctaaagaagtggccaatcgcgtcatgttcattgacgacggaaactttttagaagatggaacgcctcaacaaatctttgaaaatccgcaaaatgaacggacaaaagatttcttgaataaagtattaaatatttaa

SEQ ID NO: 674 - DNA (genomic), 495 bp, Enterococcus faecium; double-stranded, circular
  misc_feature (B) LOCATION 1...495
  hypothetical: NO
  anti-sense: NO
gggggtgtggcacgattttcagaaggaatctatgaaccaatcactgtattgattttagcttcgatggtaaccccattcggcttgacgatcgcttatttcttagggaaaatcattcgtaaaaatatactcaatcgtcaagaaatcgatacattgaagaccgcttttcctatggggatctgtcagatcacagaaggatgtttccctatcgtattgaacgacttggcacgcaatgtcatagcaacgggagtcggtgggacagtaggtggcggattaagcatgttttggggcgcagatagccgtattccggcatccggaatgtttgcagtcgctacgatgaccagaccatgggcattcattggtgcattgttaactggttcttttgtcacaagaataaccattttattattgaaaaaaccagtagatccgaatgcagaaatcatccacgaagaaaaagaggaagaagacatatcttgggatgatttgacaattagttag

SEQ ID NO: 675 - DNA (genomic), 849 bp, Enterococcus faecium; double-stranded, circular
  misc_feature (B) LOCATION 1...849
  hypothetical: NO
  anti-sense: NO
gtgggggtggcgttttttctgatgaaaccagaaatattagtagtcgttgtgctttatcagcaactattcagtcaatctccagcttatggaccattaagcaaagcacttagcgaaaagcaaattcagcttattatttacgataatagtcctcaaaggcagcaaaatgagctgtttgaaaaagaaaatatcgtttatcatcatgatccgcaaaatcctggtttagcggtggcttataattttgcgttgtctcaagcagatgaaggaacacgttgtctcgtcactctggatcaggatacgaggctagtcgacgattattttgaactattgcgtaaagtaacctttacagatgaatgtgttgctgcagttccgatgattttttctgggagccgacaagtttctcccctatattcagatcgttatatcaatcgtacagctcaagcagtagaagttgaaggcccaacagctgaacgaatcatggcaatcaattcaggtgttgcctggtctgtcaaatttctaaaaaagattggcgggtttaatcctgctttttctttagattttttggatcattggctgttttggaaagtggatcagttggaaaaaactgtggagatccttcctgtacgaatggaacatgatctttcggttttagactatgaaaaagtttcaagtaatcgataccgttctattttacaagcagaaaatcgattttatcatgaatatgatcaaaggcatttatccagtcaccgacgacaattattgttaagaacagctaaacagttcttgaccgtcaaaaaccggcatatctggcggatgactttgcgctcatatgttaagaattggaaggtgtga

SEQ ID NO: 676 - DNA (genomic), 408 bp, Enterococcus faecium; double-stranded, circular
  misc_feature (B) LOCATION 1...408
  hypothetical: NO
  anti-sense: NO
tttttttcggcaccagtaagaggtgccgtttttgatttattggatagtcccgacaaatttgtagtaggtggtaatgcgcttttccttacccttgcggcagcgccccatacccggcgtttcgtaaatcgtgatccggtcaatcagttcgtgcagcatgaagcggtcgagtttttcaaagctggtgtatttttggataagggcggcgaagcggtcaatatcagcctttgcatcccgaaccttttccagtgctttttccagttctgcaacttttgctttcagtgtttcccgttccgtatcatagtccgcgataaacatcgcaaagatatggtcgggcagtttgccgctcatgttgtcctcgtaggtgcgtttcagtttcacatccaggtcagccagccgtttttttgctga

SEQ ID NO: 677 - DNA (genomic), 393 bp, Enterococcus faecium; double-stranded, circular
  misc_feature (B) LOCATION 1...393
  hypothetical: NO
  anti-sense: NO
tcagtatcggcaaatgtagaagaagcgattttaagatctcctaatactggaaggataaataatggcagccaactaatcaataagctattgaaagcagaacctaataccgcccctcttctaccgccagtcgagttgccgaagacaccagaagcagctccgcagaagaaatgtcctactaccccaggaatgataactgtagtttgcaagcctatcatagcaaacatggatagtgttcctacaaagaagctaacaaaaaagccaattaatacagcattaggtgcatatggaaaaacgataggaacatctaatgctggtttagaatcgggtacgagttttttagcaatcccttggaatgctggaacgatttctgccaacaccattcgaaccccttga

SEQ ID NO: 678 - DNA (genomic), 219 bp, Enterococcus faecium; double-stranded, circular
  misc_feature (B) LOCATION 1...219
  hypothetical: NO
  anti-sense: NO
tgtacatcggcggaacatctgggtcgacggccgggcggattgaaaacaactacgttaggtgtgttgctgatccacatgcgttcgatgttgaaaggacgtacgagagcggaagcatttggccgtaccatccgacaaggcgcagtggttgcgggcacttactttattttttgttacgttgacgttgtgtgtagtcgccatcatgattttatcggtgactga

SEQ ID NO: 679 - DNA (genomic), 864 bp, Enterococcus faecium; double-stranded, circular
  misc_feature (B) LOCATION 1...864
  hypothetical: NO
  anti-sense: NO
tctggatcggcagaatctgcttttccagatttattttttaggagggagaatatgagccagcttgcagaatcgaaaggcttgattttatctagccgtaattacaaagaaaaagataaattagtcaaaatctttacggaatcttctggcaaaatgatgttttatatcaaaggaatccatcggcaaaatcagccattagctccggctttgctcccctttaccgaagcagtctatatcggtaattttcgaagtgaaggtttgtcgtttttaagcagtgtcaaagacgtccatgcgtttcggaacatccaagaagatatctttttgagcggttatggtacctatttgctaaatctagtagatgcagcaatcgaagatcatcaatatgacccgcatttattccaatttacgcaacaagctctgcagcggatggatcaaggagatgatgcagaaatcatcacgaatatctttgaagttcaaatactgcaacgcttcggaatcgcgccaatttggacgcactgtgtcgtatgcggggaaacaaaaggaaaatttgactattcttccaaatctggcggtgtgatatgcgagaaacactggccaatggacgaacaccgttatcatgcagatcctcgcgctgtttatttcgttcgaatgttttcggctatttcttatgataagatcagtggaatccacttgaaagaagaaacgaagcaggcaatccgtgacctcattgaccagttgtatgatgaatatgtcggtattcatctaaaaagcaaaaagttcattgatcaaatgaagtcttgggcacacgtattaaagacgccagagaaaaatatgcctgaaaaagagatacctgaaaaagaagaataa

SEQ ID NO: 680 - DNA (genomic), 252 bp, Enterococcus faecium; double-stranded, circular
  misc_feature (B) LOCATION 1...252
  hypothetical: NO
  anti-sense: NO
ctgagcaaggcgtttatgacaacacacctttcggctcgtgtcattaaggaatttgttattcaaggtggcgctttggatggttctggtgatgaagctgtttccagctatgagggctttttcgctgatgaagtgcatcgcggactttatcattttaatggcgccttggccttaggggaccacggcccccacaccaacggcaaccagttttttattgtgcaaaacacaaaggcgcaggctgacctgctaatgtaa

SEQ ID NO: 681 - DNA (genomic), 2784 bp, Enterococcus faecium; double-stranded, circular
  misc_feature (B) LOCATION 1...2784
  hypothetical: NO
  anti-sense: NO
aggagcaaggcgcaaataagcgcctttttatgctatgattatgaaaacgggaacaaaattggttgccagaggaggggttatgtgaaagaacgtcaagaagagatcttgcagctattgacagaaaaccaacaaggattgacagcaagtgatgtagctgagcgcttaactatcgatcgaagcaatgcaagccgatatttaagtgaactatacaaggcccatcatattgtaaaaaccgctggccgaccagtcgtttactctttgccaacggaaaagtcaaaatctgatgaagtgcatgtcgactcttctacgcaagtgacttttgaaacactcgttggagaaaatgattctttaaaagtcagcatacagcaggcaaaagctgcgattctttatccaccgcgggggttgcatacgattatttttggagaaactggtacagggaagtcgatgtttgctgaatgtatgtatcattttgcaatcgattcagagatgctttctgcagatgcgccatttgtttctttcaattgtgcggattatgctcaaaatccgcaactgctctttggacacatctttgggatcaaaaaaggggctaacacaggagcagctcaagatagtcccggtctaatagccaaagcagacggcggtatattgtttttagatgagatccaccgtttaccgccggaagggcaggaaatgctgtttactttcattgataaaggtatttaccgtccgcttggagaaagtgcacaagtacatgaagcatctgttcagatcattggggcgacgactgaatcttcagaaagtttcttatctacgttcaatcgacggattcctatggcaatcaccttgccgaatcttgcttcacgttcactggatgagcgttatgaaatcatctctctttttatcaaacaagaagcgaatcgtttgaatcaacgtatcgatatcgaaaaagaagcgattcttgccttcatgctttatgatgcggaaggaaatatcggtcaagtgaaacgagacttgaaactagtctgtgcaaaatcttttttacattaccgtactcatcatgagaaaaagctaatcattcgaaaagaagaactttcccttcaagtacaaaaaggattactgaaaatcaaggaaataccggaacgtctcgaccgattcatggacagcaaaagtcagtatttgacatttgaaccaggatttgctgatgttgtctggtcacaagatccagaacgaaacatgcaggtctataacgatattgaggaaaaagtcacttctctttccgaaaccggtgtggagaacattgatctagagaccctcatttcaaaagatgtggatgcttatttccagacatatgtcaaagaattgactaaaagttcgattcccaaagatcttttgccagatgaaatctggcggttaaccaatcaattgtatgatgtggctgaaaaacggttagaccgtatttataatgaaaaagctcgttttgcttttgctttgcatctgcaaagtacattggatcgtgtgagagaaggtcatatgatcgtccacccagatttgaataacgtacggaaaaattttaagagggaattccaggtagcaatcgatctttcaacgatcattgaagaagaagaacaagttgagattccttttgatgaaatcggctttattagtatgtttctttctatcaatctaggagaaagtgagcctgttaaagaaaacaaagtagatgttctcatattgatgcacggcagacagactgcttcaagcatgttggagatggcacaagaactattaggaacaaaagtagggaaagcttttaatatgccactggttatggaagttcaaacaatgtatgaagaagtgttacaatatgtcaaaaactatcaagagcatttgacgaatggcctactcttgttaacagatatgggatcattaaacaccttcagtgatttgatttatgaagagactggcattcggacgaaagctatcacgatgacaagtaccatgattgtgatagaagcgatacggatggcaagtgttggaagaagcttagaagatatttatcaaaatatccagctttcctttgaatcgatcgtacgtgatcagttcaaagcggaaaagtctgaaactttacagcgtaaaaaagccgtaatcgtgacatgctttactggtgaaggagtagctgccaaattatatcagcgtattatgccagtgattaatcaaaataaggtagaactgatccagatgcagtttttagaacgtgaatcattcaaaaaacacatcgatgccttattggaagaatatgagatcaaagcaattgcgggaacagttgatgttgattatcaaaatatcccatttttttcagcctatgacgtttttgatgatgaaaaactaaatattttaaagcgtatagctgatgatgagatcccgacagctaaaattgtcgattcacttgctggatcattaagcgatgtcttttctattgatgaactgatccgttcattgcaaaagacagttcagcagatccagaccgatttgtcgattatcgtggaacctggagtagatactggaatcgttatccatttagccttcatgttagacggattgatcaaacaagaaagccatcggcaatttgagaaactgtctattttctcaaaaatttatcgtttggaaatggatatcgttcgggcaaacttgatggcactagaacgaaaatatcaggtaaaaattccagaagatgatatcgcatttcttacacaaatgtttcttgaaaataaaataaaaaaatga

SEQ ID NO: 682 - DNA (genomic), 216 bp, Enterococcus faecium; double-stranded, circular
  misc_feature (B) LOCATION 1...216
  hypothetical: NO
  anti-sense: NO
gttctaaaggcaaaggagaatgattttatgtcctacacattgcaacaagaacatcaaattctcggtttgattaaacaacgcaggaaacaattacaagatgaccgtgcagcgcttagaaaagccgatgagctatcagatagacaagctgaactaattgcttctgaacttgaggatttgagaatgctagaaataaaaaatagggagattagattatga

SEQ ID NO: 683 - DNA (genomic), 192 bp, Enterococcus faecium; double-stranded, circular
  misc_feature (B) LOCATION 1...192
  hypothetical: NO
  anti-sense: NO
aaccagaaggccgtaaggcagttgatattgaaaattcgattaatgaatggcttcaatccgtacccaaaaatcttttcaaatcaattacctttgattgtggaaaagaattctttaattggaaaagtattagtaatacgaatgatattgatatttatttcgcagacccaggaacgccttcccaacggggattaa

SEQ ID NO: 684 - DNA (genomic), 192 bp, Enterococcus faecium; double-stranded, circular
  misc_feature (B) LOCATION 1...192
  hypothetical: NO
  anti-sense: NO
aaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaa

SEQ ID NO: 685 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 686 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 687 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 688 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 689 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 690 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 691 - DNA (genomic), 246 bp, Enterococcus faecium; double-stranded, circular
  misc_feature (B) LOCATION 1...246
  hypothetical: NO
  anti-sense: NO
aaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgcctaaggtacgcctttcttagaaagcgcacaaaaccaatggggcaaacttttttcttttgctgtttgatataa

SEQ ID NO: 692 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 693 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 694 - DNA (genomic), 192 bp, Enterococcus faecium; double-stranded, circular; identical to SEQ ID NO: 684
  misc_feature (B) LOCATION 1...192
  hypothetical: NO
  anti-sense: NO

SEQ ID NO: 695 - DNA (genomic), 1017 bp, Enterococcus faecium; double-stranded, circular
  misc_feature (B) LOCATION 1...1017
  hypothetical: NO
  anti-sense: NO
atatttgaggcaacaacagcagatccgtcggttgcctacagagccattggagtgaaaaatatgtactatccttatttaagaggaaaacaatttgacctattagcattaaaagaagcactgtcgcgaggattgctctccaataaaatccaaccagtgatcgaaccagtacgtgattccgctacgcttaaaaatgtgatcgaattatttcaaaaaaagcaccatccaatcgctgtgatccaaaatccccaagtaggacaattcaaattattcgatcagcatgtgcacagttggacagtcaaagaaaatagctctgtcgtccctgcacagatcttaacgccagaaaatctcagtgaagtactggattcacctccagcgtttcttgttttcgatggacagcactacccaaaagatacagaggtgtggaaacagttggcaggagttgattcgaaatttttgataccagatactagtcgctttcgcatctggctgcccgaaaacaaaattgtgatccgtgactcttttcaaacgagaaagcatgttgaaagttatgcagataaaacagatgacttttttagtgatgactatctttttttccacgcagacggatatattggattttctgatttcacgatcgaaggtagccgttatttcgataaagggttccctagccgagcgcttgctatccatctaacgtatattgatgcttacggcaatatacgcgtgaaacattttgtctctgacagtaacgactctgctaaagaccaagcattgaagtttcttgaagcaggagataaaatgaaaaaatggatcatgcgtcaccatcatcaactcttgattacttcaggaatgattgaattattggctctttaccagcaacaaaaattccctggactgggagtgttgaaaaagtggtcacttatgcatcatttggaacttattagtcacctgctagatcatccaaaagattggcttaaatattattcaaaagttcaggaactatatgaagtgatccaatga

SEQ ID NO: 696 - DNA (genomic), 204 bp, Enterococcus faecium; double-stranded, circular
  misc_feature (B) LOCATION 1...204
  hypothetical: NO
  anti-sense: NO
ttaaaggaggcgaactacgtggctaaaaaatcaatgattgctaaaaacaaacgtcctgcaaaattttcaacacaagcttatactcgttgcgaacgttgcggacgtccacattcagtttatcgtaagttccatctttgccgtatttgcttccgcgaacttgcctataaaggtcaaattcccggcgtgaagaaagctagctggtaa

SEQ ID NO: 697 - DNA (genomic), 705 bp, Enterococcus faecium; double-stranded, circular
  misc_feature (B) LOCATION 1...705
  hypothetical: NO
  anti-sense: NO
tatggggaggctaaaatggcattttatttaccctatctactcatttttgttagtatttcaggaagtatttggctcatctataaaatttttcaaacaagatattcattaaaaggctctaaaattcgatttaagcgatttttctttcttggctttatattttacttgataatcgtttcaagcggcttattcggcgttttagagggaaataagcgcgtttctagaagtattttattaggaaatgtcactcaaaagtatgaatcagcgcgtgataaaaagaaaaaagagcaagcattagcacaaaaaatggaagagtttaccacttgttatgaggaaatgaacgatatttttgtgaatcaagaaaaacgtttgacggataaaaacatggaaaaactcactcgtctttatcaaaacttgccagaaaaacagcaaaaagaggttcaagacaactatgagcgaaccaaaaaagacgtgcaatatgtaaaagatacaaagatagaagaagcctgtagtgatctatttggagacacaaacccttggtttgccagtgaagaagaaaaaaaagaaaaacaacaatctgtcacatatgaacgctatgaaatcttgcttcaacaagcaactaacatgcaaaatccgacaaaaaaagaaaccgccttaaactatctaaaaagtgtcaaggaatggttagatcagcaacaacaaaattga

SEQ ID NO: 698 - DNA (genomic), 1008 bp, Enterococcus faecium; double-stranded, circular
  misc_feature (B) LOCATION 1...1008
  hypothetical: NO
  anti-sense: NO
atggattttttgtttcccaaaattaaggaggaaaaagaaatgaaaaaaaatataatcatcggattaggcgctgccctgctactagctttaggaggttgcgcacaaaaagacaattccgcagaggcatcagatggacaaaaaacaattggcgtattgcaacttgtacaacataactcgttagatgctgcctataaaggattcaaagaaggattagcagaagaagggtataaagaaggcgataatctaacaatcgattatcaaaatgcccaaaacaatcaagacaacctgaaaagtatgagtgagaaactcgtcaaagaagatcctgatttgctacttggaatcgccactccagcagcacaatctttattaaatgaaacaaccactatcccgatgactgtctcagcggtcacagacttggaacaagcccatttagtcacatccaatgaaaaacctggcggcaatgtgactggcacgacagatatggtgccaatcgaaaaacaaatcggcttactgttaaatatcgtgccagacgccaaaacaatcggcatcatgtataacaacggtgaagcaaactctaagatccaagctgatttggcagaaaaagaattgaaaaaagcgggcgtcaaagtcaaagtactgacagcaaattccacaaatgatgtccaacaagtgacgaaaagtctagctaaagatgtagatggaatctatattcctactgataacacgttcgcaagtgcggcaagtgttgtcggtgaagtcgcaaaagaaacaaaaacacctgtcgttgctggcgcagttgatcaagtcaaagacggcggtctagcaacagtaggaatcgactacgaaagcttgggcaaacaaacagggatcatggcagcaaaaatcttagacggcaagaatccaagtgaacttcctgtcgaaacagcgaatgatttggaactgtatgtcaataaagacatggccaaagcattaggcatcaatccagacagcatcaaagaagctgaataa

SEQ ID NO: 699 - DNA (genomic), 234 bp, Enterococcus faecium; double-stranded, circular
  misc_feature (B) LOCATION 1...234
  hypothetical: NO
  anti-sense: NO
ctatgctgggctgttgatgatggtctttcctttgatgatggtcgtcggggcgcctttaagcggctacctgaccgaccgggttggcccggagattttggtattagtaggcttgggcttattgtcggtaacccaggtcatgtatatgtttttgtcagtggactctcctttgtggctatacattgtcgctactgccatcatgggtgccggcaatgccttgttccagtcccccaataa

SEQ ID NO: 700 - DNA (genomic), 222 bp, Enterococcus faecium; double-stranded, circular
  misc_feature (B) LOCATION 1...222
  hypothetical: NO
  anti-sense: NO
cagaagtgggcagcttcaagaaataagaaggaatttacgaaaattgcttttcaaatttttgtgaaatttcggcttatttttcgaagaagttacttctggaacaccgtgtatcagaggttgcgaaaaagctgccctgcatcaagtaataagaacagccaaacaaaaatagttcctcatattttacgtttggttgagcttattaccgcagatgcaagcttttga

SEQ ID NO: 701 - DNA (genomic), 414 bp, Enterococcus faecium; double-stranded, circular
  misc_feature (B) LOCATION 1...414
  hypothetical: NO
  anti-sense: NO
aaaagaagggcttttttttatactttgttgattgtagtgtttattttccctctgtttagccaagtaacattttctatgactcaaccagtttcaagtgaggaacatgataacctttttcgtgctacagaagagtttaagaaatatcaggaaaatattgttccggagactccattagctagtgagccaattactgatattgatggaaaccaaataggatggtatatacagtacgaagttatggtggtaaataatgactcaatagtaaaaaatacagtaggcttagagctaacaccgattgaaaaggtgagttcattgttaacgtatatttatactgatgaaagtgacgagactgagatcattttaacggattactcaaaaattgctactgataaaaagtatatattgtggatgtag

SEQ ID NO: 702 - DNA (genomic), 207 bp, Enterococcus faecium; double-stranded, circular
  misc_feature (B) LOCATION 1...207
  hypothetical: NO
  anti-sense: NO
agtggaagggcaaggctttacttatttgaagccacagacaagattactgaaaaaactataagaaaaaagacaaagataggctatgaggaaagattccacatccagctgacctttgtcttttttagtactatactatttttaactaattgttatgttcacttacccggttacttttcttttgtgtctgcaaaaggatctttcggttaa

SEQ ID NO: 703 - DNA (genomic), 261 bp, Enterococcus faecium; double-stranded, circular
  misc_feature (B) LOCATION 1...261
  hypothetical: NO
  anti-sense: NO
acggtgagggctgtccacgtaaatcctactattgaaatcacaatgatcggacattcaaaaggtggtgctgaagcagcaaattcagtagctataaatacgaatgcgattatatttaatccagcgacagtaaatttatctgcttatgaattagactcaaacacatatacagcaaacatggtagcttatgttgtcgagggagatgcattaaatgttgtttttggaggagtatacacctattggagaattaatcatgttagatag

SEQ ID NO: 704 - DNA (genomic), 498 bp, Enterococcus faecium; double-stranded, circular
  misc_feature (B) LOCATION 1...498
  hypothetical: NO
  anti-sense: NO
agtattggggctgtgatattcgacctggaaggcaatcaaatagcagtgggacaggcggagtggcggcatctggcagtaccggacgttcctggttctatggaatttgatctcaacaaaaactggcaactggcgtgtgagtgtatgcgccaggcgctgcacaacgccggcatagccccggagtatatcgctgccgtttcggcatgttcgatgcgtgaaggcattgttttatataataatgaaggagccccgatctgggcctgcgccaatgtggatgccagagcggcacgcgaagttagcgaacttaaagaactgcacaacaatacctttgaaaacgaagtttatcgcgcgaccggacaaacactggctttaagtgccatccccagattactttggctggcgcaccatcgttccgatatttaccgtcaggcatcaaccatcaccatgatcagcgactggctggcctatatgctcagcggcgaactggcggtggatccgaat

SEQ ID NO: 705 - DNA (genomic), 1173 bp, Enterococcus faecium; double-stranded, circular
  misc_feature (B) LOCATION 1...1173
  hypothetical: NO
  anti-sense: NO
aaggatttttttttacaaaaaacaaagaaaagagtgagtgaaatgagcaaaaatagaccatttacagtagatcatgtcggaagtttcttacgcccgcaatcgatcaaagaagcaagaaaaaaagttcaagaaggcttactttcaaaagaagaacttcgtgcaatcgaagaccaggaaataaaaaaattagtggaagaccaaaaagcagtcggcatcaaaggaattacagatggtgaatttcggcgtggattttggcatcttgattttttagaagaactaaatggtatcgaaggctatgttccagaaactggatataatcaaacattccacggaaaagcagcaccagcttataatattcgggtagtagataaattatctttcaatccaaatcacccatttttaaaagattttgcttttctgaaagaagtagtggaaacagatgatacttttgttgcaaaagcaacgatccctagtcccacgatgattttacgacaagagatcctatctaatgatggttcttcaaaaatcaaggagatttatcctgatctatctgatttttatgaggacttgtcctctacttacaaagcagcgattcatgctttttatgaaaaaggttgccgttacctgcaattcgatgatacaaattgggcgtttctagctgatcaaactaaaagagaagcacttcttcaaaaaggaattgatccgaaagaaatggcccatatttgtacagagattatcaataacgcactggaagacaaaccagaagatttgacgatcacaacacatatctgccgcgggaatcacgcttcttcttggctgttttccggtggatatgaacccattgcagaagagttgttttcaacaaattatgatggtttctttttggaatacgattctgaccgagcaggagattttactcctttaagacattggagtaacaaagaaagtaaagttgttttaggattagttacttctaagtttccagatttggaagatacggagaaaataaaagaacgaataaaagaagcacaacaatttgtaccattggaaaatctaagtatcagtcctcaatgtgggtttgcttcaacagaagaaggaaaccatttaacagaagaagaacaatggaagaaaatccaattattgcagcaagtcgcaaaagaagtttggctataa

SEQ ID NO: 706 - DNA (genomic), 447 bp, Enterococcus faecium; double-stranded, circular
  misc_feature (B) LOCATION 1...447
  hypothetical: NO
  anti-sense: NO
gaggatttttttatgtattccattggacaagtgtctgaaatgtttggattgcctgtttctactttacgttattacgacaaagagggattatttcctgatatccagcgtgtttctggtattagaaaattttcagagaatgagttagaggctttaagagtcattgactgtttgaaaaaatctggtttagaaataaaagacattaagcaattcatggaatggagcaaagaaggcagtaagacatttgaggttcgtaaagaactatttgaaaaacaaaaagaagtagtagaaaaagaaatagcaaaattagaaagagtactcgctatgctaaactacaaaagctggtactatgaagaagcaataaaagccggcaatgaagaagccgtattgacaatgattcctgatgatttaccccaacatgtaaaagaagcttatgtacattctcattga

SEQ ID NO: 707 - DNA (genomic), 201 bp, Enterococcus faecium; double-stranded, circular
  misc_feature (B) LOCATION 1...201
  hypothetical: NO
  anti-sense: NO
atcgttcattttgcggttttaaaggaatttgattcactcttcttcactccttttcaatattctacgcagtgcttcttccttatctattttctccagacggtggtaattattttctttcagcatcacatcaaacgtacagatgcttctgaatggacaaaattcgcaggcaatccgctgtttatctttataagctggatttag

SEQ ID NO: 708 - DNA (genomic), 1266 bp, Enterococcus faecium; double-stranded, circular
  misc_feature (B) LOCATION 1...1266
  hypothetical: NO
  anti-sense: NO
cccgttcatttgggtcaagaagcaggcgctgctaccttttgggcgaatctacgtttcttggttaccggtatcggtcttcccttcttaggggtgattgccattggtgtatcgaaaagctcaggtgtatatgaattagcaaaacggataaatcaaacatatgcgatggtttttaccatcttgctttacttagttatcggaccgttttttgctttacctcgccttgcaaccacatctttcgagattggtttagcaccatttatcgatcctagcagacagacgctatatctagcaattttcagtattgtattttttgtgctggcttggtggttttcaagaaaaccgacaaagatattagattatgttggaaagttcctgaatcctgcatttttggttttattaggtgctttgcttctccttgcttttttgaatccactaggttctgtaaatcaagcgcctattcagccaaattatcaagagcatgcttttttcacagggtttactcaaggatataacacattagatgcgcttgctgctttagcatttgggatcatcattgtcacaacaatccaaaacatgggtgtaacaaaacctgctgaaatcgctaaagacacgatcaaatctggtgcgatcagcattatattgatgggaatcatttatactttgctcgcttatttaggtgctatgagcttaggtagctttgctctaagtgaaaatggcgggatcacgctggctcagattgctgatcattatttaggtacttatggcagtatcttattagcatttatcgttatattagcttgcttgaagaccggtattggtttgattacagcttttgcagaaacattcacagatttgtttccgcaaagaaattacgcattctttgttgcacttgctagtatccttccttgtttagcggcaaacgtaggcttgacgaatatcattcaattttcgttgcctgttttgatgttcatctatccattagcaatgacactgattttactagtgttagttggtcctttgtttaagcagcgtacggctgtttatcgaatgactacttattttacattgattgcttcgatttttgatgggttgaacgcttgcccagaaactatcaaacaaacacctattgttcaaaatcttttatatgttgcggaaagctacttgccgtttttcaaattggggatggggtggatcgtaccagcagttatcggttttgttatcggactgatttggagtttcgctaagaaagaagaagtagcagattga

SEQ ID NO: 709 - DNA (genomic), 195 bp, Enterococcus faecium; double-stranded, circular
  misc_feature (B) LOCATION 1...195
  hypothetical: NO
  anti-sense: NO
gcatctcattttctgcgcatccatctgctgatgaaaagctttgttgttctaataaatgagtcaattcgatcagtaatagtgatgtatagagatttaacgaacggatcttatgactgtatgtatcaaaataaatcaacagcatattttcaatcaaatgcgtcaaacgacttgtttttccgccgcgaaaatgaatga

SEQ ID NO: 710 - DNA (genomic), 225 bp, Enterococcus faecium; double-stranded, circular
  misc_feature (B) LOCATION 1...225
  hypothetical: NO
  anti-sense: NO
attttgcatttgtatcaaaacgatgctcaatttaaagaagactatgatgccgttaagcagcacttaattgatgtcttagaaccaatcgtaaaagaagtatatgaagctgctagaaaggttattgaacctgtcgtgcaatcaataaccgaattggttcagtctaacccagagtacttcaaagctttgcaaaacaatatgaatcagagcatgttacaaagtcgctag

SEQ ID NO: 711 - DNA (genomic), 462 bp, Enterococcus faecium; double-stranded, circular
  misc_feature (B) LOCATION 1...462
  hypothetical: NO
  anti-sense: NO
aaagtgcatttctttaaaacaagaaacattctaaaagctgtagctagtggtcaaattattccattaacagcagtaaaagacgaggtcttttcttcaaaaatgataggagttggatacgctataacgaatcatgatggatatatccatgcgccagttaaaggaataatcgataatatatttcctacccgacatgccataacgatcgaaagtgaatctggcagaaaaatactgatccatatgggtttagatacagttgaactcgaaggaagtccgtttcagatacgggttgaaagtaaccaggaggtaaaagaagggacactgttagctattatagatttgaagaagttggagcaagcacaaaaagatacggtgatcattgtagtttctccaggcatttttgaaggaaatttattaaaacaaaaccaagaagtaaagattaaagatagttgttttgaattttag

SEQ ID NO: 712 - DNA (genomic), 1758 bp, Enterococcus faecium; double-stranded, circular
  misc_feature (B) LOCATION 1...1758
  hypothetical: NO
  anti-sense: NO
gaaccaccancactaaatatgggggtatttgttgggattattgcagggttcgttggggcgatggcctataataaatattacaattatcgtaaattacctgacgcattatcgttctttaatggaaaaagatttgttccttttgtagttattttgtggtcaacgattgttgcattgattcttgctattgtatggccgaatgtccaagcagggatcaataactttggattgtggattgcagagtcaaaagaaagcgctccgattatagcaccattcctatatggtacattggaacgtctattgttaccatttggcttacatcacatgttgacgatcccaatcaattatacgcagctgggtggtacctatgagatattatctggtgcgcaagcgggaacacaagtatttggacaagatcctttatggttggcgtgggcgactgatttggtcaacttgaaaggcgccggcgacatgtcgcaatatgaattcgtattgacgaactggacacctgctcgttttaaagtgggacaaatgattggttcttccggtatcttgatgggattaacactagcgatgtaccgtaatgttgatccagacaaaaagtctaaatataaatcaatgtatttttcagcagcacttgcagttttcttaacaggtgtaaccgaaccattagagttcatgttcatgtttgcagctgtacctctttacattgtttattctgtgatccaaggggcagcttttgcaatggcagatattctacctttacgtgtccattcatttgggaacattgaactattgacacgtacaccattagcgatcaaagcaggattaggtatcgacttgctcaattttgttatctgtgtcatattatttggagtattgacgtattttgtggcaaactttttgatcaaaaaattcaattatgctacaccaggacgtaatgggaactatgataacgacagtgaagaaacgccgtcaggttctgcaactaatgcagatcaacaaatcattaagatcatccatttgttaggtggaaaagaaaacatcaaggatgtagatgcttgtatgactcgtttacgtgtcagcgtcgaggatcctgggaaagtcggttcagaagaagaatggaaacgtgctggagcgatgggcttgatcgttaaggacaaaggtgtgcaagccgtgtatggaccaaaagcggatgtgttgaaatcggatattgaagatttactacaatcaggcgctgatattccagagccaacagttgaggcaacaaataaaaatgagaagaatgaagagaaacatgttttaggtatcgaaaaagaattattcactgtagcaactggtgaggtaattgctttaacagatgtgaatgatccagtcttttcacaaaagatgatgggtgatggctttgctgtcattcctgccaccggagaagtggcggcaccactttctggtaaaatcttgagtgtcttcccaaccaagcatgcaattggcatgcaaacagcagaaggagcagaagttttgatccatatgggactggatactgttcatatgagccagccagcgtttgagatcttagtttctgaaggccaagaagtagtagcaggaacaacgattgctcagatgaatctagatgcaatcaagaacgaagggaaagaaacgacgatcatagtagtctttacagatgacaaagtcaatgggctgaccatcaataaattaggagacactgaacgaggaacagtgatcggaaaaataaacttgtaa

SEQ ID NO: 713 - DNA (genomic), 747 bp, Enterococcus faecium; double-stranded, circular
  misc_feature (B) LOCATION 1...747
  hypothetical: NO
  anti-sense: NO
atttttaatttaattggcgactatcactacctgcctttaagtgggagtaaatatatttttattgttatggaggaagaaatgaaaaaaatagttgggttaggattaattctgttctctagtattgtactaggagcatgtggaaatagtaattcaaattctgatacgcctaaagaaacaaccactgcgagctctacaatggtttctcttgaattcagtagctctgtggaaaaaaagactaatcttctatcaaatgattcagatttcggaaaaatagctgataatgtacctgatggagaatccatagaagtacaaggtaaacaagattattcaaccaattttaatgataattcttgggcgggtgttaacctaaatatcgatcgggtctcagttgtgaaaactactgatatcaaagactattcagataatcaatacaatggttttgtagccgtgcattacaacatagataatacacaacaagatgtatctatataccctaatcaagccacaattgtaactgactatggtgagcaagttgatgatggcggagtctttaattatgattcatgggatggtgacttcatgaaaggaacaaaaaaagatggttggggcatctatcctttatcaaaacttcctgttgcatcttcaatcaaatctcttcgattgaagattgattctagctatgaaactgataattatgatgatgaaaactcgtatcacacatatgatattaacttaaatttacaataa

SEQ ID NO: 714 - DNA (genomic), 1374 bp, Enterococcus faecium; double-stranded, circular
  misc_feature (B) LOCATION 1...1374
  hypothetical: NO
  anti-sense: NO
aggagtaattttacaactatgggtaaatattttggaacagacggcgtacgcggtgaagccaacaaggaacttacgccagaacttgcatttaagctgggacggtgcggaggttatgtcctaagccagcatgaagaagaaggaaaacgcccacgcgtgttagtagggcgggatacaagaatctcaggtcaaatgttagaagaagcgctgatttcaggacttttatcggtgggtatcgaagtgttccagctaggtgtgatctctacaccaggtgttgcttatctgacacgtttgcaaaaagcaagcgcaggggtcatgatttctgcttctcataatccagcacaagataatggaatcaaatttttcggtgcagatggttttaaactagtagatgaccaagagctagaaattgaagcattattagatgctgaagtggatgaattgcctcgtccatcagctgaaggattgggaactgtagaagaatttccagaaggcttattgaaatattctcaattccttgtacaaacgatcaacggtgacctttccggtttgaccatttgtgtcgatgcagcaaacggagcaacttcaacaagtgttaatcgtttgtttgccgatcttgaaacagatttttatacaatgggcacaaatccagacgggttaaatatcaatgacggcgtaggctctacccatccagaacgtttagctgagatggtcgttgaaaaaggagcagatgctggactagctttcgatggcgatggcgatcgtattattgcggtggatgaacttggaaacattgtcgacggtgataaaatcatgtttatctgtgctaaatacttggcagaaaaaaatcgattgaaaaaagatacgatcgttacgactgtcatgagtaacttaggattccacaaagcggtggaaggaatcggtttgaaagatgtcgttacacaagttggtgatcgttacgttgtagaagaaatgcgcaaaaacgattataactttggcggcgagcagtctgggcacatgattttcttagattttaacacaactggagatgggatgctttcaggaattcagttactgaatatcatgaaacagacaggtaagaaattatcagagcttgcagcagaggtaacaatctatccgcaaaaattagtgaatatccgcgtaagtgataaaaacggtgcgatggatgttccggcaatcaaaaaagtgattgaagaggcagaagctgaaatgggatcagaaggaagaatcctagttcgtccttccggtacagaaccattacttcgagtgatggcagaagcgcctactgatgagaaagttaattactatgtcgataaaatcgcggcagtagtcaaagaagaaatcggactggattaa

SEQ ID NO: 715 - DNA (genomic), 354 bp, Enterococcus faecium; double-stranded, circular
  misc_feature (B) LOCATION 1...354
  hypothetical: NO
  anti-sense: NO
gggataaatttgaaaattgcttatattagagtttcatccatcgatcaaaatgaacaacgtcaaattgaagaaatgaaaaagtttggcgctgaaaaaatttttatcgaaaaacaatctggagcgacgattagtcatcggccgattttccaggaagctttagattttgtcagagagcaagatatttttattgtagaagccattgatcgacttggacgcaattatgacgagattatcgattcagtgaattatctaaagaagaagaatgtgcgacttattatcaccagtttaccgatcatggctgaagcaattggaaatcctctcctagataaattcatcaaagacttaatcatttaa

SEQ ID NO: 716 - DNA (genomic), 258 bp, Enterococcus faecium; double-stranded, circular
  misc_feature (B) LOCATION 1...258
  hypothetical: NO
  anti-sense: NO
atgtcaaatttagaaaacaaagaagaaaaagttgtaaacaaaattgtttctgttgtcaataaactggataaagagttagacgaacttgatacgttatctgaaaatccagaaaaaaaacataacctaaaaaaatggttagttgaacgaaaggctattcatgaaattaaaaaagttcttcatgaagctgataaatatgaaaaatatgatgaaaaagaacttgataaagaatttaaagaaatcaatgacttattactataa

SEQ ID NO: 717 - DNA (genomic), 210 bp, Enterococcus faecium; double-stranded, circular
  misc_feature (B) LOCATION 1...210
  hypothetical: NO
  anti-sense: NO
tttattttttactttttagataactattttcttatcataattctagatgttgtgacaaaaacgtttgtttatattcctatgttgttcgtgtgttcttttcattatcctgctaaattatttacaaggggtgagtatatgatttatatccaagcaatagtctttgtaacgttgatggttgggctacttattggcttgaaagaaaacagctga

SEQ ID NO: 718 - DNA (genomic), 186 bp, Enterococcus faecium; double-stranded, circular
  misc_feature (B) LOCATION 1...186
  hypothetical: NO
  anti-sense: NO
ccaattttttacgttaccaatcgtaaaaatctaccccgtcactccccgaaggaaattgttgatagatcaagtctactccttatttttctaatgattctaagttcttttagaagtctcgacaatattttcaagcaagcgaaaaacgataaaatacaagttatgagaatgatcaattcagctgattaa

SEQ ID NO: 719 - DNA (genomic), 186 bp, Enterococcus faecium; double-stranded, circular
  misc_feature (B) LOCATION 1...186
  hypothetical: NO
  anti-sense: NO
acggttttttatttaataaaaatttttaagggtgggacttttgattcctaccctttttttgcgtttatttttgttatacgaacaaattatgaagttatttattctaaattttatttttttgtgaaaactagactctttttaagcagagaaaaacaaggatatgataaactgaatacaacttcatag

SEQ ID NO: 720 - DNA (genomic), 303 bp, Enterococcus faecium; double-stranded, circular
  misc_feature (B) LOCATION 1...303
  hypothetical: NO
  anti-sense: NO
atgcctttttatttttctaacttaattttacaattcgcgttattaaaaaatggagcgcccgttgatattgctactttagaaaatgctaaagaagtatttggagaaagtaatattttcagcactactatcaaaaatatggaacggttaaaaagatatgatttaactggtattacagacgaagacatgcacgataaaaaagttcataacgtatgcttagtcgattcattaactgacgaacaacaacatacttttaaaaatcaatttgaagttctaagaaaacgaactatggaaagagaaaagtaa

SEQ ID NO: 721 - DNA (genomic), 327 bp, Enterococcus faecium; double-stranded, circular
  misc_feature (B) LOCATION 1...327
  hypothetical: NO
  anti-sense: NO
tgtgctttttattttgattcaaggagttgtcacatgattaatttaggggaatggggagcgatagcaggatcaataaccgctatcgtttctttgattttattagtaataaaaccaattactgcatctttctcgaagattactgagactctttcaaaagtaagtcacaatttagatttgctgactaaagatttagaatcgagcaaatcagatcgattgatgattcatgaagaactaaagacacacgatgaaagattagatacacatgcagaaaaattggtagaacacacgcaacaaattaaaactttatttagggagagaagaaaatga

SEQ ID NO: 722 - DNA (genomic), 939 bp, Enterococcus faecium; double-stranded, circular
  misc_feature (B) LOCATION 1...939
  hypothetical: NO
  anti-sense: NO
aaagctttttatataaaaagagaaaggaaagtggttcttttgttaacaaacaaccaatcctccaatcttgtcaaaaaaacactaacctattccatagatacccatcttcatttatctgctgctccctattttcgactactaataaatgaaagcgctaatttatatgctgaatttgcacataaatctatagaactagataatccttcccttttattcattgataaacagcaagaagtccaaatcttttctactcaaaaggaaacacaaacttttatcattatccagttttattttgatgagcaattattagcacatattacgggacaatctttttctatagatcaagaaataacatctatcattacttttctgaaaaatgaacagttcaaaattgattatctaaaacatagtaagccagctatttcctatgatcaggaaatcaattcttttttcatactatgccaacagatgagcattcatttgctttccttattagttacttattgtctgcaaaaaattcaattgtcttccttaccaaggcattatcaacaggaacttgctttattgacaataccttcaaatgagaaagtcattcctaaaaaaaagcatattctttattcagatgaattagttgatccaatcatacgatatttagaagaacatctttcagaaaattttttgcttgaacaattagcccaaattttttttatcagtccagccagcttaaaaaaacattttagaaaagtgaatggaaaaagtgttattagctattttaaagaactaaaaatggaaaaagcaaaacgtctcgtgctagaaaatgaattaacctatacagaaattgcagatatattaggatttcattcgatccatcatttttcttcagcttttaaaaaatatacagggttatccccttcaaagtattatctatccttaaaatag

SEQ ID NO: 723 - DNA (genomic), 228 bp, Enterococcus faecium; double-stranded, circular
  misc_feature (B) LOCATION 1...228
  hypothetical: NO
  anti-sense: NO
ttttatttttactttatcgatttactttttctaaacaaaaacaaccgagaagagaagtacaacattctcactagatttttatttaagaaagactttttagctgtacacataaacaggctaaaaagtctttttttatatttctttaatttgcttcatacattatttaacatcgatatttatactgtgaaacatgcgtttcatccattatcaaagtatttttatcgataa

SEQ ID NO: 724 - DNA (genomic), 234 bp, Enterococcus faecium; double-stranded, circular
  misc_feature (B) LOCATION 1...234
  hypothetical: NO
  anti-sense: NO
acctatttttacaacttattgattgacagcagatggaggaaaaaaatgaatccatatgaacaacttattcaagatttgatcgatggaaaaatcgaaaagattgatgtaaaaagagaagaattaatggcttttcgagaagcgtggctgaagttggagaatcgtaaatatgtggtgggaaaagcctcactgaacggcaatgtgacttatcattacgatccgacacgtttattttag

SEQ ID NO: 725 - DNA (genomic), 405 bp, Enterococcus faecium; double-stranded, circular
  misc_feature (B) LOCATION 1...405
  hypothetical: NO
  anti-sense: NO
aggagtttttacatgtacagtttcacaaataaacattctaaagtttttggatacgtctctgtcttattcactggattaggatttactatcgtcagtcctgtacttccgtttttaacgctgccttattctcactccatacatcagcaagctttctatatcactttgctcatgtctgtttatgctctagctgccttcttatctgcccccattctcggtagcttaagtgatcattttgggcgtcatccgatccttattatcagtttattaggatcaagtatcggatatttgctttttggtttaggaaattcgatatggatgttgttccttggtcgtatcattgaaggattgacggcagggagaaatctccaccttatatgcttactttgccgacatcacggaacctaa

SEQ ID NO: 726 - DNA (genomic), 336 bp, Enterococcus faecium; double-stranded, circular
  misc_feature (B) LOCATION 1...336
  hypothetical: NO
  anti-sense: NO
tccatttttctattattaagtacataccattgttactctttgaatgtgggggagaaaaaaataaaaggagctggtattttgttagttatgagtaaagctttgtttttacttccctgcacgttcatgtttattgttttatgttatttcaaaagaagaaaaaaatggtgctggatcgatgttctactattccttccctttttcccgcttatttattttcttgaagaaatatgggatgatatggcatgtgattctgcttttctttttagtcattcattggggcttatgatctctcttacgatctttgccattgtgctattttttttgaataaaaaataa

SEQ ID NO: 727 - DNA (genomic), 756 bp, Enterococcus faecium; double-stranded, circular
  misc_feature (B) LOCATION 1...756
  hypothetical: NO
  anti-sense: NO
acaccgttttatttgtctcacacctttatccttcctacttgtaaccttgctcccgtgttagaaacatgttacactaaatatgtgaaattattaacaaggagcgtcgttatgcgagaaaaaacagatacactgccaaaagcaactgcgaaaagattacctttatatttacgctacttgaagatgctggatgactcaggtataagtagaatcaaatcaaatgagttcagcgaaatcacccaaattccttctgcaacgatccgcagagacttctcgcaattaggcgagctaggcagaagcggatatggctatgatgtcccttttcttatcgatgtattcaataatatccttaatactaaagaagaaaaacgaatcgcattagtaggatatggaaatattggcaaagcattgaaacacaacaattttagaagaaatgaaaatctaaatatcgtgtgcgtctttgataatgatccagcactgatcaatcgagtaattgatggagaaatgatctatccgattgatcgtttcgcggagatagccaaagcaaaaaatgtgacagtagcaatctctacggtaccaagtaaatattcacaatctgctattgatgaaattgtcaaaggaaatgtaaccgctatacttaattttgcgcctgacagagtaactgtcccagcttatgtcaatgttcaatacattgatttgacaaccgagttgcagacgcttatttactttgatgagaattactcagaagttttttcttag

SEQ ID NO: 728 - DNA (genomic), 237 bp, Enterococcus faecium; double-stranded, circular
  misc_feature (B) LOCATION 1...237
  hypothetical: NO
  anti-sense: NO
actgagttttatttccgcggatggcgagacagaaaaattaatcgagaaaatttacctacacaaaaaattcctcgattaacaaactatttccttagctgcactaatcctaaagaaatagaattcttagttacagacatgaacgccacctactttcagctcaccaaacatgttctaccaaatgcgaaattggtgattgatcgattacttggtttttccacgcctttcaaggaggcgtaa

SEQ ID NO: 729 - DNA (genomic), 216 bp, Enterococcus faecium; double-stranded, circular
  misc_feature (B) LOCATION 1...216
  hypothetical: NO
  anti-sense: NO
aagcggttttattttggaggatgcttacatggatacagagcaacagaaaaaaggaattggtttaattccacttgctgccttagtaattggttcagcgattggaggtggcgtatttggtattatgacggacatctccggatcggctggcggcccagctattttcagttgggtactcgtaggaacagcaatgttgatgctctccttgtcgatcaataa

SEQ ID NO: 730 - DNA (genomic), 297 bp, Enterococcus faecium; double-stranded, circular
  misc_feature (B) LOCATION 1...297
  hypothetical: NO
  anti-sense: NO
gaggaaaatttgatgaagattacagtaccagatgaattgatagcagatgagttgacagaacaaatagtaagaaaggttttagatgcacttgatgaacgactgaaggtaatgaacaagtcagtggagcttcctccatatccaaacaaatcagaggtaaaaaaagttttaggcattggtgatgacaaattaacacattggataaacttaggcttaaaaacacagcagtggagcaagttagacatcagaattgaacgatcagaactccaaagatttttgaaagaaaactttgagttctaa

SEQ ID NO: 731 - DNA (genomic), 315 bp, Enterococcus faecium; double-stranded, circular
  misc_feature (B) LOCATION 1...315
  hypothetical: NO
  anti-sense: NO
ggtgaactttatatgttaatggaaggaaaaacacaattatggtttaaatttgatccttcgaacaaattcattaaagactttcacaaagtatgggattcagaagttttctttttagcaatcgaagatagcttattaatcaatctctactattctaataagaactactttaaaattcctgctgcgaaaactagaatgaagaaagatgtatattttttgtttgatatcgtgactgacgtgccagacgcacggagcgatcatcggcgttatgactatataaagtatactttcgttgatccagaaaggtatatagattaa

SEQ ID NO: 732 - DNA (genomic), 1524 bp, Enterococcus faecium; double-stranded, circular
  misc_feature (B) LOCATION 1...1524
  hypothetical: NO
  anti-sense: NO
gcccttatttattttgggacaggtatctcttcaagaaaaggagagaatatggacaacgaaatgattagtcaattacaatttgatcggatcaaaaaggaaatccaagcaagagcaattggaaactatagcaaaaaacgaatcagcgatatgacggtctcgacaaacctacaaactgtcttggatcgtcaagaagaaacaagagaagcacgcttgatcttagaaagcagtcagcatgttccatttatggggttgccgaggatcgatgcactgacagaacaagtcaaaaaagggttgattctgcagccaaccgatttgatcgaatatgcggattttcttagaagcagtcggatgatcacaaagttttttgataagaatcaataccagacacccttgttgtttgcttatagcaaacatcttcctgatttgataaatgtagaagagttgattgaccagaaaataaaaaataataaagtcagtgacgacgcgtcacgtaatttgcgtaaagtacgcaaacaattacaactaatcgaaaaagaaatccagtcaaaattactgaaattcttgcgtcatccgaaaaacaaagaaatgatccaagaagcaatgattgttcaaaaaggcgaatactatacgattcctatcaaagccagctataaaaataaaatagatggaacgattatcgatgaatcaaataaaagaacgacggtttttattgaaccaactgtgatttctaaattgaatgaacactatcagttgttaaaagctgaagaaatcagtgaagaatatcaagtcctggcggcattgactggtgctatcgcagaaaacgaagaagtgatcgatttattgatcgaaacgatcacggtgttagatatcatctttgctcgggcaaaatttagccgagaaatcaatggaagcacacctagaatcaataaatcggaacatatcattatcaagcaaggcagacatccatttttacctgagcatgcggtaccattggatgttgaaatcggtaaagactatcgaggcttgattatcaccggagcaaatgccggaggcaaaacagtcgtgttgaagacagtcggtttattgactttgatggcgatgttcggtatgcaagttccggcaaaagaagggacagagcttgctgtctttgatgagattttcgtcgatgtcggtgaccaccaaaatttagaaaatgcgttgagtacattttctggtcatatgcaaaacatcgctgctattttgaaaaagataaaaaggaatacgttggtacttttagatgagattggcagtggaacagagccaaatgaaggggctgcactagcgatcgcaatcatggaatctatgtatgagcaaggggcattgatcattgccacgacccattatggagaaatcaagaaattcgccggagatcatgaagattttgtgccggctgctatggctttcgatcgggaagcacttcgtcctaaatatcagttgcgggttggaagaaacaggagaaagccaagctttgtggattgctcataa

SEQ ID NO: 733 - DNA (genomic), 243 bp, Enterococcus faecium; double-stranded, circular
  misc_feature (B) LOCATION 1...243
  hypothetical: NO
  anti-sense: NO
gcccttatttattttgggacaggtatctcttcaagaaaaggagagaatatggacaacgaaatgattagtcaattacaatttgatcggatcaaaaaggaaatccaagcaagagcaattggaaactatatcaaaaaacgaatcagctatatgacggtctctacaaacctactaactgtcttggatcgtccagaagaaactacagaaccacgcttgatcttacaaagcattcagcatgttcccatt

SEQ ID NO: 734 - DNA (genomic), 2313 bp, Enterococcus faecium; double-stranded, circular
  misc_feature (B) LOCATION 1...2313
  hypothetical: NO
  anti-sense: NO
ttcgttatttacggcggaaggagcaaacatgcgatgaatgagaaacaactagaacaaacgcacgtggatgaaacgatcgaactaatccagatcgaacaaaatatgctggatacaaaacaacaagaattgactcaggaaatgaatcattcgacaaaagacacagctaatcacaagattcgagctggttccaatgaagctttttatgaatctgctgttgaatatcgccaacatgagcaggaattgcttttgaaataccatactcttgaagcacagcaaaaacgcctgcaaacgttgtctgtcatgaaagatagtccttattttgcccgtatcgactttaaagaagaccgtgaaacagaaacattatatctaggtatcgcttctttaagagatctggcagaagaaacaatcgttattgactggcgcgcaccaattgccaatctttattatgaaggtgagattggtcccgcattttatgaaactgaaacagatagaatagatgtcgatctgcagttgaaacgacaatttaaaatccaagaaggacgtattttatctatggtagatacgtcggaagtaatcaatgatgactttttgctagagatattggatgaatcatcaagcaaccatatgaaaaacatcgtctctacgatacaaaaagcacaaaatgcaatcattcgggacacaacaagtaaagtaatgctgattgaaggaatcgccggaagtggaaagacatccgctttgcttcaacgtattgcttttctgttgtatcataatcgcaagtggctcgaggctgaaaacgttcttctattttcacccaaccatttgttttctgattacatctcgactgtattgccttcattaggtgaaagcggcgtgcctacacagacattcaaaaattatttggtgcagctgctgccagagttttctttactagatgaacagcaacaagaaagtggttttttgctaggggaaaaagatccgatacaagtgatgaaaagcggattgaccttagtcgatcagattgatcgctatatccaaggcatcacaaactacggtcccttgttccgtgatatgaaaataaatggccgtacgatcctatcaaaggaatcgattcgccaatggtataaagaaacaaatgaacaattacctttacatcatagactttctctattacaaacgaagctcctgaaaaaattaggcggtctgcaaaaagacgaaacacgtcagcaatgggtcaaagatctggcggaagaacagctccaagaactatacgcaacagatccaaatcttgaatatacagaacaaaaggagcgttcattacgtaaaaaactggccaaccaaatcgtacgtaaaagattccgtcgaatccatcgagggatcatgaattatcaatttgtcaatataacgaaacaatatctccactttctacaaactgtgccactttctcttctaacacgacataaaatcagcgagaccaggtggcaggaacatttgacaactgttcgtacacacttgcgtcaaagagaattgcgtcaagaggatgctgtactattctttttactgatgcgccgaacatatccagtgacggttacacacaaagctcgctatatctttattgatgaaatgcaggatttcgcaccatcacaagtggcattgctgcaagccttgttcccaaaagcaaatttgactttctgtggagatctaaatcaaaatgtctttggaaatgaaacgatcgttggatcattggaagaccttttcgtggaccgtgaagtcactcgtttccaattaacgacaagctatcgctccacaaaagaaatcactgattttgctaatcattttattgtgaaagaacatcaagtagaaacaacagcaagaaaaggagaccttcctttgctcatccaaggaacaacagatgatatcaaattgaattggttagcagataccattcgaacgactcagggaaaagcccggtattggcgtacagcaatcatagctaaaacacaagaagaatgcgaagctctttatgctcaactgccagacgagttgaaacaacaagtccagctgattttaaatgagagtgactttatgaagcgttccattattttacttccagcctttttagcaaaaggtctggagtttgaccgagttttcttgtgggatgtagatgcagaacatttttcttctcagcaagacaaattgatcctttacaccatgtgtacacgtgcgatgcatgaattgaccctttttacctccaataatgaaagtcctttgttaaacaatatggatatttcatcttatgagaaaaaagtactgtaa

SEQ ID NO: 735 - DNA (genomic), 555 bp, Enterococcus faecium; double-stranded, circular
  misc_feature (B) LOCATION 1...555
  hypothetical: NO
  anti-sense: NO
atcatcatttatggcagcgagtttgaccaaggcagacaatcacgcgcagaaatagtgggcagtcctctcgggcaacccccccagcaatttgggaaaacagtagatagtgatcaaatggaaaaaccctcgcgacaaaagaaaaaccaaggtcatgatcttgttccaggaattcaagaattctggaaaaaggtccatccgcatgctgatctttatattgtgacgaacggtgtgtcgcacacgcaacatcggcgattaacagatgcaggaatgcttgattacttcaaggatatctttgtctcagaagctgtcggagcgcaaaagccgatgaaagaattttttgatcatgtcttttcccacattcctaattttgataaaaagcaaactgtgatcattggtgattctttgacttctgatatcaaaggaggaaatatggcagggatcgatacgatttggttcaatagaaataaattaccagaaatcgaagaaatccagcctacttatcgaatcgattcattagaggaactttattcattattggaaattgaaaaggattaa

SEQ ID NO: 736 - DNA (genomic), 960 bp, Enterococcus faecium; double-stranded, circular
  misc_feature (B) LOCATION 1...960
  hypothetical: NO
  anti-sense: NO
gagtcaatttatataaaacaagttttgaaatggttgattttggaaaagcctctgctattgcctggacgatggtgtttgtatctgttatattatcggctattcaatttaaattcggaggtgataaaaatgactaaacaaaagatacaaagcagaatttttacgtacgtcattattgtgtttggtgccttaatatttttgatgccatatttatatatgattgtagcttcaacgcaaagtaatcaagaaattttaagtggcggaatcaatttcaagtttggggatatgctattaaaaaactggcaagccatcatggcgagatataattatcccttgattatttggaattcgattgttattgctgtaatcagtacagttttagctacagccagttctacaatggcgggttatgcattagcaaagtatcgttttatggggaataaactgttgttcaatacagttatgctatctaggatggtgcctttttttaccacattgattcctttattttacattatgagtcgtttaggattatcgaatacttatgcaggtgtgatcatcccttcgattgccagtacaacttcagtgtttatgatgcgacaatatagcagtcaatttcctacagcactgatggaggctgccagaatcgatggtgccaatgagtgggtgatttttacgaaaatcgctgtaccgattttatcacctacgattattactagtggtttacttatctttatgggaagttggaatcaatatctatttccattagtcatgctttcagataaagataaatatacggttcccttaattatcaaaaatatgacggtttctagtacaggtgagccaattaattatggcgcaattatgctaattttagcaacttcagtgatcccaatggtcttgatttatgtgtgggcgcagtctaaatttaaggagaatgacattggagctgcaaataagtaa

SEQ ID NO: 737 - DNA (genomic), 495 bp, Enterococcus faecium; double-stranded, circular
  misc_feature (B) LOCATION 1...495
  hypothetical: NO
  anti-sense: NO
atgaaaatttattttgccgcaccaatgtttgctaaaagtgatttgttatataaccaacagttagttaaagaaatcagagagctctcttctgagctttcgatctatcttcctcaagaaaatgaagcaatcaatgacaaaactgcttatgcagacagtcgaatgattgctcttgctgacacagaaaaagtgttggctagtgatttaatgattgctttactagatgggctgacgatcgatgccggggtagcatcggaaatcggtgtggcttatgcgaaaggcatcccagtgatcggcttatatactgatactcgacagcaaggcggaacccacccgaaaaaaatcgctgcactacaagaaacagctgaaaatcaatttcactacctgaacttatatacaataggtttgatcaaattgaacggaaaagtggtttcttcagaaattgagttgctttcagaagtaaaaagatttttagatggagggactttcagtgattaa

SEQ ID NO: 738 - DNA (genomic), 207 bp, Enterococcus faecium; double-stranded, circular
  misc_feature (B) LOCATION 1...207
  hypothetical: NO
  anti-sense: NO
gaaggaatttacgaaaattgcttctcaaatttttgtgatatttcggcttattgccgaagaagtaacagcaaacatcgcagatccaatgataaaaaaagccactacattagaagtatatgtcgcaaacggcaaacttgtgtgtcccgttttttacgtaaccaaatatccaaggttaaaccatctgcatcgatggctcgatacaaataa

SEQ ID NO: 739 - DNA (genomic), 2604 bp, Enterococcus faecium; double-stranded, circular
  misc_feature (B) LOCATION 1...2604
  hypothetical: NO
  anti-sense: NO
aaggtgatttatttgttaaaaaataccatacaatggctgaaaaaccacctaggactgttcaaaacaatctttttgatttctgtcattgtcattattgtcggtgaattgatgtccatcggtaaaactctatctatccagcaattaggagaaacgtttgccactatacctgtatggaaaagcggactaatgctattgattggtcttatctctgtgttacctatggttggttatgatattattttgaatcggatgcttgaacaaaagcagaatcctcgttacctgtttgagacaagctggctgatcaatacgatcaacaatattgccggtttcggcgggtttgttagtgtggggcttcgctctgaactatatggacaaaagaaagagagcagaaacgtgatccaagcattatcgaaagttttcttgtttttgatggctggactttctatttacagtctgctttcttttttacttgtagtcttcacgccagttgctccttttttgaagcaatattggatatggttgatcggcggcggtctatattttcctgtcgtctttttatttactactttcaaaaagaaaggattccttggtggtacctcacttaaaactcaaggacagctattgctagtttcattgttggaatggaccggtgtcctgtttagtttcctttctgttggttatttaatggaaatccggattgatctgtggcaaacaattccattattcattgctgcttcagtgataggaatcgtgtctatgattccaggagaaattgggagtttcgatgtaatgatgattatcgggttgtccgctattggtgtgccaagagaaatagtcgttgtgtggatcttgctctatcgcctgttctactacatcattccgtttttgattggaatcgtctttttcttcaaaaatatcggttccacttttgatcagcgttattctggtatccctaaacaattagcaacagaaattgcgcataaaatcgtggttgtcttattatacttttctggaatcatgctagtactttctgccactatcccgcaagcttttacagagtttcgctggcttcatagtttgaacccattgaaatttcattttattatccaatttcctagtatactattgggatttcttttaatcattatgggcagagggatcgcagcacgtgtgaaacgagcatatttgcctacaatcttcttgattgttctagctttactttatgttttattaagtgattttagtttcacaccggtggttttcttgtctattctgcttctgatcattcttgcttctaaaaacgaattatttcgggaacaattgatctattcatgggagtggcgtacgatcgatggaatcattattggtgcactgtccttgctttacatcgttattggggtatacaatctgccagatttccctcatcggcgtcaccattttatttcctttttcttatttccttctgaaaagatttggttttcgggattgttggccatcatcgctgttagtttcatgatcgttctatttgttcatttccttcaaggagaaaagaaacagattggcgaagcctttaatgaagaaaaggccctgaagatccttacaacttatggaggaaactccgatagtcaattgatcttcttaaaagataagcggatgtttgcctatgaaaaagacggtgaaccaactgttcttctccaattcgcttgcttcaataataaatgtattgtaatgggtgatccttctggtaagaaagaagattttccagaagcaatcgaagcttttatcgaagaaacagatcgactatgctatttaccagttttctacgaaacaagcgaagagattgttatgattttgcatgaattcggctacgatttcattaagatgggggaagaagcttatgtagacctgaatagttttacaacttcagggaaaaaaatgaagggcactcgtgctgtcttgaatcggatcgaacgagaaggatttacatttgatgtcttacaaccaccattttctactgagcaaatgagtactttcaaaaatatctctgataattggttgggttcacgaaaggaaaaagggttttctttaggctttttctctgaagattatctacaaagagcgcctattgcagttgtcaaaaatacccaagaagaaattgtcgcttttgcaacgatcatgcctacttacacgaacaataaagtaggaacgattgatctgatgcgatatgattctaaaaaagcaccttctggcagtatggatttcttgttcttgcatttgtttgcctatatgaaagaagaacatatccaatggttcaatttagggatggcccctctttcaaatgtcggaacttccagaaagagttttttacaggaaaggattgcatacttggtttacgagtttggttctcatttttattctttccatggattaagagaatataaaagcaagtacgctacaaactgggtctcacgttatactctatattctagagatagttggattgcatatgttatgattgctttgctgattattgataatgcgccagttgagcagacacaaggtagaataagtggtttgaaaaaatggatacgaagaaagtattaa

SEQ ID NO: 740 - DNA (genomic), 192 bp, Enterococcus faecium; double-stranded, circular
  misc_feature (B) LOCATION 1...192
  hypothetical: NO
  anti-sense: NO
ttgaactttctgacactttcaggtacactggaaaagacaactacacgaaggagggaaaatactatgatgcgcatgactaaaataacaagtaatgaaaattaccaacgataccatatcgcatttagccatgcaattggttttacagttgctgttgacgggacaagtttgtccaaaacagttgaattcacgtaa

SEQ ID NO: 741 - DNA (genomic), 426 bp, Enterococcus faecium; double-stranded, circular
  misc_feature (B) LOCATION 1...426
  hypothetical: NO
  anti-sense: NO
aaccgaaatttcacgaatcaaaacggcaatcgagaagccgattttattaactgcgtgatttggcgcaaaccagcagaaacaatggcgacattagctaaaaaaggtagcttgattggtgtagttgggcggattcaaacgcggacttatttgacgaaatttccaggagtagggaaaaagacagcacaacaaatgatcttggatctaaaaggaaaattcggtgagctgagtatcgatacaccttttagtctatttgatgaagcaaacacaaaagacgctacagctctatctgaagcaatggaagctctctcggctcttggttacagtgatcgagaaatcaaacgtgtagaaaaacaattaaaagaagtagataatcagacaacggatgagtatttacgccaagcactcaagctaatgatgaaaaaataa

SEQ ID NO: 742 - DNA (genomic), 342 bp, Enterococcus faecium; double-stranded, circular
  misc_feature (B) LOCATION 1...342
  hypothetical: NO
  anti-sense: NO
tatcatgtttatgaaatgaaaaaaggagcggttatgatggaaaaaatgcgtcagcaattaatggagtgggggaaggaactagaaacattccgtctgcctcactgggaagaactccctgacttagaactttatatggaccaagtcagaacgttagttgatcgttatctttcacctgtgatacaaggagaaaagcatccattgcttacctcttctatggtaaacaattacgttaaactaggtttgataccagcaccagttaaaaaaagatataacaaagaacacgtagcatttttacttgcaatcactacgttgaaacaagtattgactattcctgaaatctaa

SEQ ID NO: 743 - DNA (genomic), 1182 bp, Enterococcus faecium; double-stranded, circular
  misc_feature (B) LOCATION 1...1182
  hypothetical: NO
  anti-sense: NO
gaggactttctcatgactaaatttactatagaaattatgcaaacactactcaataaaggggatttagatgaattatttcaggatcatttagagcgagcgattaattcacttctacaagcagagctaactgcttttttagattacgaaaaatatgatcgaaatggattcaattcaggaaattcccgtaacgggaattattcacgtacatttaaaacagaatatggcgagttgaatttaactattcctagagatcggaatggcgaattttctcaacaaacactaccagcatataagcgaaccaatgattcattagaaacgaccattatccaattatttcaaaaaggcattactatggctgaaatctccaaattaattgaaaaaatgtatggtcaccactatacgccacaaacaatctccaacatgagtaaattggtggctgaagatgttttagcttttaaagaaagaacgttagaagccaattattccgttatatttatggatgcgacgcatatccctgtgaagcgacagactgtttcgaaggaagcagtgtatattacgattggtattcgtttggatggaaccaaagaagttcttgggtttactattgccccaactgagtctgcttatatttggaaagaagttcttcaagatcttagaaaacgtgggttagaagaagttttattagtagtgacagacggattaagctgtattgaagaaagtatccatagtgtgtatccgaatgcccaatttcaacaatgttgtgtgcatgtatctagaaatatcgctcataaagttcgtgttcgaggtcgaaaagaaatttgtgaggatttcaaattggtttaccaagcgaattcaaaagaagaggcattggatcacatcgactttatgactaggaaatggaaaaagcagtatccaagagtcgtcaatttactcttgaatcctgccctattaaccttttataatttccctcacgccatcagacgaacaatttattcgacgaacctgattgaaggctttaataagcagctaaaacgatatactcgaagaaaagaacaattccctaatgaagaatctctagagagattcttcatttctcaatttaatcaatataaccaaaaatttttaggtagaattcacaagggatttaaagaaattcaggatacattagagtcgatgatttaa

SEQ ID NO: 744 - DNA (genomic), 507 bp, Enterococcus faecium; double-stranded, circular
  misc_feature (B) LOCATION 1...507
  hypothetical: NO
  anti-sense: NO
ataatcgtttacataggagaaaaaatggaggatttaggatctaagctaagagaattaagagtgaaaaaagggtatactcaagaatatgtggcaagaaaatttaatgttacacgtcaaactatttcaaagtgggaaaataacaaaacaacaccagatatagagacactaaaaaaaatttgtgaattttatagtactaacataaattctattttaaatgaagataatttaaaaaataaacaaaataatttactggtattgacagctattatttttaatatatttgttactatattaggtttatttgaattgattcaaatgaatttttttagctttacacacggaatatttacttggtttgctctatctggattaatagtaatagatatcttaaattatttttatatttactattcttatttaaaaaatgaaaaatttttttatacaatattttttcccctagtgattttgattatttggttctgttgcaaagttttaaataaagaataa

SEQ ID NO: 745 - DNA (genomic), 183 bp, Enterococcus faecium; double-stranded, circular
  misc_feature (B) LOCATION 1...183
  hypothetical: NO
  anti-sense: NO
aattcatttctggattcttcatccatacctgttgttggttcatcaagaacaaataagtcagggtcagtagcaaaaatacgcgctaaactgattcgctgcttttgtccgccagacaattcacctattcgccgatttcgcatatcccacatccctacagcttctaaagcacgctgtacatgttga

SEQ ID NO: 746 - DNA (genomic), 448 bp, Enterococcus faecium; double-stranded, circular
  misc_feature (B) LOCATION 1...448
  hypothetical: NO
  anti-sense: NO
accatttcttccagaagaaaagcaaaaaatgacaacagaagaatttcgtcaagaaatcttgttgaaaattttcggcgtagagtcagtagaagaagtaaaaacgtacgaattgactgatgaagattggaaaaaaatcaatcgaatctctgaggaatattatcgaaattgggattggaattacgggaagtctccagatttcaatttctctcgccaaaaacgtttttctatcggttcgattgaagtccatttgaatgtctcagaaggaatgatcaaagaagcaaaaatctttggcgatttcttcggactaggagatatctctgacgtggaaaaaaaattggttggacagaaatatgataaagcatctctatcaaaaatagtcagccaaattgatgtgaagaaatattttggtgcgatagaaccagaagaattgcttaccttactttattga

SEQ ID NO: 747 - DNA (genomic), 210 bp, Enterococcus faecium; double-stranded, circular
  misc_feature (B) LOCATION 1...210
  hypothetical: NO
  anti-sense: NO
cgcacctcttatattataaaggtggttgttgatctctgtttcaaatccttctccccaaatgctttcccctccagtgccatcgcctttaggatcgccaccttggatcatgaaatctttgatgacgcgatggaaagtcagtccgttgtagtaaccgtcttttgcatgtgtcataaagttttcaaccgcttttggtgcgtgttcgggaaataa

SEQ ID NO: 748 - DNA (genomic), 870 bp, Enterococcus faecium; double-stranded, circular
  misc_feature (B) LOCATION 1...870
  hypothetical: NO
  anti-sense: NO
aggagatttctaatgaaaaaacttaaattattcttaccaataataggattagctattcttttatcaggctgttcaaagtggattgatcgaggagaatccattacggctgttggctcttctgctttacagcctttagtaaaaacagttgctgaaacttaccagacagaaaatcctggaaaattcatcaatgtacaagggggcggaagcggaactggtttgtctcaagtacagtcaggagcagtcgacatcggaaactctgatttgtttgcggaagaaaaatcggggatcgatgcctcagcattagtcgatcatcgagtagcagttgttgggatcactcctattgtgaacaaggatattggcgtaaaagacatcagtatggaaaacctgaaaaaactatttacaggcgagatcaaaaactggagtgaagtcggtggaaaagatcagccagtagttatattgaaccgcgcttcaggaagcggaacccgtagcacgtttgaaaaatgggtattggacggagaaacagctgttcaggcacaagaacaagattcaagcggaatggtgcgccagatcgttgccgacacacccggtgcaatcagctatgttgctttttcttatgtttccgatgatgtagatacgttgaatgttaacggtgtagaaccgacagatgaaaatgtgacaacgaacaaatggacgatttgggcatatgagcatatgtacacaagagatcatccaaaaaaactgacaaaagaatttttagactatatcttatctgatgaagtacaagataacatcgttggagaactaggttatatccctgtttctcatatgaaagtcgaacgtgattggcaaggaaatatcgttaaagagtaa

SEQ ID NO: 749 - DNA (genomic), 345 bp, Enterococcus faecium; double-stranded, circular
  misc_feature (B) LOCATION 1...345
  hypothetical: NO
  anti-sense: NO
gaaagatcttatccttccatgttatccgggggacaacagcaacgggtggcaatcgccagaggtttagcgatgaatcctgagatgctgctgtttgatgaacctacttctgctttggatccggaaatgattggtgatgtattagacgttatgaaaaaattggctcatgacggtatgtcaatgattgtcgtgacacatgaaatgggctttgccaaagaagtggcggatcgtgttatcttcatggctgatggagaagtattggaagacagcagaaatgtgagagactttttcgaaaatccaaatgaagtccgagcacagcaatttatcagtaaagttatcaatcattga

SEQ ID NO: 750 - DNA (genomic), 210 bp, Enterococcus faecium; double-stranded, circular
  misc_feature (B) LOCATION 1...210
  hypothetical: NO
  anti-sense: NO
tcactaccttataatcttccgtgccagaaactgttgcggacaagtacttgcttgtatagttcaaatgacggacaaaaccgtgcagatgatagctgtaaccgcgttccaaaacgttttcaggaaaatactcaagccaattattcatctagttctcctttcatgaaacacttatttatatttagtataaagaaacgtttaagaaaaaagtag

SEQ ID NO: 751 - DNA (genomic), 237 bp, Enterococcus faecium; double-stranded, circular
  misc_feature (B) LOCATION 1...237
  hypothetical: NO
  anti-sense: NO
acgtggtttcttttttactatctgtttccagaagctgaggtgctgctggatggtgtatggtcatttgcagcatccgctccgctagttgctggctcactggaagaagcaggaggagcagatgaagacggtgtcgagctttcttcggatgaagaagaaggaaccgttgttgaagacgctggctcgcttgtttctgctgtcgtgctttcttttgaggactcagcagttgattcgctttga

SEQ ID NO: 752 - DNA (genomic), 483 bp, Enterococcus faecium; double-stranded, circular
  misc_feature (B) LOCATION 1...483
  hypothetical: NO
  anti-sense: NO
ggcggtgcttattatttgttaaagcactgtagaaaaggattttgtaaagtaattaaaggtaaaaatgctgctgatttaatctttgaatggaaagaatctaatttaattaatgtacgtgggaaaaatggaagcggaaagacagaaagagtgatggctagtattgataattcaaggcctagatcaagagcattagtaataactgatgaaaaaaatcactataaaggcatacgaacgatagaaaaaaaatatttaactaacaatgatttaaaagtagtagatgatattttaaatatttatcctgattttaatttagttgtttttgatgaaacaattcctgtgacagaaataaaaggattctatcaaagcttttccaatctagcaaataaatatgaggaagttctgtttgtttggattacagaagaagatagtaatagcaagtcagcgttctttagtgaaaagaacgcttttttacattctatttaa

SEQ ID NO: 753 - DNA (genomic), 231 bp, Enterococcus faecium; double-stranded, circular
  misc_feature (B) LOCATION 1...231
  hypothetical: NO
  anti-sense: NO
agcggagcttataaggaagttccgcccgaacaagaaagaaatttcttgccaggccatggcgcgagagattgccccagcagagaagccgcaaaagaaagccttgagagccctagaatgggcagggtaattcccaaaagtagcgcagcttttcagcggaataatcccgcggtggtgggaggaaaaacgggaaccgtatggacagtacaagacattgcggcaggatatgattaa

SEQ ID NO: 754 - DNA (genomic), 744 bp, Enterococcus faecium; double-stranded, circular
  misc_feature (B) LOCATION 1...744
  hypothetical: NO
  anti-sense: NO
catatggcttatgaaacatttgctttcatttacgatgaagtgatggacgaaacactttatcagcaatggttagctttttcgaaacgtcatttacaagaagacacaaaaaatattttggaactggcatgcggtactggagcattagcggttgcctttgcaaaagatggatataaagtgacagggttagacctttcagaagagatgttgatgattgccagccagcgagcatatgaagaagacgcatcgatccaatttgtggaaggcaatatgctcgatttatcagaaatcggacaatatcaggcaattacctgtttttctgattcgctgtgctatatgaaaaatagacaagaggtacagcaagtgtttgatgaagtctatcaagcgttagaagaaaatggccgatttttatttgacgtacactccacctatcaagtagatgaggtttttccagaatatagctatcattatcaaggggataattttgcttttttgtgggatagttatccaggaagcgagaaacacagcatcgaacattttcttacctttttcgttgaagaacaagaagggtctggtcgatttattcgtgaagatgaactacatcaagagcgtacctatccattggaaagttatttaagaatgctggaaaacagcggcttttcgaaagtcgaagcattttctgattttacagacgaagcagcatcagagaaatcaaagcgctggttctttgtagcatacaaagactag

SEQ ID NO: 755 - DNA (genomic), 2454 bp, Enterococcus faecium; double-stranded, circular
  misc_feature (B) LOCATION 1...2454
  hypothetical: NO
  anti-sense: NO
gaggtggcttacttgaaagaagtcgttatgatagatgctgcaagaacgccgataggaaagtatcgcggaagtttaagtccatttactgcagttgaattaggcacacttgtgactaaaggattattagataaaacaaaactgaaaaaagataaaatcgatcaagtaatatttggaaatgtcctgcaagctggtaatggtcaaaatgttgccagacagattgctttgaacagcggtctccctgtagatgtcccagcaatgacgatcaatgaagtttgcggatctggtatgaaagcagtgatcttagcacgccagctgatccaattaggtgaagcagaacttgtgatagccggcggaacagagagtatgtctcaagcacctatgctgaaacagtatcagtcagaaacaaatgaatatggtgaaccaatttccagtatggtcaacgacggattgactgacgcattttcaaatgcacatatgggattaaccgcagagaatgttgcaacacaattttctgtgagcagagaagagcaggatcgctatgccttgtcgtcccagttgaaagcagcacatgctgtcgaagccggtgtattttctgaggagatcatcccagtcaagatttctgatgaagacgtgttatctgaggatgaagcagttcgtggaaatagtacattggaaaaactgggcacgttacgtacagtattctcagaagaaggaactgtaacagcaggaaatgcttccccgttgaatgacggtgcctctgtggtgatccttgcatccaaagaatacgcagaaaataataatctgccttatttagcaaccatcaaagaagtagcggaggtcggtattgacccaagtatcatgggaatcgctccaatcaaagccattcaaaaattgacagatagatcaggaatgaatttatcaacaatcgatctttttgagatcaatgaagcatttgcagcttcttctatcgtagttagccaagaactgcagttagatgaagaaaaggtcaatatatatggaggagcaatcgcattaggccatccaattggtgcaagcggtgcacgtatcttgactacattagcttacggattgcttcgtgaacagaagagatacggtattgcttcattatgtattggtggaggtttaggcttggcagtcttgttagaagcgaatatggagcaaacacataaggatgtgcaaaaaaaaaagttttatcagcttacgccatctgaacggcgcagtcaattaatagaaaaaaatgtattgacacaagaaactgcgttgatttttcaggaacaaacactttctgaagagctctccgatcacatgatcgaaaaccaagtgagtgaagtggaaatcccaatggggatcgcgcagaattttcaaatcaatggcaagaaaaaatggattccgatggcaacagaggaaccatctgtcattgcagctgcaagtaatggtgcaaaaatctgtggaaatatctgcgcagaaacacctcagcggctgatgcgagggcaaatcgttctatcaggaaaatcggagtatcaagcagtgatcaatgcagttaatcatcgaaaagaagagctgattctttgtgcaaatgaaagttatccttcaatcgtgaaacgcgggggcggtgttcaagatatctctactcgggaattcatggggagtttccatgcatacttatctattgattttttagtggatgtaaaagatgcaatgggcgctaacatgatcaactcgattcttgagagtgtggcaaacaagttacgggagtggttccctgaagaagagattctattcagtattttaagtaattttgctacagaatcattggcttctgcctgttgtgaaatcccattcgaacgcttagggagaaacaaagaaatcggtgaacaaattgccaaaaaaatccaacaggcaggggaatatgcgaagcttgacccttaccgtgcagcaacgcacaacaaagggatcatgaatggtatagaagctgtagtggcagctacaggaaatgatacacgtgcggttagcgcttcgatccacgcctacgcggcaagaaatggattataccaaggattaacagactggcagatcaaaggggataaactagttggaaaactaacggtgcctttggctgttgccacagtaggcggagcttccaatatcctgccaaaagcaaaagcatctttagctatgttagatattgattcagccaaggaactagcacaagtaattgctgcagtagggttagctcaaaacctggctgctttgcgtgcattagttacagaaggaatccaaaaaggccacatgggacttcaagctcgttcattagcgatctcaattggggctattggtgaggaaatcgagcaagttgcgaaaaaattacgtgaagcagaaaagatgaaccagcagacagctatacaaatattggaaaaaatccgggaaaaataa

SEQ ID NO: 756 - DNA (genomic), 234 bp, Enterococcus faecium; double-stranded, circular
  misc_feature (B) LOCATION 1...234
  hypothetical: NO
  anti-sense: NO
tgtttgaatttttttggtgatagattttttcagccgtataaaataaatcgtaattctattatagagagttgtgattataaaaagatagcaagaaaaaaaaagaaagtttctatacattttaaatattttattcctatttctattgctaaaaaagtagaaattctatatttacctttaactctcgcttctcttgcaaatgtagttagcattttaatcgataataaactcaggtag

SEQ ID NO: 757 - DNA (genomic), 1545 bp, Enterococcus faecium; double-stranded, circular
  misc_feature (B) LOCATION 1...1545
  hypothetical: NO
  anti-sense: NO
gttgtctattatcaaatgcatctactaggagggatgcaaaatatgaattttatgaaacgtgcatggaaaagtacaaaagtaaaatggggacgttcattgttattgtttgccgtgttcacagccattcttatttttgtgctagctggcctcacgattcgaagcgctgcagaagaagcagcgaatcaagcacaaaaagaagttggagcaacagtgactttaagtgccaatcgagaagcttcatttaaaaaacaggaacaaacttcttcaagcggttctaccactgaagaacgtccagatccaggcagtttttctcttacaccagtttccttaacggacgcggaaaaaatagctgaattagataatgtaaagagttattcctttgaaagttccgcctcagctatggcaaaagatggaataactgccatcactagttctgattcaagtgaagacagttcagaaactactgatgcaggcggtgaacctgctggaggaatgggcgggaatccgcaaatgactcaagcagactttcaaatcagtggtgtgtcagcaactgcacaaaatagtaatttttctgatggaacagcaaaaatcacggatggtgaaggaatagatgacagcgacaaaggcacaaacaatgtagtcattgattctactctagcagaaacaaatgacctggcagtcggagatactttcacaatcacgagtactgaagatgaagataccacttatgaaatgacgatcaaaggaatttatgaatccagcgaaacaagcggcagtatgggtatgaaattcaacttcatgaatccgtcgaatacactttacacttcttacacttttgcaaatgaactaaatgggacatctgacgataacacgatagattctgctatttacactctatctgatccagataaaatggatgagtttctcaaagaagctgagaagctgatcgacacagatacatttagcttacaatcaaatgattccatgtatcagtcaatgttggaacctttaaacaacgtggcaagtttttctaaaaatgttgttttactagtggctgtagccggtattatcatacttactctgatcattatgattaccattcgggagcgtcggcatgagttaggcgtcttgctatctttaggagaatccagaagtaaaatcattctccaattgtttaccgaagtggctatttgtatgattcttgcattaggagttgcttcgcttagcggaaacgtcgtcgcgaatgccgtgggacagcagctacttgaccaacagacagaaaccacgacacaaaaccagcaagctcctggcggtggacaaatgccaggtaacagacaagaacaaggcggtcaacgcgatggtcaacaaggaaccacgaataatccatttgctgtttctgatcaagtcagcgaattggaaatcaatgtcaaacctgcacaattgggactattagccggagtagcatttggaatcagtctgttttctgtctttttagcttctatagggatattaagattaaacccaagaaaaatcctattaaactaa

SEQ ID NO: 758 - DNA (genomic), 693 bp, Enterococcus faecium; double-stranded, circular
  misc_feature (B) LOCATION 1...693
  hypothetical: NO
  anti-sense: NO
ctattccattacgagaaggtgaagcgaatgtttaaaggtgtattattcgacttagatggggtcattacagataccgctgaattccattaccgtgcttggaaaaagctaggtgatgagatcggtattcccttagatcggtcattcaacgaacaattgaagggtgtaagcagagaagattctctgactctccttcttgctcacggaaaaaaagaagagcaattctcaaaaacagaatttctcgaattagcgaaaagaaaaaatgattattatcttgaaatgatccaatcgatcacaccaaaagatgtttttccagggattttagaattattaaaagacttacgggcaaacaatatcaagatttcactagcatctgcaagcaaaaatggccctttcctacttgccaagatgggtctagaaagctactttgatgcgattgctgatccggcaaaagtcgctaatggaaagcctgcaccagatatttttctacttgctgcgaaagaaatcggtttgacccctcgtgactgcatcggaatcgaggatgcaaaagctggaatcgctgcgatcattgctagtggtgcgcaacctatcggcgtaggacgttcagaagatcttggggaggatattccaatcgtacctgatacagcttcattgactttcgattacttgaaaaaaacgtggcagccaaatgcctga

SEQ ID NO: 759 - DNA (genomic), 366 bp, Enterococcus faecium; double-stranded, circular
  misc_feature (B) LOCATION 1...366
  hypothetical: NO
  anti-sense: NO
ttcagccattattgttgtcctccttatccgattaattcttcaactgatttgccgcgaagttctgcaacttcttctgcacgtttcaattgtttcaaaccttcaactgttgcgcgaacaacgttgattggtgtatttgagcctaaagatttagaagtgatatctgctaccccagctaattctaatacggcacgaactggtccaccagcagcaaccccagaaccttctacagcaggtttcattaggattctaccaccactaaaagcaccgattacttcgtgtgggattgttgaaccaaccataggtacttcaactaagtttttcttcgcatcttcaattgctttacggattgcttcaggaacttcttga

SEQ ID NO: 760 - DNA (genomic), 675 bp, Enterococcus faecium; double-stranded, circular
  misc_feature (B) LOCATION 1...675
  hypothetical: NO
  anti-sense: NO
gtaactaattattttgcaggaggacaatttatttacacaaaattattgacgctccctatgttcaatgaaggattgaaagaattaaaaagaacaggcgaatacgataagattattaaagaatatgtagcggatggttcagaaacttccagtgagtcttccactgctgatgaatcaacatttcttggacttatccaaaacaactatcaagcattgttgaaaggactttggagaacaattctcctaactttgatctcctttgctttggctatagtaatcggtgtgatttttggattattcagtgtagcaccaatacgcgctcttcgcacaattgctagtatttatgtcgatatcatccgaggaattccaatgatggttcttgcgttctttattttctttgggttgcctggtatcgttggatttacgattcctgacttccttgctggtgttatcaccttgactcttaacgcaagtgcttatatcgcagagattgttcgaggcgggatcaacgccgttcctgtcggacaaatggaagcttccagaagtttaggtctttcttataatcggacaatgcaaaaaatcattttgccgcaagcgatacgcatcatgatcccatcattcgtcaatcagttcgttatctcattaaaagacacacgatcatttccgcaatcggtgtag

SEQ ID NO: 761 - DNA (genomic), 216 bp, Enterococcus faecium; double-stranded, circular
  misc_feature (B) LOCATION 1...216
  hypothetical: NO
  anti-sense: NO
acgaataattatggatacgttaaaagaattgaaacatcagggggaataacagtgctaattgtgcatcatgatttaagcaaggtaaagaagtattttgataatattattcttttgaatcgaaatctaattgctcacggaagtgtagaatctgtatttaatgaagagaatttaaaaaaagcctatggagatactatatttattggagagggggaataa

SEQ ID NO: 762 - DNA (genomic), 1482 bp, Enterococcus faecium; double-stranded, circular
  misc_feature (B) LOCATION 1...1482
  hypothetical: NO
  anti-sense: NO
ttgagtaattatatttacattttacaaattttatataggaggaaaataattatggattcgggatttttatggaatataacaagtacagtgttggcattatttataccaattgctacatttttatttgaaaatgagaatgctgttgattgggataaaatggtagtatttgatcaagttataaaaataaaaaaactgtcttttggactaatattgttaacattgcctttacttttctatcaaacaaattcagcaagtaatgagttttatagaaaacttaactgtatagtacttcttttatatgtaatcggcataagcttatctattctatcgttagttaggtgctatttttggattattaacaagcgtacttattcaaaaaacaattctagtgaaaccgttaaatatagaacagaatgtaggaaaagatatattagtaacttatccaagaatgaagctgttcagaaagaaatatggtctctcatatggaattcagtggatcaacatggagagatagaagaaatcgatctgatggatatgtatatagatcaatgtgaagaaaataaagactatgaaaaaaaattaaaatttttgtctatctttttcactagtatagacatgaataaatttgatgaaataaatacgtacaatactatcgattatgatgtttatgagcgtttatccaaatttatttattccgaaataaaatgtgtgtatcttgaaggaaagaatatagatataaaaaaagtaaatgattttttcgatatctatacaaaaaactctatttttaattggaattctagtaacagatataatcaattcctatcacaatttttagaagaattatctggagaagaatatagattattcctaaataataatattttaaaattaatatcttatgccaagaaagctaatagcctatctttagtagataacttagataatcttttacccgataaacttatttatgatgagaatgaagataattcacaaaaacaaataattatatttgaattgtatttaaagtggcttagcagcctgtcagtgtcaccagaaagcaatgatgatgataaatattttgcgaacaaactgtttcaatttatatttccagactattcttcaatgccattttttacattaataaattttatgctgtatgttaaagaacacttaggatatgatgatttagtagaaatgataaaggcatatgataaagaaccttatccattcaaaggaatcaatactggttcagatatggctatgatttcaggcgaaactgtagaagaaattctagctaattacaaagaacaaaatataaaaactctggaattaattaaaaagaatataaaatactatgatcctttactagcgaataaagaaaatattgataagttattaaatgcaattgctgattctgatgttagatctcctagaattgatgagttaaaagaagaaattttaatgtataaagaacttttttaa

SEQ ID NO: 763 - DNA (genomic), 462 bp, Enterococcus faecium; double-stranded, circular
  misc_feature (B) LOCATION 1...462
  hypothetical: NO
  anti-sense: NO
gcattcaattacaatgtagtgccaaactttgtacagcaaaaaaatcccgaacaggtaaaaaaagcctttgaagaantaggccccaccttcatcaagataggacagatgctttctgttcgagaagatttgctttcttctgccttcactcaaacattcaaaacattacaagatagtgtacctagcgacacattttcaacggtcaaaaagacgatcgaaacagaactttctctttcattatcagatatattcgatgatttttcaaaatcgccttttgcctctgcttctatggggcaggctcatcgtgccaagctgaagaacggtgacgcggtagtcgttaagatccaacaccctaacatcgccgaagagatccgacttgatcttcaactatttgaacgagcgatccctttgatcaaatacattcctgaaactagcgtagttgatctaaaagggggtccaatctaa

SEQ ID NO: 764 - DNA (genomic), 183 bp, Enterococcus faecium; double-stranded, circular
  misc_feature (B) LOCATION 1...183
  hypothetical: NO
  anti-sense: NO
accgtcaattacaaaagacttatgaaactaaatcaactgaagaatgggagagttattgctagatttttggtagaagtaacaaaaagtggacatattatcataatgactcgccgaaagtctgataaaaaattggctaaaaatattgctgaatgtttaataaaactatcagttttagctaaatag

SEQ ID NO: 765 - DNA (genomic), 1176 bp, Enterococcus faecium; double-stranded, circular
  misc_feature (B) LOCATION 1...1176
  hypothetical: NO
  anti-sense: NO
tcaaaaaattatataagtttgcgtacgattcaaagaaaattaagagaacttaatactattttgaaaaactatcatttatcttgcagcttgaaaaaaggtaatccgatagaaggagaagaataccgtatccgatacttttttcacttgatgtattggcagtcattcgacgaaaatcattctgatatattatcaagtataaaaaataaacgtcaactattagaaaaatttgcgaaacatgcgccatatacgcgtagtatagatagaaagaaatggatcagcctactaagaatttcgttgcaacgaatgaaacaaggccactcgattacgtatgtcccagaagagatgaacaaatttgtgcatccattgataacaaaagaagagtttacgcattacatactagagcctttttttgaagcaaacttctggtcgatgaatcacatcactccaacagagcaagcttacctttattttatgtttggtgtaatgaacacctatttggaagaagatttgttggatactccagataaagtacaagaaagttggggctggattgaatcgtctattgtagaaaattttgaaaaaaacttcaagatttgttttacaacttcagaaaaaaattatctatatgtcaatttggcaatgatccatttgtattcaagggtttttgggacaaaaaagaaggtggatgcttttggaaaatcagcagaagacagagattttcagcatatatttccagtgatgtatccaatcatgcaacagttttttagtggggtagctcgcagaattccagagcttaatacttattatgaaaagaacagacggttgatttttcaatactgtatgttagtcagggatatttttataaaacacgaacaacctgtcatattctatattcaatcaaagtatggtaaaacacaggaattatgggcaaagaaaaggatattatctatgactgaacgcccaataaaatatagtgcatccgctgatcagttacctgatattgtcattagcgattatcctatcgacaaaaaggcatatgatcaaacgaatacacagatattttactggaatggacaacctacaaaaaatgattgggcgcgtctgaaagctgaaatcataaaaatcaggaatgagaaaaatagatccatattggaaaaattggatttcgttaattaa

SEQ ID NO: 766 - DNA (genomic), 231 bp, Enterococcus faecium; double-stranded, circular
  misc_feature (B) LOCATION 1...231
  hypothetical: NO
  anti-sense: NO
aaaaaaaattataataagctaaagactcctgctcaaattgcatcttttattcctattggtggagttggaacatgggttattacaaatgcttttagtagtgctgttgatgcaatgaatgtctttgtaagagctgcaaatcaaggaaaaggtgtacaattaacatataatgctcactttagcaatacaacatcatatcaatacaatgattacgctcgttatgtaataaaataa

SEQ ID NO: 767 - DNA (genomic), 396 bp, Enterococcus faecium; double-stranded, circular
  misc_feature (B) LOCATION 1...396
  hypothetical: NO
  anti-sense: NO
atgaaaaattatccgttacttttgacacctgtcatacgaatgatgccggttataatattaaagaagactttttcaggtgtaatggaagagtttgataagatcatcgggttagatcggcttaaagtactccatatcaatgattctaaaaatccgcaaggttcgcataaagaccggcacgccaatattggttttggaacaatcggattcgacacgctgaataagatcgtccatgatccaatgtttgacaatatttcgaaaatcttggaaactccctatgtaggcaaagataaaaagaaagcttacgcaccatatggaaaagaaatcgccatgttcaaagcgcaaacattcgatccagaagtgtttcctgagttattagcacaagaagtgatactctaa

SEQ ID NO: 768 - DNA (genomic), 462 bp, Enterococcus faecium; double-stranded, circular
  misc_feature (B) LOCATION 1...462
  hypothetical: NO
  anti-sense: NO
ctaatgaattatgagttttttttaagcaaagaagatcacagaagttattcattacttaaatatttagaagcaagctcaaatttatcagagtcaatatcgaatgttcaagaagagttgtcgctatcgacatttctcttgaaaaaaacgatcgataagctgaaacatgatttacaaaagttcgatctagagaaaaatttgcgagtaaccgtcagtgaattggatatatgtctggaaattaatggaaaatgttctagcaaagctctgttatctcgttatataacggattctttatctatgaaaatggtattggctttctttcaggaaaaatatatctcagtagaaaattttgctaaacagcatcacgtgagttattctgtggcttataaagtattacaaagactaaaaagaaatctaaaaaaatatcaaattttttttgaaaagagaaagttgacgagagtataa

SEQ ID NO: 769 - DNA (genomic), 645 bp, Enterococcus faecium; double-stranded, circular
  misc_feature (B) LOCATION 1...645
  hypothetical: NO
  anti-sense: NO
cagcctgattacattggcgatagagaggtgacccgtatggaaaatggttttttgtttttagatgaaatgttgcatggtgttcgttgggatgccaagtacgctacatgggataacttcacgggaaaaccagtggatgggtatgaggtgaatcgcatcatcggcacaaaggccgtggcgcttgctctgcgcgaagcacaaatccatgcggcagcccttggctacggcttgcttttatgggatggatatcggccaaaatctgcggtggactgtttcctgcgttgggcggcgcagccggaggacaacctcacaaaagaaaaatattaccccaatattgagcgagccgagttgattacaaagggctatgtggcctcacaatccagccatagccgtggaagcacaattgatcttacgctctaccacttggatacaggggaacttgtttcaatgggaagcaacttcgattttatggacgaacggtcgcaccatacagcaaaagggatagggaatgcagaggcacaaaatcgaagatgcttgcgtaaaatcatggaaagcagcggatttcagtcctatcgctttgaatggtggcactataagttgattgatgagccataccccgatacctattttaattttgctgtttcataa

SEQ ID NO: 770 - DNA (genomic), 420 bp, Enterococcus faecium; double-stranded, circular
  misc_feature (B) LOCATION 1...420
  hypothetical: NO
  anti-sense: NO
ttgaaagattatctaaagtcattatcacgaattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagagaagtgaatcagacatttattttcagtgtcagcaatcaacgtaatcatattccaagaaaatcattgaattacagaacaccaatcgaaatatttttgagctatgtacaagaagcattttattctagcttaatttga

SEQ ID NO: 771 - DNA (genomic), 1968 bp, Enterococcus faecium; double-stranded, circular
  misc_feature (B) LOCATION 1...1968
  hypothetical: NO
  anti-sense: NO
aaagaagattatgatagggtttatcgaaagattcggnggatggncctagggactgcactctacagaaaatccacaaaaaatgtctgcaaagataaaacaaaaggattttcctgcagctggaagcattcatacgaattcattatagaaagtaagatgttttttatgtgcggaattgttggaatgattggattaaaaaatgtaacaccaggattgattgacggtctagaaaaattagaataccgtggttatgattcagctggtatctttgtctcagatggcacaactgattatctggtcaaagcacaaggcagaattcaaaatttgaaaaacaaaataaatattgatactacaggaaatataggtattggtcatacacgatgggcaactcacgggcaaccttctgaagaaaacgcccatccacatacttcccaaagtggacgcttcgtgctcgttcacaacggcgtaatcgaaaactttgaagaacttaaaattgcttatttagcaaatgaccactttattggtgagaccgatactgagattatcgctcatctaattgaaactttcgcgaaggatactacaacgcaagaggcgtttttaaaagctttgcgggtcatcaaaggttcttacgctttcgctttgattgatcggacagcacctgatgttatttacgtcgctaaaaataaaagtccactattaatcggactcggcgatggattcaatgtgattgccagcgatgcaatggctatgcttgctcatacgaaggaattcgttgagattgaagatgaagagatggttaccgtcacatcagaaaaagttattattcaaaattttgcaggtgacatcgtagaacgttcttcattcgaagcacaagtagatgcttcagatatcgagaaaggtacctatcctttttatatgctgaaagaaatcgacgaacagcctattatcatgcgtcgtatcgctcaaaaatacgtaacagaagacaatcgtgtctctcttgatcaaaagctggtcgatacattgtctgatagcgatcgaatctatatcgttgcttgcggaactagttaccatgcggggttagcaggtaaacagactttggaaaaattgacacagattcctgttgaggttcatttagccagtgaatttggctataacacacctcttctttcaaaaaaaccattctttattttcttgagtcaaagtggcgaaacagcagacagccgccaagtgctggtaaaaatcaaccgtctcggctacccttcacttacgattacaaatgttgctggttctactctttcgcgggaagcatcctttacactgctattgcatgctggacccgaaatcgcagtagcatcaacgaaagcttatactgcacaaatagctgtactaactttattagccaaagctatcggtgataaaaaagaatttgaaacttctcttgtattcgatatcactcatgaattgagtttagttgctaatgcgatggaatcggtcatcgcccaaaaagattatttagaagagttggcagaagtatatctcagcgatacaagaaatgccttttacattggacgtggtgctgactacaacgtttctcttgaagctgctttgaaattgaaagaaatcagttatatccaggcagaaggttttgccgctggcgaattgaaacatggaacgattgctttgatcgaagaaggaacaccagtgatcggaatcatcagtgaagaagtgactggtgcgcatactcgaggaaacctgaaagaagtcgaaagccgtggcgctaaaacactagttattgtctcagagggattagaaaaggaaagtgaccagctggtgctaccaactgtccacccttatctaactactctaaccacagtcgtaccgactcaattacttgcatattacgcaacgctattacggggattcgacgttgacaaaccacgtaatttagcgaaatcagtgacagtagaataa

SEQ ID NO: 772 - DNA (genomic), 1038 bp, Enterococcus faecium; double-stranded, circular
  misc_feature (B) LOCATION 1...1038
  hypothetical: NO
  anti-sense: NO
aaattggattacttaaaaaggttgttagtaggtaagcctttaaaatctgctgaaaatgatgagcacaaattaacccgatttgctgctttggcattattgtcgtctgatgcgttatcatctattgcatatggtacggaacaaatcgttgtcgttttagtcgctttgtctgctgcagccatctggtattcgctacccattgccgcttttgttattattttattgatttcattaacgctatcatatcgtcaaatcatccatgcttatcctcatggcgggggagcatatgtcgtcagcagtgagaatcttggaaagaatgctggcttgatttccggtggctctttattgatcgactacatgttgacagtagcagtatctgtctcagcaggtgctgaagcgatcacatcagcggtgccagcactctacggtcatcaagtcgctatttctgtgacaatcgttttgctactgatgatgctgaatcttcgtgggctgagggaatctgcatcgttcctattatttccggtgtacacatttatccttgtgatctcgttactgatcgttgttggtttatataatatcgtgacaggtgctgtgccattgcaagctactgcacttccaggagcggctgtgccgggtgtttctatcgctttgattttacgagcattttcttctggttcttcctctttaactggggtggaggcgattagtaatgctgtaccattctttaagaagccaagagcaaaaaatgccgctgctacattgacgatgatggcattgatcttaggtttcttcttcgtggggatcacatttatcaactattggtatgggatcgttcctgaaaaagaagtcactgttttgtctcaaattggtaaagctgtctttggacatggtattttgtattacgtccttcaatttgctacagcgctgattttagcagttgctgctaacaccggttttttctgcttttccagttcttgcatacaatctgggcaaaagataaattcctgcctcacatgtatcaagatcttggggatcgactag

SEQ ID NO: 773 - DNA (genomic), 303 bp, Enterococcus faecium; double-stranded, circular
  misc_feature (B) LOCATION 1...303
  hypothetical: NO
  anti-sense: NO
aacatggattatactgttgaatttgacagtgaactacttaagcaatttccacaagaagaacatttcatgtataaagaagcaatttcccacaaagtgacagagtatttggagcataatttttttcgtataaagccagtgcgtactcgttcggcaaaaggaatatacgagatgaaagtcaaaattaataaaaaaaattatcgcatagcatttgctttaaaaaaaaatcatgtgttcattttttatattagttcgaatttgcaaaaaattgtatttgataaagaggtgagtaaaaaaataaaatag

SEQ ID NO: 774 - DNA (genomic), 258 bp, Enterococcus faecium; double-stranded, circular
  misc_feature (B) LOCATION 1...258
  hypothetical: NO
  anti-sense: NO
ccagtacttcttgtccagcttcgatcagtgtacggcagatgcttccgccaaatcgtccaaggcctacaattgcaaaattttgtttcaccattttcctcctttagtatcttcttttctcagtataacaaagcctttccaaaaacaaaagcaagcatcattattgtaaaaaagccaagaaaaataatagttattttctcagcttttgattatcctctttatcatcgtttttatttcaccaaaccatgtttaaacgcatag

SEQ ID NO: 775 - DNA (genomic), 390 bp, Enterococcus faecium; double-stranded, circular
  misc_feature (B) LOCATION 1...390
  hypothetical: NO
  anti-sense: NO
ctattttgttactttaatttttatttgcttattttagaaaaaatgttattcttttatttattctcaatgttaggagtgattattttgccatttattgcgattttattcgatttagttgcggcagcagcttattttctccaattaaattatcaaacctcaggaattctgtttattggaatgatttttcaaggtgtgattacccttttgcttcttgtcatgatgctcagctataaaggaaaaagatatgcccgtattcaaacaaaagtatttgttaaatatgtttccattcgctatgggatcatcattctttcctttttagtgaatgcgatcgtcctctttttatatgtattgaattacttagatatcaatccattgattttttctcgatag

SEQ ID NO: 776 - DNA (genomic), 723 bp, Enterococcus faecium; double-stranded, circular
  misc_feature (B) LOCATION 1...723
  hypothetical: NO
  anti-sense: NO
ataattcgttattttgtcattaaatgtcatgtttcttttacctatgaaatatttctaaatgataaagttaatagcgtcgaaagaataaaaaacggagaaaaaaaggagtttaatatgaattcatttaagaaaattgttttaggtacaacttttgctgctggtgctactgcaatgtttgtaggaactacaaatgctcacgctgatgaagtttatacagtaaaatcaggtgattcattatctaagatctcacaaaaatttgcaggagacaactcaatgatcgatgcaattgctgaaaaaaattcgatcgcaaacatcaaccgcatttatgttggtgaacaattaacaatcccaacttcaaatgattcttcagcaacaacagaaaacaaaacaacagaaaatacagcatctacaactgaaacagcaacgcaagaacatacatacgttgcacctgttgaaacagttgaagtagctcctgctgccccagctgctgcaacagcgccaacttcaagctctgcaaaagaatggatcgcacaaaaagaatcaggcggttcatacacagctactaacggacgttacatcggccgttatcaattagatgcttcatacttaaacggcgactattcagctgccaatcaagaacgtgtagcagaacaatatgtaacatctcgttatggttcatgggatgctgctaaaacattctggttagcaaacggctggtactaa

SEQ ID NO: 777 - DNA (genomic), 990 bp, Enterococcus faecium; double-stranded, circular
  misc_feature (B) LOCATION 1...990
  hypothetical: NO
  anti-sense: NO
gtattgcttctttccgtttttttgctattattaaataggagaaatcacaaaggagcgaatgacatgtcaaaaattttagtttttggtcaccaaaatccagatacagatgcaatcggggcagccattgcgttttcacacttgcaaaatgaattaggtaaagaaacagaagcagttgctctaggtacacctaatgaagaaacacaatacgcattagaccactttcagctatctgcaccacgagtagtagagtcagctaaagcagaaaatgcagatgtcatgcttgtggatcataatgaattccaacaaagtatttcagatatcagcgaagtaaatattttagctgtagtagaccaccatcgtattgcaaactttgaaacagctaatccattgtactatcgtgcagaaccagttggatgtacaagtacgattattttaaaactatataaagaaaaccaagtaacaattcctaaagaaatcgcaggaatcatgctctcagctatcatttcagatacattgttgttcaaatcaccaacatgtacgcctgaagatgaagcagctgcaaaagaacttgcagcaatcgctgaagtcgatctaaacacttatggacttgaaatgttgaaagcaggaacaaatctaagtgataaatcagctgcggttcttcttgatttggatgcaaaaagtttcccaatgggcagttccaacgttcgtatcgctcaagtcaatacagtggaccttaatgaagtgatggatcgacaagcagagctagaagcagcaatggaagatgaaatgaaagcaaatggctacgatctgttcgtattagttgtcacaaacatcttagacagtgattcagaattacttgttgctggtaaaggaaaagaaaaagtagaagaagctttccaaacaactttgaccaacaaccgtgctttgcttaaaggtgtcgtttcacgtaaaaaacaagtcgtacctcaattgacggctgtatttagctaa

SEQ ID NO: 778 - DNA (genomic), 609 bp, Enterococcus faecium; double-stranded, circular
  misc_feature (B) LOCATION 1...609
  hypothetical: NO
  anti-sense: NO
gccgtccgttataaagtaaggataaaaggagggagcaaaatgacaagcctcatcgaaaaacaaatcgtcaataaagagattcgagtaacggatccgctctttgaagtgatccatcagatccaagctgaaaacgaagagcctttagcagcgctgaatactgggtaccatgaaccagcagatatccgcaaacggctagaaaatatcattagtgacaaagtagatgatacggtgactgttctgctgcctttttatacagatttcggcaaacatattagtatagggaaaaatgtctttatcaatcgtcaagtgatgttcgttgacttaggtggcatctgtttagaagattcagtattgattggtcctcgtgtcaacctcatcacggtgaaccatctaaccgatccaaaagaacgaagaggcttgtcagtaaagccaatccacatcaagaaaaatgcttggatcggagcaggagcaactattctgccaggcgtaacgattggcgagaatgccattgttgcagcgaatgcaactgttacgaaagatgtcccagacaataccatcgttgcaggaatccctgccaaaatcgtcaaacctgtcgaacggattatttga

SEQ ID NO: 779 - DNA (genomic), 267 bp, Enterococcus faecium; double-stranded, circular
  misc_feature (B) LOCATION 1...267
  hypothetical: NO
  anti-sense: NO
ggagtccgttacatgattacgttggtgagagttttgttttgggtgcctgcggtcgcactggtcgcaagtattgtttatcttatgaattggaacaaagaacggttttatttagctattttgactcttccggctatctactttatgtggaaagtttttaattacaactactttgaacccgatagtgtttttatagaagaattatcaggactggttttgtctttattgatcgtcattctttatttgatacgtttaaataaaaaacattga

SEQ ID NO: 780 - DNA (genomic), 246 bp, Enterococcus faecium; double-stranded, circular
  misc_feature (B) LOCATION 1...246
  hypothetical: NO
  anti-sense: NO
atttcgcttctttccgcatcttctgggaaaggtgtttctaaatcgatcgtatctcctagtacgttgaatacgcgacctaatgtttctttacctacaggaacagagattgctttgcctgtatcaatgacttccattcctctttgtaaaccatctgttgattccatcgcaatggtccggatcactccgtcccctaattctaacgctgcttcaagaacaacttttgatttattttcgtcatttttataa

SEQ ID NO: 781 - DNA (genomic), 282 bp, Enterococcus faecium; double-stranded, circular
  misc_feature (B) LOCATION 1...282
  hypothetical: NO
  anti-sense: NO
aaccagcttctctatcctctcttcatatcttcgcccattcttacacccatatcccccccacattttttactatggggcccttccaataccgcccttaccttcttctaccccctcttttctaagtctttgatcgtattaagcacttcgccaaccatttcagggtctaacgccgaagtaggttcgtcgaatagcaatacatctggattcattgataatgcccgagcaattgcgacacgctgtttctgtccaccaaataattgtgctggtttggcttcgatataa

SEQ ID NO: 782 - DNA (genomic), 234 bp, Enterococcus faecium; double-stranded, circular
  misc_feature (B) LOCATION 1...234
  hypothetical: NO
  anti-sense: NO
aaacagcttcttatgtttttaatttggttgggcttattaccgcagatgcaagcttttaaacaccgtttatcaagaggttgtgacaactgcgctatgcttcgagtagtaagaatgatgggtagaaagcagccttacatctctcttccaaaagttaagatatcaaaaaggatagaacttgattttctaagtcaagttctatccttttattatagaattcaaagaaaaagcccataa

SEQ ID NO: 783 - DNA (genomic), 1389 bp, Enterococcus faecium; double-stranded, circular
  misc_feature (B) LOCATION 1...1389
  hypothetical: NO
  anti-sense: NO
cgatttagttattacggtatgcgtgcattacttatctattatatgtacgatacagttgccaacgggggacttggattaccacgagcaacagcattagctatcatgtcgatctacggatctttgatctacatgtctagtatcgtcggcggatgggtatctgaccgagtgttaggagcaaaacgcactgtattcttcggtggagttttcattatgcttggccacatcgtcttggctttaccatttggtgtaagtacattgtttgtttcgatggcattgattattatcggaaccgcctttttgaaaccaaatgtttctggcatggtcggacatctttattcaaagactgacttgcgaagagatgcaggattttcgattttttacatgggtgtcaacttaggggcattattagcaccactaatcgttggtacaatcggtcaagaatataactatcatttagggttctctttagctgctattgggatgttctttggattattacaatacatcatccaaggacgcaagacattagacggagtgggtacaacaccgccgaatcctttgacaactgaagaacgtaaaggattcatccgtaacttgatcatcgcacttgttgttatcgctgcagtattcggcggggcacaactaactggtcatctgacaattgacttttttgtcaatacaatcagtgtattggggattatcttaccgttgtattactttatcaaaatgctgacttcaaaagatgtaactgctgaagaaaaaccaagagtatgggcttatatcccattattccttgcagcaatcattttctggtcattacaagaacaaggttcatctatcttagctttatttgctagtgaacgtacacaatctacgctatttggtgtaacgatccaagcaagctggtatcaatcattgaatccaattttcatctttattctgacaccagtattcgtaacgatgtggacgaaacttggtgaacgtcaaccatctacagtagtgaaattctctcttggacttttatttgcaggattatcgtacttgctattgatgttgccgggtatgctttatggtacaagtggaaaagtaagtccattgtggttgttgggaagtttcttcatcgtggttattgctgaattgtgtctttcaccagttggtttgtctgtgacaacaaaattagcaccacgagcatttgaatcacaaacaatcgctatttggttcttagctgatgcttcttcacaagcaatcaatgcacaaattgcacgcttctacacaccgggaacagaatctgcttacttcggtattatcggtgcagtagcaatcgtcggtggtatcttgctatttactgtgaaagaaccaatcaaaaaactaatgggctctattcattaa

SEQ ID NO: 784 - DNA (genomic), 936 bp, Enterococcus faecium; double-stranded, circular
  misc_feature (B) LOCATION 1...936
  hypothetical: NO
  anti-sense: NO
agaagaagttattcgtttaagagcagagaacgcatatttaaaaaagttagaaaccttgattcaagaacaagatttgagcaagaagaaatcaaggttaaaacaatccttcagctcaaaaaagaatttaaattgaatctattactttcaattgcacaattagcgaagtcaacttattattactgggtaaaaaaattagataagccagataaatatagcaagataaagcaagaaattacagcgattgtaaaagaatcaagaaactcttatggttatcgtagagtcactttagcgtttaagatgaaaggatatacaatcaatcataaaacagttagaaaattaatgtcccaaatgggacttacctgtcaaatccgaataaagcgatataaatcttataaaggaacagtaggaaaaattgccaagaatgtgttaaaacgaaatttttcagtagatacacccaataaaaaatgggtgacagacgtcactgaattcaagataaaaggaagaaaaatctatctatctcctatacttgatttatttaacggagaaataattagttatagtatatcaactagtccaacatataaactgattgaagaaatgcttcaacaagcaattaaaaaaaagggaactgagggttcactgattctacattcagatcaaggatggcagtatcagatgccacaatatcaaaaaaaattaaaagagaataacattattcaaagcatgtctagaaaaggaaattgcttagataattctgtaatagaaaatttttttggtgtgcttaaatcagagtttttttatcgagaaaaattccgatcaattgagatatttcaaagtaaattaaatgagtatattaggtggtataataacaaaaggataaaactaaagttaaatggactatctccagtagaatatcggaaacagtccattaaatag

SEQ ID NO: 785 - DNA (genomic), 936 bp, Enterococcus faecium; double-stranded, circular
  misc_feature (B) LOCATION 1...936
  hypothetical: NO
  anti-sense: NO
agaagaagttattcgtttaagagcagagaacgcatatttaaaaaagttagaaaccttgattcaagaacaagatttgagcaagaagaaatcaaggttaaaacaatccttcagctcaaaaaagaatttaaattgaatctattactttcaattgcacaattagcgaagtcaacttattattactgggtaaaaaaattagataagccagataaatatagcaagataaagcaagaaattacagcgattgtaaaagaatcaagaaactcttatggttatcgtagagtcactttagcgttaaagatgaaaggatatacaatcaatcataaaacagttagaaaattaatgtcccaaatgggacttacctgtcaaatccgaataaagcgatataaatcttataaaggaacagtaggaaaaattgccaagaatgtgttaaaacgaaatttttcagtagatacacccaataaaaaatgggtgacagacgtcactgaattcaagataaaaggaagaaaaatctatctatctcctatacttgatttatttaacggagaaataattagttatagtatatcaactagtccaacatataaactgattgaagaaatgcttcaacaagcaattaaaaaaaagggaactgagggttcactgattctacattcagatcaaggatggcagtatcagatgccacaatatcaaaaaaaattaaaagagaataacattattcaaagcatgtctagaaaaggaaattgcttagataattctgtaatagaaaatttttttggtgtgcttaaatcagagtttttttatcgagaaaaattccgatcaattgagatatttcaaagtaaattaaatgagtatattaggtggtataataacaaaaggataaaactaaagttaaatggactatctccagtagaatatcggaaacagtccattaaatag

SEQ ID NO: 786 - DNA (genomic), 210 bp, Enterococcus faecium; double-stranded, circular
  misc_feature (B) LOCATION 1...210
  hypothetical: NO
  anti-sense: NO
tgggcaggttacccacgtgttactcacccgttcgccactcctctttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaa

SEQ ID NO: 787 - DNA (genomic), 210 bp, Enterococcus faecium; double-stranded, circular; identical to SEQ ID NO: 786
  misc_feature (B) LOCATION 1...210
  hypothetical: NO
  anti-sense: NO

SEQ ID NO: 788 - DNA (genomic), 534 bp, Enterococcus faecium; double-stranded, circular
  misc_feature (B) LOCATION 1...534
  hypothetical: NO
  anti-sense: NO
atcagtattcttttcctattttctggagaagaaaaagcgaggcgagttgtcatggtaacattctttacggttctattgtttttattcgttgttgtgatgtttttatttctttggctggttcgaaaagaaattatttatcggactgtgcgaaatcgatgggtctacttggtgatacctttcttagtgtcactagtcatttggtatacactcatcagtcatcctacagcagatgaattggcaaaagggatcttgtcagcaatgatttttattagttttttgttggacagtagaggaatcacagaagaaggacttgttttgaatagctttgacaaaaaaggtgttcctttttctgagatcaataaaattgtattatatcagccaaaaggttctaaaatcgtaaaaatgaattttttccgaaacggatggcgaggaccgatgctgaaattttctgcatcattagaagaattagttccatttttgtcccaacgcttaaacgatgaggcagagattgatattatgattgatccagaataa

SEQ ID NO: 789 - DNA (genomic), 978 bp, Enterococcus faecium; double-stranded, circular
  misc_feature (B) LOCATION 1...978
  hypothetical: NO
  anti-sense: NO
aggagcattctcatgtcagaaacatattatgaagcaataaactggaatgaaattgaagatatcattgataaatccacttgggagaagctgacagagcaattttggctagatacacgtatcccactttcaaatgacctagatgattggcgtacattgtctcaattggaaaaagatacagtaggacatgtatttggcggtttgacactgctagatactgtccaatctgaaagtggcatggatcagttgcgtaaagatgtccgcactccccatgaagaagccgttttgaacaatattcaattcatggaatccgttcatgccaaaagttattcttctatttttagtacactgaatacgaaaaaagaaatcgaagaaatttttgactggacaaatacgaatccttatctgcaaaaaaaagctgagcgtatcaatgaaatctacaaacacggtacaccgctagaaaagaaaattgccagcgtctttttagaaacattcttgttctattcaggtttttatactcctctttattatttaggaaacaacaaattggctaacgtagcagagatcatcaaactaatcatccgagatgaatctgtacatggaacctacatcggttacaaattccaattaggattcaacgagttacctgaagcagaacaagaaacgttaaaagactggatgtacaatcttctttatgagctttacgaaaacgaagaacgttatacagaagaattatacgatccaatcggctggacagaagaagtcaagacattcctacgctataatgccaacaaagcattgatgaacctagggatggatccactctttccagatactgccaatgatgtcaacccaatcgtaatgaacgggatttcaacaggcacaagcaaccatgacttcttctcacaagtcggaaacggctatttgttaggtcatgtagaagcgatgaaagacgacgattatttgattggattggaataa

SEQ ID NO: 790 - DNA (genomic), 675 bp, Enterococcus faecium; double-stranded, circular
  misc_feature (B) LOCATION 1...675
  hypothetical: NO
  anti-sense: NO
aggaggaatttgatgttacggacagaacaattgggattttggtatcaagatccgcaagatgcgctttataaagatgtagaactgaatttcgaagctggaaaaatgtacgctattttaggagcaagtggttctggaaaaacgacttttctttcgcttatttctggactagatgcaccaaaagaaggaaaggtatactatcaagatcgttcactgaacaaaatcgggttaagaagttatcgtaaaaatgatgtctcgattattttccaagcttacaacttgcttccttatttatcggctctagacaacgtcatagcagcaatggaaatcactaagaccaagcaagagaattatcgacaagttgctttagatcgactggctcgtgtaggaattgatgaaatattagcaaaaaaacaggtgaccaaactttcgggaggtcagcagcagcgagtcgctatcgttcgtgctatctgctgtgaacatcaactaatcgtagcggatgagcctactggaaatctagatgaaacaacttcacaagatatcgtcaaacttttccaagaaatcgcccatgaacaaaatcgctgtattatcatcgtgactcatgagattgaagtagcaaaaagctgtgatgaagtctttgaactaaaaaataaaaaatttcaaaaaatcgaagtttaa

SEQ ID NO: 791 - DNA (genomic), 213 bp, Enterococcus faecium; double-stranded, circular
  misc_feature (B) LOCATION 1...213
  hypothetical: NO
  anti-sense: NO
tctttattctanggcattaaanatttagctatcaaggaaacgaaccgctatttgcgtatatgggtccacacactggttccgccagtgatcacgacatccttgtattttgttattttcggganaaatgatcggtgggcggatcggagacatgggtggtttttcatatatggaattcatcgttcctggtttgattatgatgtctgctatcactag

SEQ ID NO: 792 - DNA (genomic), 1086 bp, Enterococcus faecium; double-stranded, circular
  misc_feature (B) LOCATION 1...1086
  hypothetical: NO
  anti-sense: NO
ggtgggttctatgtgaaaaaaacgtatcaaaagtttttatggattagctatatcgtcctatttatcgttgggtttctcgtcagtgtgtccgtgatcgtcggaacgctttttcttttgttctctgacgaagatctggtacttaaggggttaatgagtacgttatcgtgtgtcatgttactttatttatgtatacagatcaacgaaattatgccccctcattggcaagaaaagaagaaagaatttaaggaagaaatcgaaataaaatccaatgactggattgaatacacatggcttcctctgaaaagaaatagcaaacgaaaggaattttgggcattgcaattatggccaataggaaaactttttatttatatggcttcacttatggttactttaatcggttatttggtggtggtctatggggtggcctattacttgttaagtgagccaaaacagatcgcggcgtcaaatattttcacggcagtaatgacattaatgtgtgtcatgtgcttttctatttttagttacttactcgtccaatttatcaggcaaaatttaacaatgagtaaacttttcaaaagtttattggacttacttatcttaggcagtatgttaacgactctaacagatcggttcgaacaatctgaaaaaacggtagaggggataaagaacttcttaacgacgattgatcaatttataaatggatatatgtatttgtttgaagtaggctttattctcactttgtttggttgtgtatttataaaactcattaaaagatcaatcgaaaaagaaatggttattgatctaattccgacgctgagcggctatgagtattacgttgattttggaaagtatgaggagttgatccatacggatatcgttcacacgagtatccatgaagtaaccgttaagggcatcagatctactttaaaagatggacaggagacgaaaacaatcgaccgaagaaaagaggtctacaatttttataaagttgaagcaagtctacgatatggcattgggaaattgaggttagatgggagtaatattcaacaaaacaaaccatatgttttaggaaaagtggtgatttag

SEQ ID NO: 793 - DNA (genomic), 408 bp, Enterococcus faecium; double-stranded, circular
  misc_feature (B) LOCATION 1...408
  hypothetical: NO
  anti-sense: NO
caaatgattctgacagtcacactaaatccttcagtagacatctcttatcctctagaaacattgaaaattgatacagtgaatagggtgaaagatgttagtaagacagctggtggaaaaggcttaaatgttactagagtcttgtatgaatctggtgataaagttactgctacaggtttcttaggtggtaaaattggtgaatttattgaaagcgaattagaacaatctcctgttagtccagctttttataaaatctcaggaaacactagaaactgtattgctatcttacacgagggtaaccaaacagaaattttggaacaaggaccaacaatttctcatgaagaagcagaaggctttcttgaccactatagcaatcttattaaacaatcagaagttgtgacaatttcatga

SEQ ID NO: 794 - DNA (genomic), 738 bp, Enterococcus faecium; double-stranded, circular
  misc_feature (B) LOCATION 1...738
  hypothetical: NO
  anti-sense: NO
atgaagattctaatcacagctggaggaacgactgaaaaaatcgatcaagtacgtgctattacaaatcattcgacaggacgattagggcaagcattagctgattatttagctgccaatccggataccacaatcgattacgtgactacgaaacaagcactgaaaccgaaaagacactccaatataacgatttatacgatcgaatctgcactggacttatttttacaattagaagaactaacgaaaaaagaacactacgatgcgattatccacagtatggcagtcagtgattttactcctgcttttagtttttcagaagaacagctggcaaaaaacctacccacttcttcaacgcaagaagaactggacaattggtttgcggaaaatgaacagacagataccactgtttcaaagatctcttctaacaccgagcatcttgtgctcgttttgaagaaaacaccaaaaatcatttcttatctacgtgaatggcagccaaaagcaaaaatcattggtttcaaactattagtagatgtaccaaaggaatctcttctggcagtcgcaaaaaatagtctgataaataacaaaactgattttattttcgcaaatgatttgacggaaatccatggcgagacacaccacggctatctcttatctaaagatggaacagtggaagaagctcaaagtaaatctgagattgctgcattgattactgagaaaattagactggaggaatcaaaatga

SEQ ID NO: 795 - DNA (genomic), 207 bp, Enterococcus faecium; double-stranded, circular
  misc_feature (B) LOCATION 1...207
  hypothetical: NO
  anti-sense: NO
tcaatggtctatcgccaacgatcatccaaacttttatggatgatcctctggctaaacagtcggctacgacacaagttattttgtttttttgccggtatgttcttatttggagtcatactaaaaagtttcatttggtttttcccatggtatttgtattccatggcccctttgagaactaatcagttatattacggtcaaattatttga

SEQ ID NO: 796 - DNA (genomic), 198 bp, Enterococcus faecium; double-stranded, circular
  misc_feature (B) LOCATION 1...198
  hypothetical: NO
  anti-sense: NO
tcttttgttcttctaaataacgttcgacttttgtttgactcatcattgattcactccctttattctatcgtttattataaagcgagggatgctgtattcaaaaattatttgtttttcgcaaaaaaagagcaagacgagcactctatagagaggttcatcttactctttttgtttattttttatttcgacgttgagtag

SEQ ID NO: 797 - DNA (genomic), 1830 bp, Enterococcus faecium; double-stranded, circular
  misc_feature (B) LOCATION 1...1830
  hypothetical: NO
  anti-sense: NO
aagatggcctataaaaaaggaaactggaagccgaaaacgaaagagcaaaaacaaaaagagctagacgatttaattaaggcttccaacagcaaaatcgagcaatatcagtctaaccctgaagatatgatcgagtttgccaagttcatgtctaaaatacacaattacagtcctttaaacctatcgttgatcgatgagggatttgaaggagcaattgctgtagcaagttatgatggttggaaaaaactaggatttcaagttaaagcgaaagaaaaagggataggcatttatgcgcatgctccggtaacggtttttattgatgaaaatggtgaggaaaagacgttaaaagaagcgacaaacgagcaaaaagaaaaaatcaaaaatggagaattaagaagcaaaaagatcaagcattttaagaagggttacgtatttgatatttcccaaactaatgcaactgaagctgatttgccaaaaatatttcctaacagggtatggaattttaatattgatggtgaattaagtgttagtcaattagaaaaaggtgtaaatcatttggccgaatctatgaatatatctataaaagatatgaacgagtctggtagaggtgaaatgggaagcgctagaggtgaatatattcaatatgttgatggtagggaagaaattgtattaaattcaagaaatagcagaacacaaaatcttactaccagtattcacgaattggctcacaaaaagcttcacaataagaatgaacacggttcttcctactcaacaccgattaaagagtttcaagcggaaatgacttcatttattgtttgtcacaattacggtattgatacgtcagactttactattccttatattgcaaattggactaaaaataatgaaaaaattgatccaaaaaactttagacagataatgcaagaagttagagaaacgtctattgactttataagtacgattgataagaaagtcttggaagaacagcaaacagcatttaatgcactaaaaaattcctttgttcctaatgagaataaagagcagatacaacaaaaatcagatttagaatttcataatttctacgatagtacaatcaacgatccggatagaacaatccacggtagttatttagaagcgatggtggattattatagaggaaagtatggagaaaattctattgagcttactcatagcaattatgatgttacagctaaaataggagaaaactatgtgacatattattcagatacgaaacaatttgatgtatgtgatgtttatggtgtagtttttgagaatccaagtgaaaataaacatgatcgtttactattagatcgatcacctgaaaattgtgattatgttgaaaagtttgttgtagaaagtttgaaagcttgcgagaatcatgaactaaaaaatgatacgttaaaattaagcgaaccgctaagatcagttgttataaatgaagcggtttataatctatctgaaaatgctaacaattactataatgaaaaatgctggcaagaagaaattgaaaaccaaacaaatattaatgatgtaaaagaattaaactcttgtatgactgcggaagatttttacgaatctcataaacaagaaatcgaaaatacgattacagattttgaatctgtgtcaggaacaaatttaagagatacaatagacaatgagtcatataaagaggtggcttcagtggtagcttataaactggttgcaactaaagtaaaatatgaaatggatgaaggaactttcaagataccagaaaattctaacttggaaaagccgactgtaaaaacagcagaacgttcttttgaaatggagtga

SEQ ID NO: 798 - DNA (genomic), 573 bp, Enterococcus faecium; double-stranded, circular
  misc_feature (B) LOCATION 1...573
  hypothetical: NO
  anti-sense: NO
ttctcggcctattgccattcactttttttatccatcacttgcaaagcaggaggtctaaacgtaatgaaacctgaatatttgattaacgctgaccatttgaccgttatcttgtgtcccctcgaaaaacaggataagatattggaacatttaaaaaaagaagttctagttgctaatctggaaaatttcgccatcgttcaaaaagattggccaatgtttccttacctaaagctcaaagaccatgtgctgttagatttaccagaaaagggaatcaaacaagatcgtttagcctatcaagaaaaacttgatatctcttcttcattacttaattgtgcggcgactgagcttacgccttttgataaagtaaagcttcaattgcttcatgcattgctttccaaacgaaacaatattgttattgaagatacatttgatgaacttagtatattggagatccaagaactgctccatttgctttcttatttagctcatgaagaaaatcaaggtatcttactctttacgcatgacgctactattgcccaaagtccttacattgatcgtttagagcctgcgggttaa

SEQ ID NO: 799 - DNA (genomic), 201 bp, Enterococcus faecium; double-stranded, circular
  misc_feature (B) LOCATION 1...201
  hypothetical: NO
  anti-sense: NO
ttttactactacaacaataaacccaaaaatgggttactgacattacgtatatacatgttcttaaaattgagtctgccgtctttaataatgctgaaaaaggcagtaaagcctaaactattgaccctttttattgccatttgtacgtatgggcatattattgtaggttatctctttaatatttttagtacattatttatttaa

SEQ ID NO: 800 - DNA (genomic), 474 bp, Enterococcus faecium; double-stranded, circular
  misc_feature (B) LOCATION 1...474
  hypothetical: NO
  anti-sense: NO
aaatcatactatgatatgtacgccaatggaggggatgaaatggaaaagccaattgaaaaagcgttagatgaatgtcttttctttagcgtgaaaaagctagatcgcatgttgaataaattagctgatgaagcgtttagaaggacaggtctggcaccaacttatggttttattttattgatattaaaagaaaaagatggaataccacaaaaagatattgcacaaatgctctattccgccccatcaacgattgctcgttttgttgaaaaattagaatataaaggatacgtcaaaacagttagcgaaggtcgcttgtcattagtttatcttacagaacaaggacgccaatttgctaaggaagtcgatggtagctgggaagaacttcatcagtcatacaaagcagttttgggaaatgaagcaagtaaagaattagcccagacaatgaatgatgcaacagataagttacaaaaaaaataa

SEQ ID NO: 801 - DNA (genomic), 306 bp, Enterococcus faecium; double-stranded, circular
  misc_feature (B) LOCATION 1...306
  hypothetical: NO
  anti-sense: NO
gatgaccactacagtaacctactgaaatatataaacagccactgtagtaccattttcaaagtagtctatgagaggagaatcttcattcttatgaacgctggaattgcggatatgaatttaataaaaaaaacccttaatgattttacttccaattcaatatcaaaaggtactggtatcaatttaagcacaataaaaaagctgaaaagtggtgaaagatcagtggaaaagctgaatcttttagatgctataaaaataacggaatttgctatgaaaaatggaaaagctgagattgaaatatggagataa

SEQ ID NO: 802 - DNA (genomic), 549 bp, Enterococcus faecium; double-stranded, circular
  misc_feature (B) LOCATION 1...549
  hypothetical: NO
  anti-sense: NO
ctggaccactatacacattgttttttggctatgatcctgaaagtgtcggcatatatccaaatggctttgctagcttctttgtttttctctttattcacgatcctatctacgatgcttcaatctttgaatcaccatcgttttgcgatccgattaactgtagaagcaattatcctgaaagtcatcttccaagtaatcggattaggattagttggcggatacgggatgagcttatcaaatggcttagcattcggtattgtctttgttcgcggctatcactttatgtgcaaagaataccgaatagcacctttagcaaagatcagcaattttttcttaaaaactttccgctccaccctgattatgcttgcagtatgttttgccgttttctttttgctgaatcagcgattgtcaatggaatcaaaaagctatgcaatgatttattgtgtggctgtaggaagtattggcggcttagtatttttattttctcaattcggaaaaaatgggtttcgaatgttgaaaaatgttaaacatcatagcagaagcaaagaatag

SEQ ID NO: 803 - DNA (genomic), 759 bp, Enterococcus faecium; double-stranded, circular
  misc_feature (B) LOCATION 1...759
  hypothetical: NO
  anti-sense: NO
gaaaacaactatattttttatgtgttttgctttataattaaaaaaatattgtcattttatggaggaaaatatatggaaaattatcttagccttttaggcgtcttgattgttattctcgggtttgcatttaaattagactcgatattgatcgtaatggttgctttagttgttacagctttgactggcggtcttggcattcaaggaatgttagaacttttaggtacaagttttgtaaacaatcgcgggatggcgatttttatcatcattatgttggcaacaggaacgcttgaaagaaatggtctgaaagaatcagcggcttccttgatcaagcgattcaagaaagtatctgctggtatgattgtagatatttatgggatctttcgaatgatctttgcggcttttaacgtgagttttggtggagttgctggatttgttcgtccaatcattttaccgatggcattggggaccatcgaatcaaaagggttagaagtccatcctaagcatgaagaagaactaaaaggtatggcttcagctatggaaaatgtctgctggttctttggccaagtactattcatcggaggagcaggggcgttgctagtccaatcaacactgaaagatctaggatatgacgtaacattgggacagcttgctttagtggaagttccagtggctatcacggctttagttgtggcaagtgtctacttctatcttaaagaaaagaaattagcgaagaaatattatccaggaaaggggcaataa

SEQ ID NO: 804 - DNA (genomic), 333 bp, Enterococcus faecium; double-stranded, circular
  misc_feature (B) LOCATION 1...333
  hypothetical: NO
  anti-sense: NO
tccttctgctatcaaataaggagtatgatgaaagaaatgacagtaaaaagaaaattgaaacgaccagaaatcctagcgccagcaggaacactggaaaagttaaaaaccgcgatccattatggagcagatgcagtatatattggcgggaatgcatatggtttaagaagccgtgcaggtaattttacttatgaagaaatggctgaaggagttgcttttgccaaagaacatgatgcgaaggtatacgttgctgctaatatggtcacccatgaaggaaatgaagatggagcagggaatttttccgcagtttgcgtgatgtcggtatttctgcagtga

SEQ ID NO: 805 - DNA (genomic), 360 bp, Enterococcus faecium; double-stranded, circular
  misc_feature (B) LOCATION 1...360
  hypothetical: NO
  anti-sense: NO
ttattctgctatattttagctatcaaagataaaagagggataaaaatgaaatttaaaacattgctattaaaatttgtcgttttaggtataagtgccgtatttattttgttcggcgtacttttttatactcagatcgctacaagcgaaaaaggattcaattttgattggcagaccacattatttgtttctgtcatttactttgcccttctcctacggatcgttattgcttatttcttattgaaactattgaaaaaaatccaagattacaagcctttttccactccaagccttaaacatactaaaaaaaatcgaacgaacccatttgtttattggttcccccttttttggcttacttcctaa

SEQ ID NO: 806 - DNA (genomic), 204 bp, Enterococcus faecium; double-stranded, circular
  misc_feature (B) LOCATION 1...204
  hypothetical: NO
  anti-sense: NO
attcgctgctacggtcgaaaatccggccagggcttggactcaacgtttgtaaatagtcgaatatctgctgaacagcatgtagatcaacagaaaaacgttgtgcgatttctttccattttcgctccaccagttcctcaaaacattcttccaacacgatataagctaattccggcgcataatcatctcgttctgtttgaagcatga

SEQ ID NO: 807 - DNA (genomic), 204 bp, Enterococcus faecium; double-stranded, circular
  misc_feature (B) LOCATION 1...204
  hypothetical: NO
  anti-sense: NO
ggaaggtgctacatgaaaaaaagacagaaaaagaaaaacgcatataaacactatatccgttcgatttttaccggttatgaaagaatgcttgaagatcccgaattggaacaattgacgtttacttatctaaacgaagaaacgcagctaactcgtgatgagcatcagcgcattcatttcacaacaagagatctgcctagtaaataa

SEQ ID NO: 808 - DNA (genomic), 468 bp, Enterococcus faecium; double-stranded, circular
  misc_feature (B) LOCATION 1...468
  hypothetical: NO
  anti-sense: NO
acaaaacgctatcctacagaaagaggattggctatgaatgattttaattattacaaatcaaaagaaatttatcgtgaaaaatattatcaaatgcctaaggtattttttactaacgaaaaatacatggatctatcaaatgatgcaaaaattgcttatatgctacttaaagatcgatttgattattcagtcaaaaataactgggtagattctgatgataatatatttttcatattcacagttgaagaattaatgaaattgttacaatgccgcgaaggtaaagtatctaaaatcaaaaaggaattagaaaaagcaggtcttctgaaacagaagagaggaagagtaaataaacgtgacggtaagattgaatccatgcctaatttattgtacttaggcaagccagaagtaacgaatcaaagacgtctttataatatcatggaaggagggagacaaatacttataccaccgtaa

SEQ ID NO: 809 - DNA (genomic), 639 bp, Enterococcus faecium; double-stranded, circular
  misc_feature (B) LOCATION 1...639
  hypothetical: NO
  anti-sense: NO
gaacagcgctattcaaagacgaataaaggaggaacaaaaatgccgcttttaaacagaggagcaattgctaattttttcggattagctgatgaggaagagtacgaataccaagattatcctgaaacaacaaaaaaggctgtacagccaactaaaaaaaatacaacacagaatcaatcaactcattctgtatctgctgcgaatactcatgaaaaacaaaaaacggcgacttcacgtcctgtaacgcatgaaagtattcagccggctgaaaagaaaaaagtaattgaactacatcaatcacctacaaaaactgtagcgaaagaaagaacagcttcaagaacctctacacaacctaaagcaaatcttgctggaaaaatcactgtaatggaaccaagagcttattctgaagctatggcgattgctaaacgaatcattgctggagaagcaaccttagtgaattttcatttagtagaagaaaaacaagcgagaagaatcgttgattttctaacaggaacagtttatgcactagatggagatatcaaacgtgttggagatgagatttttctttgtacaccgactgggatggagattgacagttcaaccgctcaatcttttgcagatgcgaatttgtttgatctgtaa

SEQ ID NO: 810 - DNA (genomic), 183 bp, Enterococcus faecium; double-stranded, circular
  misc_feature (B) LOCATION 1...183
  hypothetical: NO
  anti-sense: NO
ccattttctctcaacgtggtaaaaatcccacttataagagaaaatggtcaagaacctaaacggtcggcgaagaaaacataccaagcaccacaagcaaaaaaagttagagtaacttccaaaaaagaaaaattttttagaacaacttttgaaaatttaattttgatttatatccgttcaatttaa

SEQ ID NO: 811 - DNA (genomic), 372 bp, Enterococcus faecium; double-stranded, circular
  misc_feature (B) LOCATION 1...372
  hypothetical: NO
  anti-sense: NO
gaggaattatacatggcacgtgttaaaggtggaacagtaactcgtaaacgtcgtaaaagagtgctaaaattagcaaaaggttactacggttcaaaacacactttatttaaaacagcaaaagaacaagtaatgaattcatacaactacgcatatcgcgatcgtcgtcaaaagaaacgcgacttccgtaaattgtggattgctcgtatcaacgcagcagctcgtatgaatggcttgagctactcaaaattaatgcacggtttgaaagttgctgaaatcgacatcaaccgtaaaatgttagctgacttggctgttaacgatgcagcagcatttactgcattggctgaccaagcaaaagaagctttggctaaataa

SEQ ID NO: 812 - DNA (genomic), 1083 bp, Enterococcus faecium; double-stranded, circular
  misc_feature (B) LOCATION 1...1083
  hypothetical: NO
  anti-sense: NO
gctatgttatactatataagtgaagggggacgtaaggtgaaggtattattatattttgaaagtgaaaagatgcttgcaaaatctggaatcgggcgtgcgcttgatcatcaaaaacgtgctctgacggaagtcggtatctcttatacactagatgaaaaagaagattatgacatcctgcacatcaatacatacggaatcaatagtcataatatggtcaataaagccagaagagaaggaaaaaaagttgtctatcatgcgcattctacagaggaagatttccgaaattcctttatcggatcgaaccagctttctcctatcgtaaaaaaatatctggtaggattgtaccaaaaagcggactatctgatcacgccaacaccttattcaaaacagttgttggaaagctatggtatccgtgtgccgattcaagctatttccaatgggatcgacttagagaaatatcaccctgatccaatgaaagaacaaaagttcagagaatatttcaaactgtctccggatcaaaaagtaatcatttgtgtcggtttgtttttcgaacgtaaaggaatcattgatttcgtagaaattgctaagaagatgcccgaatacacatttatttggtttggtcatgttcccatgtactcgattcctcggaacatccggaaaattgtaaaagaagatcatcctgaaaatgtcctgtttcctggttacattcgtggagagatcatagaaggtgcgtattcaggtgcagatctattctttttcccttcttatgaagagacagaagggatcgttgttttagaagctttagcaagcaaacaaaacgtacttgttcgagatattccagtgtataatggctggttagaagatagcaagaactgctatatggggaagacaaacgaagaatttatccgactgatccaacagattaccaatcaagaactaccgagtacgacacaagccggttatcaaacagcaaaagagcgaagtatcaataaaatcggtgaagaacttaaaaatgtatacgaaagtgtactgaatgaaaaagtctctagcaaattaaaaaaagtaaatcaggtcaaggactag

SEQ ID NO: 813 - DNA (genomic), 615 bp, Enterococcus faecium; double-stranded, circular
  misc_feature (B) LOCATION 1...615
  hypothetical: NO
  anti-sense: NO
actcattctctgccaaccttccatgggttactcctggtccgttgggaattgtactcggtactaacttccaagttctatcatttatctgagccggactctttggtagttgttgatactatcatttattacccatttgttaaggtatacgatgaacaaattcttgaagaagaacgttctggtaaaacaaacgatgctcttaaagaaaaagtagctgcaaacttcaatactgctaaagcagatgccgttcttggaaaagcaggcgttgctaaagaagatgtagcagcaaacaataatatcacaaaagaaactaatgtccttgttctttgtgcaggtggaggtacaagtggcttgcttgccaatgccttgaacaaagcagcagcagaatacaatgttccagtcaaagcggcagcgggtagttacggtgctcaccgtgaaatgttgccagagtttgacttggttatcttggctccgcaggtcgcttcaaacttcgatgatatgaaggctgaaacggataaattgggcattaaacttgcaaaaactgaaggagctcaatatatcaaattgacacgtgatggacaaggtgctcttgcatttgttcaacaacagtttgattaa

SEQ ID NO: 814 - DNA (genomic), 393 bp, Enterococcus faecium; double-stranded, circular
  misc_feature (B) LOCATION 1...393
  hypothetical: NO
  anti-sense: NO
caatctatatataaaggagacatttctatgcgattatggcatgaaaaattgatttcaaagcttcctcgtcaacagcttttaggacaacatcgggaatgctgtgcattaagaggaaatggctggggaaagaaacatgctactgtggattatgtttttcactattctccttatagattattccaatatcatcagcttgtcatggatgaaatggaaaaacgtggttacagcccagcaccagagtggaaaaatcctatgtatcgtggcaaatcatgcgaagcattttttgatttacctactgtagagcgcaacgtgccgatttatccggaacacgatgaagtttatctagcagaatgtttagcaaatttggagcaaaaaggaatttatcttacctaa

SEQ ID NO: 815 - DNA (genomic), 410 bp, Enterococcus faecium; double-stranded, circular
  misc_feature (B) LOCATION 1...410
  hypothetical: NO
  anti-sense: NO
gtttatatatattataatgacaaaggtgcgtttactttagtgaattgcacagacgtaatcagaatgatttcgtcggctaagaaacgagaggttgcgacacgcccggacgctttgccacgaacgagcgtgacggaaattttcgtggagctatgtctacttttcaaaataggcgaaggagggaacaagatggcaaaacaaaaaattcgtatccgtttaaaagcgtatgaacaccgtattttagatcaatcagcggataaaatcgtggaaactgcaaaaagaactggagctagcgtgtctggtccaattccattaccaactgaacgcagtctttacacaatcatccgtgcgactcataaatacaaagattcacgcgaacaattcgaaatgcgtacacacaaacgtcttatcga

SEQ ID NO: 816 - DNA (genomic), 288 bp, Enterococcus faecium; double-stranded, circular
  misc_feature (B) LOCATION 1...288
  hypothetical: NO
  anti-sense: NO
tataatatatatatcaagaaaggagaaacaaaaatgtataacgtaggagatcaaatagatgagatcgtaaaaataggtaatgttaaacttgttaaaagtaagtactatatttcagaaactgaaataatttttaatactgaatcaggatgtattctaatttggaaactgccttttcccaaagacgaaacaacactgaaaaaaataaatactttaaaaatcagatattgcattcatgaaattattgataaaaatacttatgttataaatcaagtaaaagtgatggggtaa

SEQ ID NO: 817 - DNA (genomic), 219 bp, Enterococcus faecium; double-stranded, circular
  misc_feature (B) LOCATION 1...219
  hypothetical: NO
  anti-sense: NO
ccaaatatatatataaacaaagataaacgtattttactcgtgattaattctcgaacaaaaccaacaattaaaatcactaaaaataataaaaaacttatacttacaaaaaatgatgtcggcaccgtcagtaacaagaaaacgttagatacaaaaaataggattatgataaaattaattattctattcatcagctttaaatttaataatcctttcgtataa

SEQ ID NO: 818 - DNA (genomic), 198 bp, Enterococcus faecium; double-stranded, circular
  misc_feature (B) LOCATION 1...198
  hypothetical: NO
  anti-sense: NO
tatctaatatacgttgttccagaagttgcttcttcgaaaaataagccaaaattccacaaaaatttaagaagcaattttcgaaaaatcctttcttattttttgaagttgatcacttctgtcacaacctctcatgtcacaaaccatttttttgtttcctttaactcaatataccgtacgtcttcccacaatatcggctga

SEQ ID NO: 819 - DNA (genomic), 903 bp, Enterococcus faecium; double-stranded, circular
  misc_feature (B) LOCATION 1...903
  hypothetical: NO
  anti-sense: NO
gaggtgatatatatgcaactacaaataaacgaagaatccttaccggtatatgaagcattagctagtaaaacaaggatcaagatcatccagctactttccaaaaaaaagatgaatgtcaaagatttggcaaaagaacttggagtgagcagtgctatcacgacgatgcacgtgaaaaagctagaggaagcaaacatcatcaaaacagaaaaagtaggacaacaaaaaatttcgagccttcgtgtcgataaaatcgatatcagttttccagaaaaaatattcaatgcttttgatacgaaagaaacatcgatacctattggtcactatacaaattatgcaattgaaccaacatgcggtttagctacgatccatgattttatcgggaaagtggatgaaccacgctattttatggatcctcgaaggatggatgcccgcattctctggtttaccagcggatttgtcgagtatcaggcacctaattttttaaatacagaggatacattggagatgttggaagtttctgtggaaatttcttctgaatttcctttttcaaatgacaattggccttcagatatcactttcagcctaaatggtgtggagctaggaacatggacgagccctggagattttgctgatatccgcggtaaatatacgcctgattggtatccagataatcttaatcaatacggcttgctgaagacgatccgaattaccaaacacttgacgaatatgaatggagaacccttgtcaaacatcacgatcaacgacatccctaaagagcaagacacttggcatttgcgaatcgaagtgaaagacgatgccaaacatgtggggggctgtactttatttggtaaaggattcggtaattacgatcaggatatcaaattaaaagtttactacagctga

SEQ ID NO: 820 - DNA (genomic), 273 bp, Enterococcus faecium; double-stranded, circular
  misc_feature (B) LOCATION 1...273
  hypothetical: NO
  anti-sense: NO
aattcgatataccctttagtttttgtatcagatataccatttggatcttctacaatcgaaggtttggcatctagggcttcttggatacgtccagctgaaacagctgctcttggatacatcatgaacacactagcaaataacatgaatgagaacaaggcatggaatatatactcgataaacgcaatcaaatctcctacacgaagctcgcctgcatcgatttgcactgccccgctccagatgatcaataccattacgatattaaataagaaataa

SEQ ID NO: 821 - DNA (genomic), 300 bp, Enterococcus faecium; double-stranded, circular
  misc_feature (B) LOCATION 1...300
  hypothetical: NO
  anti-sense: NO
atacgtgtatatganagctcgaaaatgagaaagagttttgaacaacaaaaaaaactgttgcatgatcgctatggcgccctttcgatggatgaccgccgtcaaatactttgtaagttgcgtaaaagaaatatattgatgtatcgtcagttggaacgtctgaaacatgatctgcttcgtttggagtcaaaacgtgtacagtgtgaattagaggggaaccaaacacaggttgaagtagtcgaaaccaaaattttaaagaaaaaagaacaatttttaaaaatgcttacacaaaataaaaaataa

SEQ ID NO: 822 - DNA (genomic), 225 bp, Enterococcus faecium; double-stranded, circular
  misc_feature (B) LOCATION 1...225
  hypothetical: NO
  anti-sense: NO
tttcaagtatatggttccgcttacataataaaaagtagatatttctgccacttgaagtggaaagaaagtaagcaaagcaaacaaaaaataagccatatgctttttcatctcctcaacgaaaaagacatacgcctattattacaaaaattttgcccatctatacaaaaaagaggttgtgaaaaagctgtcctgcatcaagtaataagaacaactaaactaaaatag

SEQ ID NO: 823 - DNA (genomic), 666 bp, Enterococcus faecium; double-stranded, circular
  misc_feature (B) LOCATION 1...666
  hypothetical: NO
  anti-sense: NO
gtggaggtatatatgaaaatattaactgttgaagatgataatatgataagagagggaataagtgaatatctttcagaatttggatatactgttattcaagctaaagatggaagagaagccttgtcaaaatttaatagcgatataaatttggttatcttagacattcagataccttttataaatggtttagaagtgttgaaagaaattagaaagaaaagcaatttaccaattctaatcttgactgcatttagtgatgaagaatataaaattgatgcatttactaatttagtagacggatatgtagaaaagccattttcattgccggtcttaaaagctagaatagattctttaattaagaagaattatggacatttagagaagtttgaatataaggatctatcggttaattttaatagctatacagctaaaataaatggtgaagaaatagatgtaaatgcaaaagaactagaagtattaaaatgtttattggataataatggacaagtgttaacaagaatgcaaattattgattatgtatggaaagatagcgaagaaactccttatgatcgagtaatagatgtatatataaaagaacttagaaaaaaattacaattagactgtataactactataagaaatgtaggatataaattggagagaaaatga

SEQ ID NO: 824 - DNA (genomic), 330 bp, Enterococcus faecium; double-stranded, circular
  misc_feature (B) LOCATION 1...330
  hypothetical: NO
  anti-sense: NO
aagctatctcttccctgcaaacaacacctgaaaatgaagcgtggttacaaggtgcgctggaggtgttcaaacatgagtaatgatatacaaccagaaattcgtttcccaggatttacggaagcttgggaacagcgtaagtttgaatgcttacttgataaaaaagatggagtaaggaggggaccatttgggagtgccttaaagaaagaattctttgtatctaatagcaattttgttgtctatgaacaacaaaatgctatttatgataattacgaaacaagatataaaattactgaaaaaaaatataatgaattaacccgtggtgctagttaa

SEQ ID NO: 825 - DNA (genomic), 1284 bp, Enterococcus faecium; double-stranded, circular
  misc_feature (B) LOCATION 1...1284
  hypothetical: NO
  anti-sense: NO
aagctatctcttccctgcaaacaacacctgaaaatgaagcgtggttacaaggcgcgttggaggtgttcaaacatgagcaataatacacaaccagaaattcggtttcctggatttatggaagattgggaacagcgtaagttgggggaattagctgaaagttttgagtatggactaaatgcatctgctaaaaaatttgatggaagtaataagtatattcgtattactgatattgatgatatcagtcacaagtttaatcaaagtggagtaacttccccagatattgattttgcaagtgctgataattacaaacttaaaaaaggtgatatcctttttgcgagaactggagcaagtgttgggaaaacatatatgtatagagaaagtgatggactagtttactatgcaggattcctcattagagccagaataaaatctaaaattagctcagaattcgtatttcaaacaacttttactgatagctataaccggtttattaagattacttcgcaacgttccggtcaaccaggagttaatgctgaagagtattccaattttaaaattatgattccaaactatgaggaacaaaacgcaattggatgtttttttaaaaaaattgatgacactatcactcttcatcaacgtaagttagatttgctgaaggaaacgaaaaaaggattcttacaaaaaatgttccctaaaaacggagcaaaagtgccagaagttcgttttccaggatttacgggagattgggaagagcggaagttgggagaagtggtagtttttttgaatggtagagcttttaaacaacaagaattacttgattctggaaaatatagggttttaagagtaggtaattttaatactaatgatagatggtattattcaaacttagaattagaggaagacaagtatgctaataaaggagatctcttatatttatgggcaacaagcttcggtcctgaaatgtggaatgaagaacgtgtaatctaccattatcatatttggaaacttaaatttttatctaaggaattggacaaacagtatctatatacttggctattgactgataaagagaaaattaaagaatcaactaacggaacgacaatggtacatgtgactaaaggtggtatagaacaaaggacatttcagtttccaccggatataaatgaacaacaaaaaattggtgccttcttcaagcagctagatgatacgatcgctcttcatcaacgtaagttagatttgctgaaggaaacgaaaaaaggcttcttgcaaaagatgtttgtttag

SEQ ID NO: 826 - DNA (genomic), 507 bp, Enterococcus faecium; double-stranded, circular
  misc_feature (B) LOCATION 1...507
  hypothetical: NO
  anti-sense: NO
ttgatatctcttattacggaccaggtaagaaatacattgctgaaatggaggcagaatttgatgagtgaaatcaaagggacaacgaactttgaaaaactttttagtcgtaagttaaataaaattctcaagaaaaaaggaaattttgattatttatcttgggctcacgcgtgggagattatgaaaaagaatgatccacaggcaacggtaactattaatgagtacaaacactacagggttgtttctggaactcatcaagactttcttgttgaggaatataaaccttttcttatggatgaaactgggacttatgtatctgtctcagtaacggttaaaggacacacggaaaccgaattatttcctgttttagattatcgaaaccaaccagttgttaaaccaaatgcaatgcaaatcaataactcattgaagcgatgctttgtgaaagcattggctctacacggactgggattatatgtatttcaaggggaagatattcccaacaccacctag

SEQ ID NO: 827 - DNA (genomic), 795 bp, Enterococcus faecium; double-stranded, circular
  misc_feature (B) LOCATION 1...795
  hypothetical: NO
  anti-sense: NO
ttgatatctcttattacggaccaggtaagaaatacattgctgaaatggaggcagaatttgatgagtgaaggaacgaaacgcaacgataacaaattattcaatagtctgtacaagataaccgtcaatgatgttgtcgaaaaaaggaacaaactaacctatttgtcttgggcatgggcgtgggcagaagtcagcaaaatatgcgaagaagtagactacgaaatctatcgtgatccagaaacgcatcgtccatacctctttgatgaaaaaacaggctatatggtttttaccagtatcacagtcaacggagtaaagcgtgacatgtggttaccagtcatggatggtgcaaacaaggcaatgaaagataagccatatacctacgaagtcaatgattatcagtggaataacgaaacgaagaaaaaagagattgttggaaaaatcgaaaagcgagttgaagcagcaacgatgtttgatatcaataaaacaatcatgcgctgtcttgtaaaaaatctagcgatgtttgggctagggctatatatatttgctggcgaagatatgccagaagacgtctcaatgcttgaaccagctactcaaagaagcaaaaagctattcttagatgctttgcaattggttgctaacaagtacgataaatcaattgatgaagcaattgttgcattgactgatgcggcttctataaccgctgatgacagtaaatggaccaagagagacttgggcattctaaaacgaggcgttaattggcttgaagatcagtacagagaagaaacaaaagagaagtga

SEQ ID NO: 828 - DNA (genomic), 1347 bp, Enterococcus faecium; double-stranded, circular
  misc_feature (B) LOCATION 1...1347
  hypothetical: NO
  anti-sense: NO
gtagaatctctactatcttatttcttgcatacaaaaaaatcaaggagtgagagagttatgagatattcaaccatcttaatatcaacatttgcagccttaagcttatcgcttactataaatcagacagtccacacagaggagatagaaacagccaaatggacagaaaccaagtgggccaacgtcaatcgaattacctttcaggatgaattttcatccttcaattcaggagtcgcaaaattaagaaaaggacaaacagcgaccatcaaagcaaaaattgactattcaggagacttagcacctatactacaatcagctgttacatttgagaatgttgatcccgctttgtcgattggctatgacgagaacactttgactatccaacacaagcaagcgatatttaccttcaccgttacattaaatcaggacttgttaaaaccagcgctttttactgtcaaggtatcagatggactaccgaacgatcatcatcatttaacgccgtatagtcagcggcagacaattgagcaagattcagctatcgactcaggaggagatcttgttgaagaaccaacagataaaccagaaaatgaaaataagccagaagtaccgcctacagaaaatccagacggagaacagaaaccggaaatagaacctggagaagaacccgatacagaaactcaaccagagccagacaatgaatcaaaacctgaaataacccctggagaaaaaccagatgtagacccagaagaaaaaccggatgtgactccagaaccagatacggattctggaaaccaaacagtaccggaaacaaatccagacacagataatgaaactgaaaatccagaaaaaccagaggtagccccagaagaaaaaccagatgtaactccagaaccagatacggattctggaaaccaaacagtaccggaaacaaatccagacacagataatgaaactgaaaatccagaaaaactagaggtagatccagaagaaaaaccagatgtgactccagaaccagatacggacgcaagagaccaaggaataccagaaaaaataaacaaaaaaacaattcaagaggatggaaaaaaagagagtaaaaaatcaaatctagcaattctaaaaataaatgaagagcagctgaataaaaaatcacgaatatttgatagcgcccaatcagctgaaaccttaaaaagtagcaaggatacaacctttgctagtcctgaaacgaaaaataaacagctaccaaaatccggagagtcacaaaacaaagttatactgtggagcggaatcattctattaagtatagcaacaatgctttctgcaaaaagatttaaacaaaacagatctctctaa

SEQ ID NO: 829 - DNA (genomic), 201 bp, Enterococcus faecium; double-stranded, circular
  misc_feature (B) LOCATION 1...201
  hypothetical: NO
  anti-sense: NO
acggtatcatatancctaacattacacctatntttggatgtttcatttgtcggaatgcttgcacccaatgaatcgtttgggcctgcgttaccaaaaaattttaagcgatgcataaggaaaattgcagtgatgttaccaagagcattacccaaaatgttgatgatcgcacctgtcagtggtccaaagctcaaaccgcaatga

SEQ ID NO: 830 - DNA (genomic), 447 bp, Enterococcus faecium; double-stranded, circular
  misc_feature (B) LOCATION 1...447
  hypothetical: NO
  anti-sense: NO
agaactgattttttacagcgaatggacaagaaaacagcttttcaaacgtcttcatcactggatgcattttattcagccaatcatttttttgggcgtagcggctttgattttattagtttatgccgctgttttattacctgtttacggaagcatagaggaggttttgccatgaaaaagagaaaaatatcttattatagcggttttacattgatcgaaatgctaatcgtcttactgatcatcagtgtattagtgttgttgttcgtccctaatttgtcgcgttataggaatcatgtagaccaagaaagtcgtgaagcgatcatccagttggtagacacacaaaaagagctctatgcgcttcaaaataatggaagagttcctactgtggaggaattgttgaatgaaggctatatcaaacgagaacatgcagaaatctatcagcggccttga

SEQ ID NO: 831 - DNA (genomic), 633 bp, Enterococcus faecium; double-stranded, circular
  misc_feature (B) LOCATION 1...633
  hypothetical: NO
  anti-sense: NO
gtagcgtctctttctcctgtttctccgctgaagaataaatcagaaatagctgattccaaacgatctagtccgtcgtttttagctacggaaattgaaaaaactggttcattttcgatcaatttcttcaatttttcttgttccagctgtgctggcaaatctgttttatttagaagaatgatccgtttcaatccacttgtcgcttccaataattgttcatcttctgctgtcagtggttcgctttggtttagaacaagtaagatcaagtctgcttctgctaatgcttttcggcttctttcgaccccgatccgttccaccacatcttctgtttcccgaattccagctgtatcgattagcttgagcggtaccccccgaacattgacatactcttcgattacatctcgagtcgttcctgcaatatccgtaacgattgctttttcttctcttaacaaatggtttaacaaacttgatttgccgacatttggccggccgatgattgccgtacttaacccttcccgcagaaccttcccttgcttggatgtagcaagtagcgcttggattctttgttggatcatctgcgctttttcaagcaataacttcgtagtcaattcttcgacatcatcatattctggataa

SEQ ID NO: 832 - DNA (genomic), 402 bp, Enterococcus faecium; double-stranded, circular
  misc_feature (B) LOCATION 1...402
  hypothetical: NO
  anti-sense: NO
aggaatgatttgatgaagaaaataaaaagctacaccagtatttgggcagttgaaaaggtcatttatgcaattaatgactttcaactgccttttcctgtgacttttaaccagatggcttggtttgttttatccttgctgtttgtcatcgtatttgcccatgtgcctccactatctatgatagagggggcctttttaaaatacttaggtataccggtggcagttacttggttcatgtcgcaaaaaacgtttgacggtaagaaaccattgggatttttacgatcttttattagctatcacttacgatttaaggtcactttcgcaggaaagaaagtcaaagaacagaagaaacgatgggacgaacccattactctggtaaggagtgtgaactatgtacccgattaa

SEQ ID NO: 833 - DNA (genomic), 912 bp, Enterococcus faecium; double-stranded, circular
  misc_feature (B) LOCATION 1...912
  hypothetical: NO
  anti-sense: NO
aactatcctcttgatcaatacacctgcaaaaaacattttctaccaaacagagcagctattggatttcgaagtaggaaaaaaatcagtgataatctatatgacgttttgtttaaagagacgattgagcatcaaacgaccgttcggactcaatccatgtatttaaatgggatagaaactatttctagcgttacacctctttttagcaatgaccgttttttaggagcagtcgcaactttacgaaatcgatcagaagtaatgaaattaatggaggagcttggggggacgaaacaatatataaactccatgagagctcaaacccatgaattcatgaataaacttcatgtcatttctggtttgattgatttgaagaagtatgaagaagtcacccattttatccagcagctaaatcaaaattataaaaaagagattggccaagtctcaagtctgatcaaagtacctgcaattgccggttttttattaggcaaaataaacgaagccaaagaacaatctgttgaaatgctgttagaaagcgattcttttatccctaaaatggagatggatgactccatccattcacttttgcaagtgttagggaacttacttgataatgcaaaagaagccgtgctacaaaaacatgaaataaacggacaggtccggattcatttaaactatgacacagaagctgaagtattcatcgtgaccgtctgcgatgacggtgtcgggatatcaggagaaatctcggaaaaaaatatttacgctaggtttttcgaccaaaggaatcaatcgtgggtttggattgaatctcatccattcaatcgtcaaacgccacggtggatttttagaattttccaaacaaacaaatggcggtacaatcgtctatctagaattaccaaaaaaggaagatcaaaatga

SEQ ID NO: 834 - DNA (genomic), 315 bp, Enterococcus faecium; double-stranded, circular
  misc_feature (B) LOCATION 1...315
  hypothetical: NO
  anti-sense: NO
ggaagtcctcttttctgtgaattggttgtcgttaactttattctacagaagggacttccttttttgtatggattttttcatttacacaaaatattttatactctcaaaaacttaacaactttcgaaaactttcgtcacaaaatattcacaactaatgactattatataagcataccaacaaacaaccctaacaacactttttcatttttaactccttatcctgctagctccccggctagcaggacctttttttatcaaaaaaacttgtaccatccaatcgattcaactaatcaaccgaatgctgtcatgctatga

SEQ ID NO: 835 - DNA (genomic), 777 bp, Enterococcus faecium; double-stranded, circular
  misc_feature (B) LOCATION 1...777
  hypothetical: NO
  anti-sense: NO
ggaagtcctcttttctgtgaattggttgtcgttaactttattctacagaagggacttccttttttgtatggattttttcatttacacaaaatattttatactctcgatttggaatttaaaaataaagaaattttaaaattagaaaagttaaaatatgacttttttaaaggtgcatcccatgaacttaaaacccctcttgctagtcttaaaataatactggaaaacatgaaatacaatattggaaaatataaagaaagagatatttatattaatgaatgtattgaaatcgttgatagtttaacaaaaaatatttctcaaatattatcagttcattctatagaaaatttgaataatgatgaagaatatttgaaaataaatgatacattagaagacatattaaaaaagtatgaaatattagcaaatcaaaagaaaataactgtcaataattatatattagacgagaatgtttatataggaaaaacagctttaaagattattctatctaatttgattagtaatgcggtaaaatatactgatgtaaatggggtaattaatattgggatagttaatgattggttatatatagagaattcatacggtaacaataaaatttcgaatatggataaaatatttgatgttaaatttgatttaaataaggaaaatagtaatggattaggtttatatattgtaagtaatattctgaataattacaatatagaatataaagtattgcaggatgaagaattttttatctttaaaataaaaatattttcttaa

SEQ ID NO: 836 - DNA (genomic), 300 bp, Enterococcus faecium; double-stranded, circular
  misc_feature (B) LOCATION 1...300
  hypothetical: NO
  anti-sense: NO
ggaagtcctcttttctgtgaattggttgtcgttaactttattctacagaagcgacttccttttttgtatggattttttcatttacacaaaatattttacactctcgtcaatcattgttatataataaaatgttatataataaaattactaatgatatttaatattacaagcaatcttaagaaattcgaaaaggaaaaaatgattatgaaaaagaaagaaaaagaaagtattgaaacattgtgttattctaggaatattaggaacttgtctagctggcattggtacaggaatagacgttga

SEQ ID NO: 837 - DNA (genomic), 546 bp, Enterococcus faecium; double-stranded, circular
  misc_feature (B) LOCATION 1...546
  hypothetical: NO
  anti-sense: NO
aaaatacaatatatggttttgaataattttttgaaagaaggcttcattttgagttatctgatagtatgcttaattatcataatttgtctgcaccatctttttttatcgaaaacaatacctcgttattccaagaataaaaaagctgaaaaattttgtttattattaaataaatttactttaattgctcctatccttgcatttattattttttctgtacttttaagcactactcttaaaggaaaatttatggaaagaagctctcatgcaatgattctcacttttttatggttgttgttcaccagaatctatatttttctgatgagcctgaaaccgcccaaatccattagtttatgtttagttataaatggtatttttttattatcacttatcatttttattacacctttagatagatacgtcacttatttatataatcctttggaatactggacttattttataggtatattggaaggcattattttctacatcgggtattttcccaataaaaataacaacttttatttttatcgcaataaattgtaa

SEQ ID NO: 838 - DNA (genomic), 249 bp, Enterococcus faecium; double-stranded, circular
  misc_feature (B) LOCATION 1...249
  hypothetical: NO
  anti-sense: NO
atagagcaatatgaagaaggcggtgcttcttcacttgagagccaaaaaaggggcagaaaaattagtatgaattccaagctaaacattcctaaaaaacttaaagatgagtctcttgaagaagaagttattcgtttaagagcagagaacgcatatttaaaaaagttagaaaccttgattcaagaacaagatttgagcaagaagaaatcaaggttaaaacaatccttcagctcaaaaaagaatttaaattga

SEQ ID NO: 839 - DNA (genomic), 921 bp, Enterococcus faecium; double-stranded, circular
  misc_feature (B) LOCATION 1...921
  hypothetical: NO
  anti-sense: NO
gttggtaaatatgctttttctgcgatattccctacaccgattacaccaatcttcatctactttcctcctggatcatttagttactttcatcttacaccattttttactaaaatgaggtacaatagtatcgcaaaggtaaggaaattaattcgaaggagtgtgcttttattgaaatttatctcttggaacgtaaacgggcttcgtgccatcgtaaataaaaattttttagaagtttttcatgagttagacgccgattttttctgtctgcaggaaacgaaactccaagcaggacaaattgatttagatcttccaggttattatcaatattggaattacgcggaacgaaaaggctattccggcacagcgatttttgctaaaaaaccagcattgaatgccacttacggaatgggtatcgatatccatgatacagaaggccgtctgattactttggaatattccgatttctttcttgtaacctgttacacgccaaattctcaaagcgaattaaaacgtttagattaccgattagaatgggaagaagccttttataattatttggaaaatctaaaaaaacaaaaaccagtcatcgtgtgtggggatctaaatgtcgctcatcaaaagattgatttgaaaaactggaaaacgaatcaaaaaaatgctggattcactccagaagaaagagcggctctttctcgactgttggataacgggtttatcgatacattccgttatttttatccaacccaggaaggtgtctactcttggtggaactaccgattcaattcaaggaaaaacaatgctggttggcggatcgattactttttgacgagcaaagatttagagccaggactagctgatgcaaagatccatacggacattatgggcagtgatcattgtccagtagaattagatttgaaataa

SEQ ID NO: 840 - DNA (genomic), 192 bp, Enterococcus faecium; double-stranded, circular
  misc_feature (B) LOCATION 1...192
  hypothetical: NO
  anti-sense: NO
atgcccaaatacatgattatccagaaagtacgagtttacagccgcacaagcaaaagagcaattgcttgcaggcgagcacattggctctggcttaggtattcttacttcataagtttagtacttcgaaatagtttaaaagagcgtgagacaaaagtaaagaacacttttgtctcacgctctaaacacgtataa

SEQ ID NO: 841 - DNA (genomic), 204 bp, Enterococcus faecium; double-stranded, circular
  misc_feature (B) LOCATION 1...204
  hypothetical: NO
  anti-sense: NO
ggaataaaatataaatttaagtgggatagactaaacaaaattgcaacaattatatatatgcttcttgtagacaaatttgtttttaattccaattggttttggataattcctctcattaaggtttcttcaaagaaaggagcaaaaatcccacttatgaaaaacgaaataaacgttactaattcagttacattgtcttttctttga

SEQ ID NO: 842 - DNA (genomic), 939 bp, Enterococcus faecium; double-stranded, circular
  misc_feature (B) LOCATION 1...939
  hypothetical: NO
  anti-sense: NO
atgaaaaaatatcttttgacagctacggtaatgataggtgctttactgtttgcagcatgtggaaatacgaacaaggaagcagacaaaaaagaggatttgacgatcgttacgactttttatccgatgtatgattttacaaaagagatcgtaggggatgaaggaaacgtgaaacttttgatccctgctggaacggagccgcatgatttcgaaccaagtgcaaaagaaagagcagaaatttccgatgcagatgttttcgtgtataatagttcagacatggaattttttgtggattcgttaaaggattcagtggatagcaaacagaccttgatgatcgaagcagctaaaggaatcgaccgtttagaatcgcaagaagcagacgaacatgaagaatcagaagaagggcatggtcattcacatgaatacgatccacatgtttggctcgatccggtattagctataaaagaagtcagaacgattgctgaagaattaggcgaaaaatatccagataaaaaggagacttttacgaagaatgccgatgcttatatcaaaaagcttgaagcactggatcaaaaatactccgatgagctaaaagatgcaacaaaccgcacatttgtcactcagcatgctgcttttgcttatttagcgaatcaatacgacttaaaacaagtagcgatttcgggcgtttcaccagatcaggaacccacaccaagtcgcttagctgagctaaaagaatttgtgaagaaaaacaacatcaaagtgatttattttgaagaaaatgcctcttcgaaggtagctgagacattgtcgaatgaaacaggagtgaagctagaagtgttgaatcctttagaaagcttgactaatgaacaaatcaaagcaggcgaaaattatatttctgtcatggaaaaaaatctgaaagctttaaaagaaagtatcaattaa

SEQ ID NO: 843 - DNA (genomic), 204 bp, Enterococcus faecium; double-stranded, circular
  misc_feature (B) LOCATION 1...204
  hypothetical: NO
  anti-sense: NO
tttaagaaatattttcattgcagcaatcgatattacacttttagttattttcttgtcagtgcttatgtatcagttgtggctgcatcatcgcctggcaatgtggctcatgattccttattatttatgggtactattcgcaactctattgaattattcaatttattttttaaactaagcgctaaaaagagacgtcctgtaatttaa

SEQ ID NO: 844 - DNA (genomic), 819 bp, Enterococcus faecium; double-stranded, circular
  misc_feature (B) LOCATION 1...819
  hypothetical: NO
  anti-sense: NO
gtgaagaaatacaaacgtttacttttgatggccggtatcgttagtttggtcatcgtcttatccggttgcggaactggggaagtcagcgcacagagtacaggaatttgggatcgttatattgtttattactttgctgaggcgatcaaggcgttgtcatttggtaatgcagggatagggatcattttatttacactgatcatccgcgtgatcctattgccgttgatgcatttccaaacaaagagcatgcgtaaaacgcaagaattacaaccgaaattaaaagcactgcagcaacaatatagttcaagagatccggaaacacaaagtaagttaagagaagagcagcagcgtttatatgcagaaaatggcgtcaatccatatgctggttgtcttcctttattagtacaaatgccaatcttgatggcgttatggcaatctatttcacgtgtaccagagttgaaacaagggcatttcttatggttgaacttagggaacgcggatccaacatttattttgccgattttagcagcaatctttacttttgcaagtacgtatttatctagcatgagtcaaattgaatcgaatgcatcaatgaagatcatgaatttcgtgatgcctgtaatgattttagtgatgggtgtcaatttagccagcggtctttcattatactgggtagtttccaatgccttccaagttgtacaaacgctgctgatcaacaaccctttcaaaattcgaaaagagcgtgaagaagaagcacggagaatccgcgaaagagaacgtgctcttaagaaagcaatgaatcctaagaaaaaacggaaataa

SEQ ID NO: 845 - DNA (genomic), 2049 bp, Enterococcus faecium; double-stranded, circular
  misc_feature (B) LOCATION 1...2049
  hypothetical: NO
  anti-sense: NO
agggagaaatataagatgtatttatcgcccagagaaaaacaattattagcagaatttctcagtagcccgtcacctgtatctatccaaaaaatgatgaatttattgaaggtcagtaaacggactatttaccgcgaattagataatcttgaagtctcattgaaatcggtaaatgcttctttgaaaaaagcagctagaggctcatttgtcattgaggcatcagaagaagtattagagcaattaaaagaaaatacagatgggaaaagtaatgacttatccactgctaaacgacaacacgcgattttagccgagttgttactgacgacagagccgttgagtcttgctcatttcatggaatcatatcgcatcagtaataccactttttatgcagatatcaaacagttggaagaaagtattcgccaactgcctttggaaatcattcggaaccagggatacgagatcgaaggaccggaaaaataccgccggcttctgacagcgaatgtattagaattagaaatcaatgaatatgaactttttcatagtatttctttcgatgcatcactgaattatttttttcgattcgttgatccgcaacatctatctcttgcacgcaaagtaatcggggaagaattgatccaaaaaaagaccaatctaagtgatagaaagcttgaacatttggttttgatgctgacattgacgatggagcgtgtgacgaaaaatcatttactgacaaatgagacatataatagtctggcaaacaaagaattactacagacagctaaacgattgttttcacggatcgcttctgagacaaaacaactttatccagtaaatgagatcgtcttttttgcaggattattaaatgacttcacgaactcatttgatcagaatttctttgaagagacgttcgatacacagcttgcttatttagtaaaacaactgattcaagaagtaagtgaagagacgaatgtccatttttatgaagatgaaactttgtacaaaatgctgttgactcatttatctggtgtgttttcaagagccgttttacaagaagagacactgaccaatccgattttagaaaaaatcatggttcaatacgaggaagttgcgaatgcaatccgtaaagcagtagagcggatttttcaagaaaaaaaattatccgaagaagagatcgcttatatggtccttcattttgcgaattcattggaacgaagtccgaaagaaagcaatatcagtattgcaggattttcgccaagtggattagcttctactagcatgttggaactacgattgaaaaggtattttcccttcatccaacaaattcatttctatcggattgctgatttaaaaaaaatcgatttacaagaagaatatgatgttgttatttctacatctattttaccaggatacggtggaaaatatattttagtctccccgctactgctagaagatgaagtcaagcagctaaaagaagctttttcgcatattgagaagaaaaaaaggcaaaaaattacgtataacagcaataacgagtggatgatagaagatacttatgaggaaacaatgcatttcatggatcaaatcaatcaattactcggtcgtttttttatccaagaactggataatcctgagacgatttccgaaacgattcgcagcttatttccttattttcctgaaggactagtaacggatgaagaggtggttcatcgccggctgcttaagcgatatgaacaagcacctatcggtattcctcatacaaatatggggttattccatacatccagctcattgatttctaaaccgatcttttgtattttcaatttgaaacatccgttgaccattgaagggatggatagacagccagtcgatttgtcccgtatgttagttatgctggcgccttcgccaatccaagaaaaagacgggattcttttaggaaagatcagtggagcaatcatcatgaatgacttgaacaccgagatcttccgctcaggaaataaagaaatcgtttatcagttgttagcgaaaatcctgattgaagaaataaagaaatga

SEQ ID NO: 846 - DNA (genomic), 624 bp, Enterococcus faecium; double-stranded, circular
  misc_feature (B) LOCATION 1...624
  hypothetical: NO
  anti-sense: NO
acacggaaatattcgccgtgcaatcttaggcgaaaatatcggaacaactgtaagggggaaataaaaatggcagatgcaattatgacagaagcaaaagaaaaaatgaaaaaagcagcacaaaatcttcaacgtgaacttgggcaaatccgcgcaggccgtgcgaacgctagccttttggaccgtattactgtgaactactacggtgcgccaacaccattgaaccaaatggcatcaatccaaattccagaagcacgtgttttaatgatcacaccttttgacaagagcattcttcaagatgttgaaaaagctattatggcaagtgatatcggaatcagtccaaccaatgatggaaatgtcattcgcttagttatcccgcaactgacagaagaacgcagaaaagaattagctaaagatcttaaaatagaagcagaacatgcaaaatacgcgattcgtaacatccgtcgtgatgcgatcgatgaatataaaaaacaacaaaaaaatggtgatattaccgaagatgatttgcgcggattagaaaaagacgtacaaacattgacagataacagcatcaaagaagtagataagatcgctgctgataaagaaaaagaattattggaagtttaa

SEQ ID NO: 847 - DNA (genomic), 1245 bp, Enterococcus faecium; double-stranded, circular
  misc_feature (B) LOCATION 1...1245
  hypothetical: NO
  anti-sense: NO
tctaggaaatatgttactattattatataccagatatataataatgaggtgctaaaattgacaataataactatgactaaaaaaatagaagtatatgttgatggatcacaagaggaaagagattcgttttttggttttttttggaaaaatagtagagaatatgtaaaagcgctgaatatggtatataaacagctgatgtttgaagaattgatcgaaaattctataaaagaattggatcatgagtatattaaaagagagctaagtcttgaagagcgaattgataatttactaagtaatgaagtgatcgatcaaaagaaattagataaaacgaaaagggaattatctaaactacgaattgcgaaaaacaaagaagccagagacgttttgacacaagctataggtttaaaaagtcaaaccagaatacgtgatatagcaaaaaaattggactttgattattcggattttatagattcagctaaaatgaaagctagtaaggattttagcaatgattttgttggaattgttactgggcaaagaacacctagaatctatagaaataaaaataaatatggattgttaccgttcagaggtcgggatattaagattcacaaagctgacaagttttatatctctttacctaaaggatttaggtttaaagtaaatttaggtagaaaaccaagaaaagccagagatagcgctttaactttagaacgcattatggacggtcaatacaagttaaaccagagtaatctaatctttgaggggaaaaatttatttttgaatttaacaatttcttttgaaaaagattatcataagctagatttcaaagaaggagctgaattaaccataaagtttactgatttgtgtagcggtaaatgtttagttaacaatcaatctgtgattgattttggtgacagcaaatatataagtaacttcaaaaataaaattaaagcaatgaaatcaagggagcaaagccgaggagttttttctaaaggcggtcatggtcgaaaaagaaaattagatcaagatagatgggaagccataaagaaaagagaaagcaattttgttaaaacctataataatcaatgttcggcaaaaattattcaaacagctatccgcaataagacgcaaataatctgtatttctgaaccagataaaaattatggggaatgggcttattatcagttgaaagaacaaataataaataaagggaaaagatatggaatagaagttaaaagtgagtag

SEQ ID NO: 848 - DNA (genomic), 1962 bp, Enterococcus faecium; double-stranded, circular
  misc_feature (B) LOCATION 1...1962
  hypothetical: NO
  anti-sense: NO
acaaaccctcttggcgaattgacacacaaacgtcgtctttcagccttaggacctggcggattgactcgtgaccgcgccggttatgaagttcgtgacgttcactactcccactatggccgtatgtgtccgatcgaaactcctgaaggcccaaacatcgggttgatcaatagtttgtccagttatgcgaaagtaaataaattcggatttatcgaaacaccttatcgtcgtgtagaccgtgaaacaggtcgtgttactgaccaaatcgactacttgacagctgatatcgaagaccattacatcgtagcccaagcaaacagcccattgaatgaagatggaacatttgctcaagacgttgttatggctcgtgctcaaagtgaaaacttagaagtatctattgataaagtagactacatggacgtatcacctaaacaagtagttgccgttgcgacagcatgtattcctttcttggaaaacgatgactccaaccgtgccttgatgggtgccaacatgcagcgtcaagcagtgccgttgatcaatcctcaagcaccatgggttggtactggtatggaatacaaatcagcgcatgactcaggagctgctttgttatgtaaacatgacggtgtcgttgaatacgttgatgcttctgaaatccgcgtacgccgcgacaacggtgcattagataaatacgatgtaacaaaattccgtcgttcaaactccggaacaagctacaaccaacgtccaatcgttcatttgggtgagaaagtcgaaaaaggggatactctggcagacggaccatctatggaacaaggcgaaatggctctaggccaaaacgttttagttggtttcatgacttgggaagggtacaactatgaagatgcgatcatcatgagccgtcgtttggtaaaagatgacgtatacacttctatccatattgaagaatatgaatcagaagcccgcgatacaaaattaggacctgaagaaatcacacgcgaaatccctaatgtcggggaagacgcattaaaagatttagacgaaatgggtatcatccgtattggtgcagaagtccaagatggcgatttgcttgtagggaaagtcacgccaaaaggggtaacagaattatctgcagaagaacgtctattgcatgcgatctttggcgaaaaagctcgtgaagtccgcgatacatcattacgtgtaccacatggcggcggcggtatcgttcacgatgtgaaaatctttactcgtgaagctggagatgaattgtcaccaggcgtaaacatgttagttcgtgtttatatcgttcaaaaacgtaaaatccatgaaggggataaaatggccggtcgtcacggaaataaaggggttgtatcccgtattatgccggaagaagatatgccattcctacctgatggaacaccaatcgatatcatgctgaatcctttaggggtgccttcacgtatgaacatcgggcaagtattggaattacacttgggtatggctgcacgtcagttaggtatccacgtagcaacgccagtatttgatggtgcaagtgatgaagacgtatgggaaacagttcgtgaagccggtatggccagcgatgcgaaaactgttctgtacgacggacgtacaggtgaaccatttgatggacgtgtgtctgtcggtgtgatgtacatgatcaaacttgctcacatggtcgatgacaaattgcatgcacgttcaatcggaccttactcattggttacacaacaaccattgggaggtaaagctcaatatggtggacaacgttttggtgaaatggaagtatgggcactggaagcatacggtgcggcttatactttacaagaaatcttgacatacaaatcagatgacgtagtcggacgtgtgaaaacatacgaagcaatcgtcaagggtgaaccaattccaaaaccaggtgtaccggaatcattccgcgtattggtgaaagaatag

SEQ ID NO: 849 - DNA (genomic), 2700 bp, Enterococcus faecium; double-stranded, circular
  misc_feature (B) LOCATION 1...2700
  hypothetical: NO
  anti-sense: NO
aaattggaatacaaatatagaatagacatattgcagccgatagtttattatgcttttagacacattaaactggaggaaaaaatgaaaaagagcgctaaagatcgagtttttgatgagctgatacgactaacagggaatatgtcttctgtcactgccgagaaaatttcgaagaatctaggtatctctcgtcagaatgccagccattatttgacgagattagtggaagataaaaaggtcgagaaattaccgggaaagcctgttttgtggaagcctttagatgaatatgcggttgtagataatacggagcaaataaacgaagcctttcattctgtagttggtcatgacggaagtctgagagaggtcattcaaaaatgtatagccgctgtcaaatatccgcctaacggactcagtgtattaataaatggagccacgggtgttggaaaaagttttttagccacaaaaatttttgaatacgctatccatgagcaaattattgaaaaagatgcaccatttgctatcttaaactgtgccgattatgcggacaatcccgaactgctttcggcaacactgtttggatacaagaagggggcctttacgggggctgaaaaggataccgatggtttattggcaacggccaacaacggctatctttttctcgatgaggtccatcgcctatcgaaagaaaatcaagaaaagctctttctatttattgatactggaaactatcgtccagtcggtgaaaatgtaaattggcattctgctaaggttcgttttattttcgccacgacggaaaaaggtgaaaattatttattagacacctttgatcggcgtattcaaattagtgttatgttgccaacttttgaagatcgccccattcgagaacgattagagctgattcaattattttttcaaaatgaagcggatgttttacaaaaagatattattgtttcaagagaagccttgtctttaatgttatctcatccctttagtgggaatattggtaagctgaagaatatcattaaaatcagttgtgcggatgtgtatagtcgaacacaagaagaaccattaacgattgggaaaaatgagatcttgattcagttaaatatgctggaatccgaagtagaaagcttgccgattgctagtttattgataaagaaaaatcaaaagataaaaacggatcgaatcaaaccgtttgattatgattcgattttggaaaaaattactcagctgataaatgaaggtaatttcaatgaaaatttttcttcgataaagaatgaagtacagcatttggtgcatcacattgataaggattcttttttatcaatgagtagaaaattgatgattcagatgtttagaaaggtctgggtatccgttttaggaaaaacgtacggattgacgacgagtggacctgttgcagaaattattagcagatcctatgtcatttccccaagctataagacagacttaaccgggataaatcgtacattagctgcaaatctacctcggacgacttacttatgtaatcagttcttggagcatttaccaccgctctcagaaaaggacgagaactttctaagactgcttattgtcgtgactttatctgattatgtagatgaatccatcgagctgaagggcctgttgcttgctcacggagatagtacggctagcagcattcaagcagtagtgaatcaattatgcggcaattatgtttttgaagcgttggatatgccagtagagagtaatgtgtcagagattgtcgaatcgacaaggaatttcgtgaaacggcaagtgaatacagatagtctagtgctgatcgtagatatgggctctttaaatcaaatttacacacagatcaagaacgatttaaaaggggagttacttcttctgaataatttgacgacttccattgcacttgatattggcttgaagatgacgatgaatgcgccatttaaacagattgcggaggatgcagcagacaagtattcaatcaatgttcaatactttgaaggcttttctcaaagtagcaacattatcatttcctgtatgtcgggtttggggatttcggacaaattgaaagatgtttttcgtcatcatttatcggatgaatccatcgaagttttcacgaaggactacagagaactacgtgaattaatcgaccaaaatgatgaaacttattttgacaagacaaaattggtcatcacgacttcggatcttccacgttccttttcaattcctaatattaatgtttatgacatcttagacggtgatggagcagccaatttggagcatattttgagtcctgaaatgaagccggcagaatttaaccgcttgattcaggagctagtaaaattcttttcgttggaaggaattgcggaccgtttgaactttctgaacccaacgatcgtgatgagtgaagtggaaacagtcatttctaaatatgaaaattactatcatttcactttaaatggccgtgtaaaactaaatctctatatgcatacggcattgatgatggaacgtttattcttggctcggacagaaaaatctgaagaaccgaattatgatttgaaaccagatgaagatgaattttattatgtttctagaagtatttttcaatcaatggagatgaaatataattttaaagtcaatgcttatgagctttcgctgctctatgaattattaggaccgtatattcaaaaataa

SEQ ID NO: 850 - DNA (genomic), 354 bp, Enterococcus faecium; double-stranded, circular
  misc_feature (B) LOCATION 1...354
  hypothetical: NO
  anti-sense: NO
aggagtgatttggtgataaaaaaaatgatctattttcttggttcactcattaccgttctctcaagttttatttacttgaaaaagaaaaaacaagcggaaaagtcagaaggactctcaaagtatcaaggtacatggttctttagtgatagccagcaaaaacaacaattacagattacatctgattacacgtttttgatcaacggtcagtctcttggcacatctgtggtagaaatagatgaatatcgtttagtcgtacgtgatcagtatggtttttatcttatcttttcttatcccgaacaaactctttatgacgaatctgcagacacttcatataagttgttatctgaaaaatag

SEQ ID NO: 851 - DNA (genomic), 246 bp, Enterococcus faecium; double-stranded, circular
  misc_feature (B) LOCATION 1...246
  hypothetical: NO
  anti-sense: NO
ctgaaacgatacctaaaacttctggcatcgaatatattgcttttgaggtcttctctgcgtttggtacaggtaggtcttaccatgggattgacgccagacttgactgcaatagggaaattgatcattatagcgcttatgtacattggacgagttggtgtattgactgtggtcttctctctgatgacaaaagcacaaagaacacaatcaaaatacaaatatccacaagaaagtgtcatgattggataa

SEQ ID NO: 852 - DNA (genomic), 300 bp, Enterococcus faecium; double-stranded, circular
  misc_feature (B) LOCATION 1...300
  hypothetical: NO
  anti-sense: NO
tttgagcgatatatctacatagataaaactccttttgcctatcaaatatttattgcaacgaaaaaacgtacattgatacgtatcaggaggaatttatttatgaataacggtacagtaaaatggttcaacgcagacaaaggttttggctttatcactggtgaagatggaaatgatgtatttgcacatttttcagctatccaaggtgacggcttcaaaactttagaagaaggccaagcagtgtcttacgatgttgaagatggtcaacgtggccctcaagcaacaaacattgttaaagcttaa

SEQ ID NO: 853 - DNA (genomic), 729 bp, Enterococcus faecium; double-stranded, circular
  misc_feature (B) LOCATION 1...729
  hypothetical: NO
  anti-sense: NO
ggaaaaagatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 854 - DNA (genomic), 729 bp, Enterococcus faecium; double-stranded, circular
  misc_feature (B) LOCATION 1...729
  hypothetical: NO
  anti-sense: NO
ggaaaaagatacattgcaaaaagatcaactgaaggttggaccccagacgtcattattggccgtgcagagcgaaccttctcttgttcagtaagtaccctctatcgccggtttaaaacgggagaattcaatgttttacatttaccgatgcaaggaaaacgaaaaccaaatggttataaggaaaaacgtggaaaacaggcattcaaaagaaatatttctgagcgtaaaaaagattatgtcgttttcgaagaagaatttggacatttagagggtgatacgattgtcggcatccaccataaaagtgccgtcatcacactcgttgagcgactttcaaaagccattatcgtcttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 855 - DNA (genomic), 912 bp, Enterococcus faecium; double-stranded, circular
  misc_feature (B) LOCATION 1...912
  hypothetical: NO
  anti-sense: NO
aggagaagatacatgacacctacgcagttaaaagcaaaagtgaagaatatttctagagaaaaagaagttgatccgcagcttgttttaagacattttatgatggaaaaattcttggaaaaaatctcagagtctccttatcgtgaaaattttgtgttaaaaggcggcttcttgattggctcaaagtacggcattgaaaatcgcacaaccaaagatattgatacgactttacgggaaatgaaagtaaccaaagaaacattaacaacggttctaaacgaaattttttcaacgccgacgaaagaaggcattcaatttgagattcaaggaatgaaagaaacgagagaagccgattactatccaggatttagcttacgtgtgctggcacatttggaaaacatgcggccagattttaaggtagatgtgactacaggtgactcgatctatcctgcaacgatcactcacagtcataaattgatgtttgaggatcgaacgattcctttggaatcctatcctacagaacaaattattgctgaaaaattaagtgcaacctttgattttttaacagataattcgagaggaaaagatttttatgatctctatactattcctaaaatggagaagatcgatgagaagaccttgaaagatagtgtgagaaatacatttacacgtcgaggaaaaactgatccgttaaagatatactatgaaaaggatatggatgtactgaaaaatagtcacgagctaaaagatacctggaagaaatatcaaaaaagcaatccttatgctgcgtcgatcacgtacgatgagacaatggattcgattagtaatttgatggaaaaagtgattcacgtcgaagaaaaagagcgaaaactagcttatcaaagacaccaacagatgaatagagaaatggagagataa

SEQ ID NO: 856 - DNA (genomic), 257 bp, Enterococcus faecium; double-stranded, circular
  misc_feature (B) LOCATION 1...257
  hypothetical: NO
  anti-sense: NO
tggcgtggatacggtataataccgagaatgcccacaggattacccgtaccgtggtggacatggatattaccagaagacattattagattgaagtggcggttatggccatggtgccggaagcggtaccaccaggcaagttggccggtggcccatggaccgaatggaataccgttattattggccggattgccggcggcaggaatggaacggaattaccggtgggttagggtaccggcccagaaattattggaagaatt

SEQ ID NO: 857 - DNA (genomic), 195 bp, Enterococcus faecium; double-stranded, circular
  misc_feature (B) LOCATION 1...195
  hypothetical: NO
  anti-sense: NO
ccctttttgtataaaagagaaaaaaacaataaaatcgtttacatgaatattcttccttttttattaagtatgaaaaaatatttcaattttattttttcgtttcaaattattctattagtgacatccttgaactataaaaataggagtacggcatcatctgccgcactcctatttttttcgtcatttatttcttaa

SEQ ID NO: 858 - DNA (genomic), 1449 bp, Enterococcus faecium; double-stranded, circular
  misc_feature (B) LOCATION 1...1449
  hypothetical: NO
  anti-sense: NO
ttccccttgtatactggtagaaacgactattgtcaggaggatagtactgtgcatgttgatttattctttcgaaggctgcagcggcgaggacagaagtttgctgccaatcatttctcatcgatccaaatcatcgttttttattatatattgatgacggtcttatcactcgttctattttatatgccgatttttcgcgaaccagatagccatgtttcttttgtggacatgctgttcatggcaatcagtacagtgagtgtgactggactatcgacttttgatatcaattctgtgttcaatgataacggtattatactgctggaaatattatttcaagttggtggtttggggatcatgatgatttctactgcttttgtcattttttctaaacgacggatcacactgaaacagcgacagctgatcatgacggatatgaatcaaccgcgtttgtctggtatcgtccgactgattcggatcacttttgctattttaatctggtttcaattactttttgggacattcttttctatttatttttattacagaggctattttgatcgttggcgtgatgccgttttttacggtttttatcaggcgatatcggctgtcacgaactctgggtttgacgtcactggggattccatcaagccctttgcacatgactattttttcttgatcctgatcatgtttttgatttttgtcggaggaattggttttcctgtattgatggagtgccgggaatggctattatacaaacgttccaatgcgaagcttccgtttcgtttttccttgtttaccaaattagctgtgttagcttttgttatcttgtttgtttcgggaactgtcttgatttatctattggaaaaggaccatttattccaagattccaatatgagtgtcaaatggatcaattcgatgttttattcgattacgactcgtaatgctggtctgcagattcacgatttgggtgattttcaaatcacaacactgatcattttttctttactgatgtttatcggatgcagtcctagttctgtaggcggcgggattcgaacaactactgtagcaatcatcggtttgtatctatattccttcctcaaaagtgaagataacatcaatatttttggacggagaatcgatcaagatgatgtgcgaaaatcagtcgttgtctttatgctttctcttggtatgtgtttcttttgtatcgtttttttatctgctacagaagaacaaacgctgatctcgatcatcatcgaagtaacttctgcgtttggaacaactggtttatctttagggattaccggagacttgtctgttgtgggcaaaatcacgattgctacactgatgtttattgggcggatcggaatgctatatacattgatgttattcgtgccaaaagaaacacgagatctaggctatgaatatccaagcgagaaaattattatcggttaa

SEQ ID NO: 859 - DNA (genomic), 1176 bp, Enterococcus faecium; double-stranded, circular
  misc_feature (B) LOCATION 1...1176
  hypothetical: NO
  anti-sense: NO
ttcctattgtatcagagaaagagagctgattcaattatggcaagattagtcaaacgtggaaatagttggcaatacgaaatttcatacaaaaaagatgacggaaaatacacgaagataagaaaatcaggatttaagacaaaaggagaagcaaaagatgccgccaacgaattagaatataacttgaacaaaggccttaaaggggatcgcaaaaatctattattatcagattactttgaggattggatgcaactttataaagaaggaacagtatctcctatcacttatagaaaatacgaagatacgttaatgaacataaagaaatatatgccagcggtattgatttctgatttagatagagtgggatatcaacgctttttaaataagtatgctaaagaccatgtaaaatctaccgttattaagtttaataaccatattagagcgtcgttgaaagatgccgtagaagaaggattaattccgtttgatccaactagaaaagcagtaatcaaaggaaaagattcattgaagccaaaagaagataaatatttagattatgatcaatttaaatctttaatgaaactcgtagaagaaaacctttctgcgcagtactcttctcctatgctcgtgttagttgctggtgccactggaatgcgatttgctgaacttctaggattaacatgggaagatatcgatttcgaagatcaaatcatcactattaataaaacatggaattataaattaaatgaatggggaaaaacaaaaaacgaaacttcaaataggaaaatttccattgataaacatacgattgatctcttaaaaaagtttaaaatcaatcaaaaagaattattcgagaattttgaaatcaaaaaccctcataattttgtttttttcaacttaaaaaatggattagtttcatcaaacgccgtcagcaaatatttgcgcaaaaaattaaaagaattagggattgaaaagcaatttactttgcatggactaaggcatacacatgcatctattttactttatcaaggagtaaatatacttagcgtatcgaaacgtttaggacatagcagtttagaaactacaatgtctacttatcttcatattgttcgagagcttgaagatcaggataaagaaaaaatcaatactgtgttcgatagtttatataaaaatgataactag

SEQ ID NO: 860 - DNA (genomic), 600 bp, Enterococcus faecium; double-stranded, circular
  misc_feature (B) LOCATION 1...600
  hypothetical: NO
  anti-sense: NO
caaaggttgtatccttgctactttttaaggtttcagctgattgggcgctatcaaatattcgtgattttttattcagctgctcttcatttatttttagaattgctagatttgattttttactctctttttttccatcctcttgaattgtttttttgtttattttttctggtattccttggtctcttgcgtccgtatctggttctggagtcacatctggtttttcttctggatctacctctagtttttctggattttcagtttcattatctgtgtctggatttgtttccggtactgtttggtttccagaatccgtatctggttctggagttacatctggtttttcttctggggctacctctggtttttctggattttcagtttcattatctgtgtctggatttgtttccggtactgtttggtttccagaatccgtatctggttctggagtcacatccggtttttcttctgggtctacatctggtttttctccaggggttatttcaggttttgattcattgtctggctctggttgagtttctgtatcgggttcttctccaggttctatttccggtttctgttctccgtctggattttctgtag

SEQ ID NO: 861 - DNA (genomic), 1122 bp, Enterococcus faecium; double-stranded, circular
  misc_feature (B) LOCATION 1...1122
  hypothetical: NO
  anti-sense: NO
gtagatatgtatgaattaaaacaaacaccaagacaaatcgtaagtgaattagatgaatatattgtaggacagcacgcagcaaaaaaatctgttgccgttgctttgcgtaaccgctatcgccgtttgcagttagatgaaaaaatgcaacaagatattacaccaaaaaatatgctgatgatcggacctacgggggtcggtaaaacagaaatcgcacgacgtttggcaaaaatcgtcaatgcaccatttgtcaaagtcgaagcaacaaaatttactgaagtcggttatgtcggaagagatgtagaatcaatggttcgggatttagtagaaaatgcgatccaaatcgtagaaaaagagcagtacagccgtgtatacacaagtgctaaaaaaaatgcagaaaaacgtttggtaaaaatcttggtacctggtatcaaaaaagaacagaaacaatccactaatcaatttgaacaaatgatgaatctttttaatgctagtcagcaaaataccgctgaaccgcaagaagaagtgacagaagatattcgaatcaatcgccgtacagtcttggaacaactacaaaagggtttactggatagtcgtgaagtaaccattgaagttgaagaccaaaagaaacctgcaccaatgatgaacaatggattggagcaaatggggatcgacctaaatgaaactctaggtgctttgacaccgaagaaaaaagtggaacggacggtaacagtcaaagaagctttagagttattgatcaaggaagaatcagcaaaattagtcaaggatgctgatatccatagtgaggcaatcaaattagcggaagaaagtggaattatttttatcgatgaaatcgataagatcacttctaaatcacagcaatctggagaagtatccagagaaggcgtccaaagagacatattgccaattgtcgaaggttcacaagtaaacacaaaatacgggatcatccaaacagatcacgtcctattcattgcttcaggagctctccatttgtctaaaccaagtgatctaattccagaacttcaaggacgctccccgatacgggtagaattagatgatttgacagctgaagattttgtgaagattctgaccgacaccaaataa

SEQ ID NO: 862 - DNA (genomic), 1059 bp, Enterococcus faecium; double-stranded, circular
  misc_feature (B) LOCATION 1...1059
  hypothetical: NO
  anti-sense: NO
aaaaagatgtattggatgaattatacgaaatggacatacggatttgtgagattgaaggccgcagattctgtctttatttctaaaactaacattaggagagaagagatgaaaaaattagtagtaggtatcttgattctagcatcatttggtttagcagcatgtggaaatagcaacaacaccagtcaggcagacacaaaaaaaagcagcacacaaactgaaactacattgacgataacagatagtaatggagaccaaatcgaggtgccaaataatccagaaaaagtcgtcgtattcgacaatggttctttagatacgatggatgctcttggtgttggagataaggtagttggagcagctacaagcagccttcctgagtatctttcatcctataaaaaagtagaatcagcaggtggaataaaagaaccagacttagaaaaaattaatcagcttcagccagatctaatcatcatttctggccgacaaagagattttcaaaaagatctaagtcaaattgctccgaccattttcctttctttagatgcgaaaaatccatgggaatctttccagcaaaatgtcactgctttaggggagatctttggtaagcaagaagaagctaaaactcaattagaggaattatctagtgcaatcgatcagacgaaaaagaaagcagaagctactgacaaaaaagcactagtcacacttgtgaatgaagggcaattatcagcctacggatctggttctagattcggtttcatccatgatttatttggctttgaacaagcagatgatcaaatcgaagcatccactcacggtcaaagtgtttcttatgaatatgtgctggaaaaaaatccggatatcttatttgtagtagacagaacaaaagctattggtggagacgacagcaaagatgatatttctgccaatgaactggtagcacaaacgaatgctggtaaaaatcagcagatcatctcccttgaaccagatgtctggtatttaagcgggggcggtttagaatcaatgaaactgatgatcgaagatgtgaatcaagcatttaaatag

SEQ ID NO: 863 - DNA (genomic), 1413 bp, Enterococcus faecium; double-stranded, circular
  misc_feature (B) LOCATION 1...1413
  hypothetical: NO
  anti-sense: NO
ggagagatgtacatgcttaaattaccagaagattttatttttggcggagccacagcagcctatcaggttgaaggagccactaaggaaggtggcaaaggcgctgttgcttgggatgactttttagaggaacaagggcgattcagtcccgatccggcaagtgatttttatcatcaatatgcaaaggacattgaattgtgtgaacgttttggtgtaaatggtctaagattatccattgcttggagccgcatttttcctgatggagctgggaaaccaaatccagaaggaatcgctttttatcatcgtgtgttcgaagaatgtaagaaaagaaacgtaacgccgtttgtgacgttgcatcattttgatacccctaaacgtttgtttgaccatggagattttttgaatcgagaaacaatagaagcatttgtttcctatgccattttttgttttcatgaattcaaagaagtcaaggtgtggagtacctttaatgaaatctatccagttgcaaccaatcaatatttgttaggtgttttcccaccaggaatcaaatatgattttacaaagatcgtcgcctgtcttcataatatgatggttgctcatgcccgtgtagtgaactatttcaaagaaaacgaacttccgggtgaaattggtgtagttcactcattagagacgaaatatgcggcaacagacgcgccggaagataagcatgctgcctttttagacgatgcattgtcgatccgtttcttattagatgctacctatttaggctattattcaactgaaaccttgactgctcttgatgagatatgtgaagcaaatcaggccagctatcattttcctgaagaagatttcgttgaattgaaaaaagcatccacgcgtaatgactacttagggatcaatcactaccaatgccattttgtcaaagcttacgatggagaaaatgcaatccatcataacggtacgggtgaaaaagggacctctgtttataaagtgaagggaatcggagaacgtatttataaagaaggaattcctcgaactgattgggactggctgatttatccagaaggtctatatgacttgttgctgcgaattaaaagcgattacccacattacaacaaaatctatatcactgagaacgggatggggtataaagatcagtttgaagatggcattattatggatcagccgagaatcgactatttgagagtctatttggaatccttaagcaaggcgataacagccggggtaaatgtgaaggggtattttttgtggtcgcttatggatcttttctcatggacaaatgggtataacaaaaggtatggcttgttttatgttgattttgaaacccagaagcgttacccaaaagaatcagcttactggtacaagttggtcagtgaaaccaaaacgattatttaa

SEQ ID NO: 864 - DNA (genomic), 2187 bp, Enterococcus faecium; double-stranded, circular
  misc_feature (B) LOCATION 1...2187
  hypothetical: NO
  anti-sense: NO
cggatggtgtacccaacattttcctataaagtacagcgggtacacgcacaatcaagcagcaattattacggaactcagttttctaatacgcaagatcggccgggaaatacttctctaatctcaagaatctatgatgcacctgaccaaaacaatctatccagaagaatcgacagtacgtttatcgcaaccatcggagaagcgatggcactcaaagaacgaggaatcgaaatacatggtcttggcatccaacttcaaagcgatccggcagctggtctctcaaaagcagaagtagagtctcgtatgcgacaaatggtttcatcagatgaaaaaggcgatctttactatgaatcagctgatcatgcaacagatatctctgaatacctagccaaaaaagctgtacagatctcagcaactgtaagcaatggacaaataaatgatccaatcgcagaaccattcatttatcagcctggtacactttcagtcaagagtgtggggacaagtcctacaacggtcactccatctatttccatagaaggaaataccatcaagagcaatcagatctatttaggaaaagaccaagaaatccaaatccattaccaagtgagaatccaaacagaaaatgaggacttccatccaaatttctggtatcaaatgaacggcaggacaactttccagccaaacattgataccaatgaattagctgaattcggtataccatctgctaaagctcccggagtcagtcttcacatcaaaaagttatgggaagaatttgacaacaatctagctgatcgtccagatcaagttacttttgagattcaacgggaacatacgacaaatgctgcagcttggaaaaacggatatattcgaatcattaaaccagctaaagatacaacaaatacgtgggaacgtgcagacattgacaaattatctgcacatagcggagaaagttatcaagagatattatcactacctcaatacaataatcaaggtcaagcattcagttaccaaacaatcaaagaattacctgtaccaggatacgattctcaacaaatagatgcaatgacatggaaaaatactaaacaattcacaccgttaaacttgaaaataacgaaaaattcctctacaggtgaaaaggatcttattggcgctgttttcaaattaacaggagattctattgatactttactaacagatcatggcgacggaacctattctcttccagaaaatgtcaaattgcaaaaagaaatgacctatacgctgacagaaacaaaagctccagaagggcatggattaagcaaaaagactacttgggaaatcaagatcgcttctgatggtacggtaaccattgatggaaaaacagtcactacttccgatgatacgatccagttgactattgaaaatccttttgttgaagttcctgtagcagtacgtaagtatgcgatgcaagggacggacaaagagataaatcttaaaggagcagcattttccctacagaaaaaagaagcaaatggtacttatcagccaattgacagccaaacaacgaatgaaaaaggtcttgccagttttgattcactcacacctggtaaatatcgagtcgttgaaacagctggtcctgccggatatgatacttcgccgggaaattatgaattccaaatcgataaatatggaaaaatcatttacacgggaaaaaataccgagatgacaaataatgtatggacgctcactcatcaaaatcgactaaaagcgtttgatctaacggtacacaaaaaagaagacaacggacagacattaaaaggagcaaaattcagactgcagggaccagaaatggacttagaatcgccaaaagatggacaagaaacagatacctttctattcgaaaatttaaaacctggaacttatacgctgaccgaaacttttacaccagaaggataccaaggtctaaaagagccagttactatagttatacacgaagatgggtcaattcaagtggatggacaagatcatgaatctgttctgtcaccaggagccaaaaacaaccagatttctttagacatcacgaatcaggcaaaagtaccattacctgaaacgggaggaattggccgtttaggaatctatctagtagggatgattggttgtgcgttttctatttggtatctttttttgaaaaaagaaagagggggcagctaa

SEQ ID NO: 865 - DNA (genomic), 1122 bp, Enterococcus faecium; double-stranded, circular
  misc_feature (B) LOCATION 1...1122
  hypothetical: NO
  anti-sense: NO
atgcgttttttacatacagccgattggcatatcggaaaaaaactacaaggttatgacttgattgaagaccagcgtcatgtactatcttctatactagatatcgcgaaagaagaaaaagtagaggcaatcgtgattgccggagacttatatgataggagtgtcccagctgttgatgccgtagaattatacaatgaattgatggtcgattggaatttaaaggaaaagatcccgatttttgctatatcaggaaatcacgatagcagtacgagactttcagcgggtacgccatggttcagttattcgaactattttttgcgaacacagctagcagaagcatttgaaccagtcgagtttaaaaacgtacaatttttctttcttccttactttgaaccaattgcagcgagattatattttgaagatgacaatatccgaacgatcaagcaagcggtagccaaggtgatagataaaatgcaggagctatttgattcagaaaaaaaacaagtattgattagccatttttttgtaatgggaagtgtaaaatctgattcggaaacgaaaatcgaagtaggcgggttggattcgatccctggtgaactacttacaccgtttgattatgtagcactaggacatttgcataatcaagctgctttgagacaggataatgctcgctatagcggttccccattgaaattctctttatctgagatcaaccaaaaaaaaggcgtatggatcgttgacctgacaacaggcctggagttgaattttagggagatcgaacccctgcatgatattgaagaaataacagcgagtttcaaagaattgctggatcctgccttttatcagtccgtcaatcgggagaattacatctatatctatctcactgatagaacgatcatcccgaatatgatgaaccagcttcggcaaatatatcctcgtattttggggattgaacgggcaaacggtcgagcagaacaaacaaagcgcaaacgaaaagtactagaaatgaaagatcctcaaaaattagcagaagcattttttagtgaaatgacggaagagcagctaactgcaaaccaagaaaaatggctcggagaaacgttgcaagaaatcatggaaatggaatga

SEQ ID NO: 866 - DNA (genomic), 750 bp, Enterococcus faecium; double-stranded, circular
  misc_feature (B) LOCATION 1...750
  hypothetical: NO
  anti-sense: NO
attgatgctcttttgaaatgggggaaacgcatgcgtttagataagtttttagcagatatgggacttggcagccgcaaagaagtcaaaggattaatcaaaaaaggaacgatcgaagtcaatggacaagtggtgaaaagcgataaagcgcaagtaaatgaattcgaagatgcggttacttatttaggagaaatcattacgtatcaaaaagatttttactacattttgcataaacctgcaggagtcatttctgctactcaggataatcatgatcaaaccgtaatcgatttattggaagaccaggattatcgggaagatctttttccagtcggccgattagataaagacacagagggcctcttgattttaacgaatgacggggtgtttgcccatcagttactatcacctaaaaaacatgtggagaaagaatatctagctgaggttagcggtataatgacagaagaagatatccgtttatttgcagaaggactgattattgatggcgatgagcagacattgccggcaaaactccaaattgatcaagtagatcaagagacagaaacttcaattatccgtctgattttgcatgaaggaaagtttcaccaagttaagcgaatggtcaaagcagtaggaaaagaagtcttatatttaaaaagaatccgtatgggaaaattttggctgcctaaagatttgaataaagggcaatatcgacccatgaccaaagaagagctagaacaagtgagagaaaaataa

SEQ ID NO: 867 - DNA (genomic), 237 bp, Enterococcus faecium; double-stranded, circular
  misc_feature (B) LOCATION 1...237
  hypothetical: NO
  anti-sense: NO
agagtaccgtacgcaagtaaaacagaaatatttgaagaaatggaaccgtcatataagatgaataacaaattaaaccagccgatccttattagtattgtgacggcaaacagtgataaaatttttcggacactagataattttatttcaactgtaaaagatgaaacagcagtaaaaaatccgaaatttttgacaacaattcacttcccgagtacaaaaaaaaagactaacagagtatag

SEQ ID NO: 868 - DNA (genomic), 984 bp, Enterococcus faecium; double-stranded, circular
  misc_feature (B) LOCATION 1...984
  hypothetical: NO
  anti-sense: NO
ataaaagcgtatatttgcaaagcgaatgaactagaaataaaaaggaggaaactcatgttttcttttattccaaattcggttttgcagatgagtacgattttcttatcgatcgttattgaagcattacctttcgtattattaggctgtcttatctcaggcgccttacaagtatttttgaccccagaacgtgtgaagagatggcttcctgaaaatcgtatcttctctatttttactggttcgatcttaggatttttctttccttcatgtgaatgcggcatcgtaccgatcgttcatcaatttgttaaaaaaggcgtaccagttcacacagcgtttgcttttatgctgactgctccgatcatcaatccaatcgtgattttttccacttttatcgcatttggcaattcttggcagatggcaagctggcgggtgataggcagcttttttgttgcccttgtgattggtgtctggcttgcctattttcaaaaagacgctgtattgaaagaaaaaatcacgtctaaagtagcagaaaatcaccatcatcatgtccatgaagaagaacaaagtgagaagaatgaaccaaaaaatcagctgatccatcaaactgggcatgtgttgacacattcaatcgacgaattttttgatacaggtcgttatttgatcattggcggattaatcgcagctgcgatgcagacttatttaccaactagaattatgctaacgctcggctcaacaaagattttagccattatcatcatgctgttattggcctttacgatgtctctttgctcagaagcagatgcgtttataggatcttctttgttaagtctgttcggcacagcacctgtagctgcctttttggtctttggcccaatggtcgatatcaaaaatctactgatgatgaaacgatattttacaggacgctttattttatcgctgatcggactgattgcccttagcgttattggattcacattatttatttag

SEQ ID NO: 869 - DNA (genomic), 1083 bp, Enterococcus faecium; double-stranded, circular
  misc_feature (B) LOCATION 1...1083
  hypothetical: NO
  anti-sense: NO
cgctcccagtatgtttttgagaaaataaatgttaaaaatttattattggtttgctctatatactgtttaataccattgacagtaatgggggaaaccggttggagagcaaccaccttgaactatcagtggccagtagcatttagtttactaactttttatccgttttttcaactcttaagaggagaagaaataaatagaaaaatatattgggtaagtattcctttattgatatttttaactaatcaagaacaagtcaacgcctgtttttttgttctaacaagtatagttagtttatatttgattgtcaatggacgatataattataagttatcagtattttcaataataagcttagcagaattaattttctctttgacaactccagggaatgcattacgtgctgcacatgaaattaataaatggtttcctgaatataaaaatttcaactttcttaataagttagatttaggtatttcatcatttggaaagccgttttttttagacatgaatatcttatttttattgctatttttcttaattttccttctaacatataggaaatgtcaaaactattatgtgcgtatattgactgcattaccgtttttcttaaacctgattatttattttggtaatacaatgggtcaaagctttacttacgtcaatggaaataaaagggcaatgatttggagtagtagtaacctgaataatctctttacagagttaggaacgaaactgtcacttttttatccaggtacttggatagctactttagtagtcttggcattattactatgtttaattgttggaatttatttaagttttgacaataagaaaacttctatttttttagttattttgatgataatgggattttgttcaaggttaattatgggattttctcccacagtatgggcttccggaatgcggacgtactatatactttatgttgttatcgccatcttagtactaatggcagttaaagagctaatgaaaagcatgagtgtacaaaaaaatgaatttatgcaatttggattaaccgtgcttggtatttgtacctttataataacggtgataaacagataa

SEQ ID NO: 870 - DNA (genomic), 183 bp, Enterococcus faecium; double-stranded, circular
  misc_feature (B) LOCATION 1...183
  hypothetical: NO
  anti-sense: NO
cttgcccagtatgtcatgaaggacaagtcattgaacgaaaatctaagaaaaacagactattctatggttgttcccgtttcccagaatgtgaattcacttcttgggataaaccagtgggcagaaattgtccaaaatgtgacggatatctggtcgagaagaaagtcaaaggcggtaaacaagtag

SEQ ID NO: 871 - DNA (genomic), 225 bp, Enterococcus faecium; double-stranded, circular
  misc_feature (B) LOCATION 1...225
  hypothetical: NO
  anti-sense: NO
catgcggctctggaaaaatcattcgatagaaggagtagaagaaaatgcaagaaatggaaacacgttatacacacagtccagaagatatccgtcatttattcaacggaacaattgagaaaagaatttttagtagaaaaggtatttgaaccagggaaaatcagtttgacttatacgcacaacgatcgaatgatctttggtggagtgaccctactgaaaaagaattag

SEQ ID NO: 872 - DNA (genomic), 570 bp, Enterococcus faecium; double-stranded, circular
  misc_feature (B) LOCATION 1...570
  hypothetical: NO
  anti-sense: NO
gagcgttttttttattacacagctgattctttgacttttttctttttttattctattattgacaagtcaatcgttgacgagtcaattattagaaaggaggaaattatgtctttagaagagattagtcaccttttatatcaaatcaaattagccgatcaaaaaatcgtccagatctttgaagaaaatatcggtataagtcttactagatacgagatcatgatgagactgaaagaagaaaatccattgctacaaagcagtttgcaagaaaagttgcagattgatcaaggagcagttactcgtcatctgaaggtattggaagcaaatggctatgtttcgcgtcagagaaatcctcagaacaaccgggaagtgtatgtagcgctaacagaaaaagcccagaagaaaatcgagcattgtgaaatggaccataaagatacaggttccgtgctatccccggctttcagcgatgtagaaatgaaacaatttctaacacttttagataaattgaatacccaactttgcaatataacaacagaaacgaaagaggttaataataatggaacaaaaaaatga

SEQ ID NO: 873 - DNA (genomic), 354 bp, Enterococcus faecium; double-stranded, circular
  misc_feature (B) LOCATION 1...354
  hypothetical: NO
  anti-sense: NO
caccaaaagtatagaaaaatattgggcggcggtttatcccactgcctttttttcattaggagagataaaatggtaattttggatagcataaaaaaaagtatgcggatcgatcacactattgatgatgactttattcaacaattgattgatacagcaggcgaatatataaaaagtgctattgatagtagcgcaacggataaagatatggataattatcagcaatttgatttggcggtgtcattacttactcaacattggtatttgaaccgtcaagaagccagcagcgaacggataccagtaacggtacaagcattagtacaacaaatgagaggtgcttattatgccaatcattaa

SEQ ID NO: 874 - DNA (genomic), 444 bp, Enterococcus faecium; double-stranded, circular
  misc_feature (B) LOCATION 1...444
  hypothetical: NO
  anti-sense: NO
atgaaaaagtattggaagtttttgttgatgatcggtgtttcaacggtagttatgtttggtatgatgtacttgaatgtctatgcgctcgatcatatcttcttcagtcgtacacgagtattcatggcgttgatgatgggtgcagtcatggcagtcatcatgctgttgttcatgtggaaaatgtatgaaaacaaaaagataaatgttatgatcttagccgctagtcttcttgtttttgccggttccttgtttatggtacgaagccaaactactgtcaacgacacagcttggatgaaggccatgattcctcatcattctatcgctatcctggcaagtaaacgagctgatttaaaagatcctgaagtaaaaaaattagcggaagaaatcattcaggcacaagaagaagagatcgacaaaatgaaaaaaatgatcaaagaaatggaatga

SEQ ID NO: 875 - DNA (genomic), 1098 bp, Enterococcus faecium; double-stranded, circular
  misc_feature (B) LOCATION 1...1098
  hypothetical: NO
  anti-sense: NO
aagaaaaagtatcgttcttttaaaagcagaccaagaagggagtatatgaattcaatggcaaatgcatacgcaaaagctggcgtagatgtcgaagctggatatgaagtagtagaacggatcaagaagcatgtcaaaaaaacggaacgtttaggtatgatgggcgctataggaggattcggcggttgttttgatttatcggtctttcaattaaaagagccagtccttgtctcggggaccgatggcgtggggacgaaattagcagtggcaatcgaagcagacaaacacgatacaatcgggatcgactgcgtagcgatgtgtgtcaatgatatcttagcacaaggcgcagagccgttatatttcttagactacttagcaacggggaaaaatgatccgttacgtttggaaaatgtagtaaaaggtgtagcagatggatgtgttcaaggaaatatggcgctgattggcggagaaacagctgaaatgcctggtatgtactcaggtaatgattatgatctagccggatttgctgtagggatagctgaaaaatctcaattattgacaggagaaacgatcaacccaggagatgtgttgcttggaatagcatctagcgggattcattcaaatgggtactctcttgttcgcaaaattttctttgagcagcagcagttttctttatcatcaaaactgccagaattgaaaaaaacacttggcgaagaattgcttgagccaacgaaaatctatgtttcttccttgcttccgctgatcaaagaaaagaaaataaaaggagctgcacatatcactggtggagggtttgtagaaaatatcccgcgaatgttaccagaatctatggctgcacaaatcaaacttggctcatggccgattcttccaatattcggctgtttacaaaaatatggtgaaattcctgagatggagatgtatgaaatcttcaatatgggcatcggtatggtcctggcagtcgaagaatcgaaagtaaaagaaatagtacacgaaattgagcaagctggcgaaaaagtttatgaaatcgggaaagtgatcgccaaagaaaaacatcgtgtggtgtttataggagaagaacgatga

SEQ ID NO: 876 - DNA (genomic), 864 bp, Enterococcus faecium; double-stranded, circular
  misc_feature (B) LOCATION 1...864
  hypothetical: NO
  anti-sense: NO
aaaagcgagtataatgaaaaaagtttacaaagtaagaagggaagtaggagtcaaatggctgaagaaaaaccagcttttaaaatcagtatcctagcaagtggaagttcgggtaattcactttatatcgaaagtgaaaaaaaacggcttttggtcgatgcaggacttagcggtaaaaaaatcacttccttgatggctcaaattgatcggacaccggaccaattagatggaatacttgtgacgcatgaacatcgagatcatatacatggcgtgggtgtcttggctcgtaagtatcatttggatgtttttgccaatcagcagacttgggaagcgatggaaccactgattggaaatgtaccagtggaacaaaaacatctatttgagatggggaaagtcagaacattcggcgatatcgatattgagagtttcggcgtctcccatgacgcagcggctccgcaattttatcgtttccataaagaaaatcggtcattcgtcatgttgacggacaccggatattgcagtgattatatgcgaggtgtcattgaaaatgccgatggttatttgatggaaagtaatcatgatcttgagatgttacgcatgggaccttatccgtggaatttaaaacagcgtattttaggagatagaggacatctttccaacgaagacggtgcacttgtcatgactgatgtgatcggtaatcggaccaaacgaatctatcttggccatcttagcaaggaaaacaatatgaaagaacttgctcatttaacaatggaaaatgttttgaaagaaaaagattttggcgttggacatgattttgaaatctatgatacagatccagatgaagcaactgagctattttcgatttaa

SEQ ID NO: 877 - DNA (genomic), 318 bp, Enterococcus faecium; double-stranded, circular
  misc_feature (B) LOCATION 1...318
  hypothetical: NO
  anti-sense: NO
atgaaagagtacacgctagtttattctaaaagtttccagaccagccttgaaacgataatagaagaatgggaaaatgagcttgctctttctccagccagcataaaaagatttgtaggtgcgatccagaaggctttagaactaaccaaaaattttccaactatgcatgaggaagtttccgaaatctatggaatggatatcccaacatatcggatcgtgatcggcaaaagctatgccttattttatcggatcgaccatgaaaaaaaagagatacttgtaggacgtattttccaatctaaacaaatgaaactaggcttttaa

SEQ ID NO: 878 - DNA (genomic), 471 bp, Enterococcus faecium; double-stranded, circular
  misc_feature (B) LOCATION 1...471
  hypothetical: NO
  anti-sense: NO
ttatatcggtatgcnngtnnggcccatgtttgcggaccggtcgattgttgccccctcttggagtccacgagatgcgacagaggatcccctcgagcccctcaggctgggagaacactcgtggaacaactgggtgcagtgcagaccccggcaaaaggcgagctgaatgtagctatttcctcttttaattatccgaaagaagaatcaccagcattagaacaaatcaagtttgcgatccaagaaggagaaacattaggtattgttgggaaaactggtgcgggaaaaacgacgatcatcaaattactgatgcgtgaatacgatgattatcaagggaaaatccaatttggcggacgttcgatcaaagaatattcattgaatgctttattaggatcaatcggctatgtgcctcaggatcacttcttgttttcgatgaccattcgagataatatccgtttttctaatccaaaactttaa

SEQ ID NO: 879 - DNA (genomic), 765 bp, Enterococcus faecium; double-stranded, circular
  misc_feature (B) LOCATION 1...765
  hypothetical: NO
  anti-sense: NO
atgcagcggtattttttaaaagaatcatatgaatcaaaagactattttgttttagaaggggaaaactatcaccacattgtacgggttatgaggatggaacccgaggatgaagtttttttggcattcaatgatcaaatagccattgttgcagaaatcacggagattactgaagaggctgtttatctgaaagaaattaaaaaagaagaaaatcaaaaggaactgccaagttcgattaccatagcgagtggctatcctaaaggggaaaagctggattggatcgttcagaaatccactgaattaggagcgcaagcttttcttggtttcccggcatcagcctctgtcgttaaatgggatgcaaaaaaacgtatgaaacgacaacaacggcttgaaaagattgctcaagaggcagcggaacaatcccatcggcagatcgtgccatcagtagagttattggaaacgaaacaagatttatttgagcggctagatgattatgacgtggtcttggttgcttatgaggaatcagcaaagcaaggcgaaaaatcaaatgcagccaaaattcttagtgaaacaaaaccagatagtcgaatcttagctgtctttggaccagaaggtggattatcccgcgatgaagtcgattattttgtagaacacaaagggatactttgtggattaggaccaagaatccttcgtacagaaacagcacctctttatttattaagtgctgctagctatcaatgggaattaatgaatccttctttcagctaa

SEQ ID NO: 880 - DNA (genomic), 1374 bp, Enterococcus faecium; double-stranded, circular
  misc_feature (B) LOCATION 1...1374
  hypothetical: NO
  anti-sense: NO
ggaaaaaggtattttttgaaaaaagaatcccgtataatgattgttgtgcaaacgctatacaaaatgaaaaagaaaagagggatgtttatggaaaatgaacagtcggtcgttttaacgaattggaagagaaattatttgttctttttatcgggacagtttttgtcaggaatcactagtatggtcgtccaatatgcgatcatctggtatttgacaagagaaaccggttcggcgacaattttgagttttgctactttactaggaatgattcccatggttttactaagcccatttgtaggaccgctagtggatcgctgggataaaaaagctcttttgattgtcacggatattattgtagcgattttcgcgcttattttagcagtagtcggaacgatttcagaatccttcccgatttggctagtttttgtgtctttgtttatgcgttcggtcgcacaaacattccaaatgccaacgatccagtcgattatgccgacaatcgttccatcttctcacataacaaggacgaatggacagttaggaatggtccaatcagcgaatttcatcattgcgccagctctaggtgcggctttgttttcagtcgttcctgtcaattaccttattttattagatgtattgggggcagtttttggtgtcggcttattgatttttgtgaagatcccaaaagtttctcctgaaatattggaagttccgcttactatttttaaagatgcaaaatttgggctgcagcaattgatggataataaagggttatggtacataacgatcaatggtgcatttgtgatgctgttgttcatgccagcaatcagtctgtatccattgatgacgctagattactttggtggttccgttggacaggcgggagcagtggaagtagtctacgcagtcggaatgctcttaggcggtgcactgatcagttttataggaacatggaaagaccgaatgaaacctattattatagcctacatcattatgggcctgacgatcggtgcaagcggattggttccaaacgatagtcaagggttcttgtactttcttatcttgaatgcaggagcaggttgtgcaacgccatatttcaatacactgctgatggcaatgatccagcagagttatgaatcgaatgttttaggtcgtgtcttagggaacttcaactctttgatgaacctggcaggtccaattggattattatttgcaggaccattagctgatcgtttaggggtagaaaaaatgttcttgttttccggaatcgggattttattatgcggaatcgttttatttttaacgtcagctgcccgaaattatgataaagaattacagaaaaaactggtaaaagaacaccatgagcaaaaagacgaatag

SEQ ID NO: 881 - DNA (genomic), 402 bp, Enterococcus faecium; double-stranded, circular
  misc_feature (B) LOCATION 1...402
  hypothetical: NO
  anti-sense: NO
tttatgaggtatctttcgactaaagaaattatcaaaatcaacgcgaaagttattttacgtcactcgccaggcgaaatgatcggtgtaaaagatgcaaatgcattagatatggccgtcaaacagccttcacaagcagtattcaatcaagaactctatcctgaaatctatgaaaaagcggcgattttagcaattaatttagctaaaaaacatccttttcataatggcaataaacgaactgctcttgttgccatgttgttgtttcttcaattgaataattgtccagttgctttttctcgtcaagaagctgttgattttatcataatgattaccactagttcattggatttcgattcactaaagtccaagataaccagttatttacgacaaaccgcaataaaatga

SEQ ID NO: 882 - DNA (genomic), 735 bp, Enterococcus faecium; double-stranded, circular
  misc_feature (B) LOCATION 1...735
  hypothetical: NO
  anti-sense: NO
tcgaaagggtatgagcgaaggagagaacatatgaagaaaaaacagaaacaaaaattattaaatcaattccgtccttcattggatggtgtaagaggacaattattccgttctctagaagaagagagcttgcgacgttatggtttgccgttacaagtcatgcttgatcccaaaaaccgtcaaatcttaacgatcggattagctgggaaaacaaatgaagatacacggatcaacgtgccaatcgatgacaacttcaatactgtattaaagagaattcgttcaggagaaaacgggattttcgaacgattccgtgacaatcttcttattgaaatcgtgtcttactggaatgatcaacgattgaaaaacgatgaaccaactgcgcaagctgttgcgacaccagttacagaagaaacagtcagtgtgccagacgaaaaaacggaaaaaccaaaagcggacacaactgaaaatacacgctcaactgatacgaatgccgctttaagttttgctgatttttcaaaagccgttgctgagtatcctaaattttacacagaacaaaatgaacatgaagtagttattaatgaaaaaaatgctgatgaacctcgtaaattagcaactatttctatgactactgaaaatgagttcgttatcgaaaaagcactcgaacggaaatacaaagtcaaattgactttgattcctttgatcgaacaatttgcagcgacagcgattactgatcgataa

SEQ ID NO: 883 - DNA (genomic), 2628 bp, Enterococcus faecium; double-stranded, circular
  misc_feature (B) LOCATION 1...2628
  hypothetical: NO
  anti-sense: NO
ttaggagggtatacctgtatgaatattgagaaaatgactacgacgcttcaagaagcgattgctgaagctcaacagattgcggtcactcgaaaacatcaagatatcgacattgcccatgtatggaaaatctttttacaatctaatcattttggtcgaaatttctatacggatgccggattggatgtcgaatcttttgaacatgaaattgatcgtctactggatgagtatccagttgtttctggtggaaacgtccaatatggacaaaacctcagccagaatttctttcgattattgaatgaagcagaccaaatacgtgaaagcttcggcgacgagtttctttcaacggaagtcgttattttagcgttgatgaaattaaaaaattatccgttaactgtttatttgaataaaaacggattatctgaaaaagaattgcgtaaaaacatcgaagagatgagaggaggagaaagagtgacctcacaaaaccaagaagaacaatacaaagcattagaaaaatacggcgttgatttagtacagcaagtcaaaagcggaaaaatggatccaatcatcggtcgtgatgaagaaatccgtgatgtcatccgtattctttcacgaaaaacaaaaaataatcctgttctgataggagaacccggtgtagggaaaacggcaatcgttgaagggcttgctcaacgtatcgtacgcaaagatgtgcctgaaaatttaaaagataaaacgattttttcattagatatgggtgcattgatcgctggagcaaaattccgtggtgaatttgaagaaagactaaaagcagtcttgaaagaagtcaaaaaaagtgatggacgtatcctcttgttcatcgatgaaatccacaatatcgtaggggcaggaaaaacagaaggaagtatggatgccggaaatctgttgaaaccaatgcttgctcgcggtgaattacatttgatcggtgccacaactttagatgagtaccgtcaatatatggaaaaagacaaagcgttggaacgtcgctttcaaaaggtattagtcaaagaaccaacagtggaagatacgatcagtattctgcgtggattaaaagaacgttttgagatccaccatggtgttaacatccatgacaacgcattagtagcagcagctactttatctgaccgttatattactgatcggttcttaccggacaaagcaatcgatttgatcgatgaagccagtgcaacgattcgggtagaaatgaactctatgccaacggaattagatcaagttactagacgtttgatgcagttggaaatcgaagaagctgcactgaaaaaagaatcagatgatgcaagtaaaaaacgcttgaaaaatttgcaagaagaattagctgaacttcgtgaagaagcaaatgcgatgaagatgcagtgggaaacagaaaaagaagaagtcaattctgtttcagcaaaacgtgctgaaatcgataaagcaaaacacgaattagaagatgcagaaaataactatgatttagaacgcgctgctgtattgcgtcatggtacgatacctcaattagaaaaagaattgaaggaattagaagctaaagcaaaagacagcgagattaagatggttcaagagtccgttaccgaaaatgagattgctcaagtcgttggcagattaacgggtatccccgtaacgaaacttgtagaaggtgaacgagaaaaactaattaaattgaatgaaacacttcataaacgagtgattggtcaagatgaagcagttgatgcggtcagtgacgcggtaattcgttcacgggctggattgcaagacccaaatcgtcctctaggttctttccttttcctaggaccaactggtgtcggaaaaaccgaattagcgaaagcgttagctgagaacttgtttgactcagaagatcatatggtacggatcgatatgagtgaatatatggaaaaacatgctgtgtctcgtctagtcggagctcctccaggctatgtaggttacgaagaaggtggtcaattaacggaagctgtcagacgaaatccttatacaatcgtcttgttggatgaaatcgaaaaagcgcatcccgatgtcttcaatatcttgttacaagtcctagatgacggacgcttgactgattcaaaagggcgagtagtagatttcaaaaatacggttctgatcatgaccagcaatatcggttcacagttactgctggaaggcgtgactgctgatggaacgattccagaagcagtggctgaacaagtcaacacgctattacgtggaaacttcaaaccagaattcttgaaccgaatcgacgacacgattttatttacaccattgagcctagacaacgtgaaaggaatcgttgacaaaatggtggcgcaattggcacaacgtctggaacatcaagaaatcctgctgacaatcagtgatgaagccaaaacgtggattgctgaaaatgcttatgaaccagcatatggtgcaagaccattgaaacgatttatcactaaggaagtagaaacaccactagctaaagaaatcgttgcaggacatgttatgcctaaatcaaaagtaacgattactttacttgatggacaacttcatttcaaaacagaagagctagaagaaatcgtctaa

SEQ ID NO: 884 - DNA (genomic), 744 bp, Enterococcus faecium; double-stranded, circular
  misc_feature (B) LOCATION 1...744
  hypothetical: NO
  anti-sense: NO
agaacagattttattacaggaaggatgccgataattgtgatcattgttgcaggaacgatcggtgcagggaaaagcacactaactgaaatgcttgcccaagatttagaaacaaaacctttttatgagaacgtggaagataatgaagtattgccgctattttattctaatccagaaaagtatacttttttattacagattttctttttgaacaaacgctttttggcaatcaaagatgctttcagccatgatgacaacgtactagaccgctccatctacgaagatagtatgctgtttcatttgaatgcagatttagggcgtgtttctgaagtagaagtaaagcagtatgaaggtcttttagaaacgatgctgaaggagttagaagaaatttcgccacaaaagaaaccagatctactggtttatattcgtgtatcctttgaaactatgttagcgagaatcaaaaaaagaggccgggaatatgaacagctagaacaagatcctgaactctattcctactataaagaactcaatcgacgatacgaagagtggtatgaacagtttgatatatgtcccaaaatagtgatcgatggggacaaatatgatttcgtagccgatccggcatgtggagaacaaatcgtacaagaaatcaagatgcgggcaaagaaaatgacagaagaggcagatgcccagtcgatccgctacactacaaataacccgaaagcaaagggaatctttacaactaaataa

SEQ ID NO: 885 - DNA (genomic), 1602 bp, Enterococcus faecium; double-stranded, circular
  misc_feature (B) LOCATION 1...1602
  hypothetical: NO
  anti-sense: NO
tccctctatctcccaaaacaattggaggaaacaaacatgtataaagtttttatcatcgaagacgaatacctcattcgcaataacttgcgggaacaaataactgtccttggttcttattatccaatcacttatgtcggcgaagctggagatggtgagatggcactgtcttcaattatcgacttacagcccgacatcattctgactgatatccaaatgcctttcatggacgggttgactttttcaaaagaagcaaggaaactacttccttggactcgtctcatatttattagtggattcgacgatttcgattatatgaaaggagcaatccaggtacaggcagatgattatctgcttaaaccgattaaaagtagcgaattgaaacaagcaatagaaaaagcagtaactgctttagatttgcagcaaaaagaaacgcacacttcttctgatcttgttttcgaattgaaaaaaaatcatttcttgaacggtttgttcaaaggctcacttacgatcagtgaaacattgaaacttgctgaatctttcaatcgctctttagcagggaaaaaaatgaccgtattattagcagcaaaccaagtcagtacagactttgaagattacgctcatctcagtgattatttgaagtttttatttagggagaatcaacaagtgatcttctctgctgtttcctctcgattcatcaaatttttaatagttgattctcttgaagaaaatgtgatcgagaccagttatcaggtagcccaaacgttggtccatgaattagaaaagggacaaaaaaataatttttctgtcgccattggtcctgtcgcagaaagaatcagcgaattacctgcatcttttgagatcacgcagatgatacttgaaaccgccagttcccttaaagaacaaattatcagctatgaggatttgattcaagaagcgaaacttccagttgattctgtcttttactttgacctctcacttgatttgtcttcattatcgaaaaacgaagtatctaagtacatcgaacacttgacgaaaccacaaggcacaccaactcgaacacgattatatcgtttatttgtcttgactaagctactccagcatgtctgcctgaaagaaaagaaaatcccgcaagaaatggttcattgcacatccaccagtcaacgcttagcaatcagcgccgacgactcgctttaccgttcgacagtttatatgttcatttctttcttaactgctctgccctcacagccttcaaggaacaaatatcagccaattttgaaccatgcattggattttatcaaagaaaattttaccgatccagatatgtccttaacttgggtcgctcaacaagttgcattaagtccctctcatttcagtacgattttttctcaatcgtttaaccaaacattcatcgattatctgacagaacaaagaatcgaattagcaaaaaaattattgcagcaatcagactatcgtatttcagatattgcttttgaaattggttataatgaccctaactatttcagttatttatttaagaaaaaacaagggatttctccaaaagaatatcggacacagcttttccttaaaaacaaaaataactaa

SEQ ID NO: 886 - DNA (genomic), 1329 bp, Enterococcus faecium; double-stranded, circular
  misc_feature (B) LOCATION 1...1329
  hypothetical: NO
  anti-sense: NO
aaccgctatcttggaatgtggtcagatgtcgtttatcagatgaaggaggaacaaaaaatgaaaggtaaaaaatggttaattggctctttgttggtagctgcaacaggtattttaggagcttgcggtggcggaagttcagcagaatctgattctgataaagaagtgactttgactttttggaatgggtttactgcatctgatggtgaaatattgcaagaaatcgttaatgaatttaataaaacaaatgataaaaacatcaaaattgaaatggatatcatgacttgggccaatttgaatgaaaaacttcctacagcgatttcttctaaaaaagcacctgactttattgcattaaattatccagattttgcacagtatgtagaaaacggagcggtacaaccattagacgatttctgggaatatgatggagtagataaatctgattttaaagaaacggctattgaattaggtgaagtagaaggtaaacagtattttgtccccatgcaggtacaaggcatgtatatgtattggaataatgatttgtttaaacaagctggattagatactgaacaaccacctactacttgggaagaattgacagaaatggcaccaaaattaactgatagtagtaaaaatgtatcaggttttgtcttcaataaggatggaactgcaccgttatataactggatgttagcaaatggcggtaaattagtgaacgatgattatactaagtctgaatttgcgtctcctgagaaccttaaaacgttaaaagcgatccaaaaaatgatccatgtagacaagactggtccagaatcgatttctggcgccgaaatggacaatttaatgaatgctggtcaactagccattgaaatcaatgggccatggttaaataacggattgaaagcaaacgagattgattataatgtgactaccttaccacaagggagtgattcagacaaaaaaacagctattttagatggcgtaggatatgccattccggcaagtacagataataataaaaaagaagctgtctatgagtttttgaaatattggaatacaactgaaattggtaaaaaatggagtatcgaaaatggttttcctgcctacttggattcagtagcaaaagatgaagaagtaaaaaatgatcctattgtatctgaattatcgaaacaaatggactatgcagagccatatttaccaggttttacccaaatctctgcgatcaataacgatatcatcaatccactgattgaaaaattattagcaggagaagatcctgagacactcatgaacgatgcagatgatgccatcaatcaattactgcaaaaatag

SEQ ID NO: 887 - DNA (genomic), 771 bp, Enterococcus faecium; double-stranded, circular
  misc_feature (B) LOCATION 1...771
  hypothetical: NO
  anti-sense: NO
gcaagagatttttcaaaacaggaggagaatagaatgaatgatttatcagaaaaagtgattgtcatcatgggcgcttcaagcggaatcggtgaagcaacaacgaagctattagcagaaaaaggggctaaactagttatagctgcacgccgagaagatcgcctaaaagcaataaaagaatctttaccagaagctgagctatatattcaaacagcagatgtaagagattttgcacaagtccaagcagttatcgatttagcgatggaaaagttcggtcgaatcgatgtattgtacaataatgcaggaatcatgccaaccgctccattagttgaaggtcaccgtgatgaatggcaaaatatgcttgatatcaacatcatgggtgtgttaaatggaatttccgccgtacttccaatcatggaaaaacaaaaatctgggcatatcatttcaactgattctgtggcgggacatgttgtttatcctgattccgccgtttattgcggaacaaaatttgctgtccgtgcaatcatggaaggattacgtcaagagcaacggcaaaataacatcaaatctacgatcatctctccaggagctgttcaaactgaattatatcaaaccatcagcgacaaaaaggctgctcttgaacttcatgaagcgcaaaaagaatggggattgacctccgaagatatagcttctgctgtagcatttgcgatagaaacgccagaccggatgtctgtcagtaacatgattatccgtccgacgacacaggaagtataa

SEQ ID NO: 888 - DNA (genomic), 1197 bp, Enterococcus faecium; double-stranded, circular
  misc_feature (B) LOCATION 1...1197
  hypothetical: NO
  anti-sense: NO
tgttcggatttagggggatggaagatgaaggaaaaaatactttcctacttcgaaatagaaaaattgaacaccacggtaaaacgtgaggtactggcaggatttacaacatttatctcaatggcttatatcttatttgtaaatccaactgtattaggtgcttctggaatggatgaaggagcagtgtttactgcgactgcattagccagtgcgatcggctgtgttttaatgggggtattagcccgttatccaattggaacggcacctgctcttgggatcaatgctttttttgcttattctgtttgtttaggaatggggattccatgggaaacagcattagccggcgtattcgttgcttctttgatttttattttgatcacaatcttcaagctgcgggaaatgatcattgatgcgatcccagcagatttgaaatatgcgatttctggcggtatcggtctatttatcgctttccttggtctgagcgagggtgggatcatcgtttcgaatgaatctacattagtaggattaggatcactcaacgttggttctacttggttgacgatttttggattagtcgtaactgctatcttgcttgttcggcgtgtaccaggtggcatcttcatcgggatggcagctacaacgattttaggtctggtcacaggtttgattccaatgccttctgaaattgttgccgcagcaccaagtttgaaaccaacatttttagttgcattaaaacatgtaggggacatcaattctcttcaaatgtgggtcgtagtgctgacattcttgcttgtgactttctttgatacagcaggaactttagttggattagcaaaccaagcaggtttcatgaaagacaacaagatgcctcgtgtagggaaagctttagcttctgattcaacagctatgcttgcgggttccttatttggtacttctcctgttggtgcatttgtagaatcatcagctggtatcgccgttggaggacgttcaggtatcacagctattactacaggggattttcttcttgttaggcttgttcttttctccattactatcagttgttacttcacaagtaactgcaccagcattgattatggtaggagtattgatggcacaatctttgcgacaaatcgaatggggaaacttagagattgcgatcccttcattcttgatcttgatcggcatgcctttgacttatag

SEQ ID NO: 889 - DNA (genomic), 936 bp, Enterococcus faecium; double-stranded, circular
  misc_feature (B) LOCATION 1...936
  hypothetical: NO
  anti-sense: NO
aactcgcatctattaaaggagcggatgatcttcatgaacacgaaagatatcgaatactatgtccaaatcgtcaaacaaaaaaattttacgaaagtggctaattatttccgtgtgagccaacctactattacatatgcattacaacgtcttgaaaaagagtttgacaccgtacttattacaagagatcgatcgcatcacgaattgatcgtcacgccttctggaaagcagctgtttctccatgcacaaaccattctccaagagatttctactgcaagagctgaaatcactcagttgcaaaagaaaaagcttcgttttggcatgcctcctattatcggcaatgaatactttcctaaactgtcaagttactttatcaagcatgaattgatgaatcaaattgagattaccgatggaggccctcgggacttatacgggatgatccgacaagggaggatcgatttagctgtattaggctcaacacagccaatcgtggatcaatatttagaaacagagttacttttggacaaacgtttcatgatcgtcgtgccacctacacatcctctttccaagcaggatactgtctctttcaaagatatagcagatgaacagtttgtactattgaacgaacattatgtccaccccgcagcattcactaagctttctaaacaaacacatactcatccaaaagttgtgtatcaaagcaatgacttgacgattttaaagagtatggtccgagaaaatgtgggtatcggttttttggcagagattgctgtccatcctgaagatcatttagtttgcctccctctttcagatgaagttcagcctcgcttcttgatttcattggcaaaacgaacacagcagatcgtcacgcctcttcaagaacaagtagtccaagttatccatgaattcgttacagcacaaaaaaacagctcttcgtaa

SEQ ID NO: 890 - DNA (genomic), 1002 bp, Enterococcus faecium; double-stranded, circular
  misc_feature (B) LOCATION 1...1002
  hypothetical: NO
  anti-sense: NO
ttttctaatctcaccaaaacaaaaatttttaagaaagaaggagagaaagttatgatgagaaaatggaaagcagtactgggaagtctggggattttgattgctctttttatattcggggcatgttcaacaaatagtaaagacaaagatacagtggcttcgaacgaaaaattaaaggtagtagttactaattcgattttagcagatattactgaaaatatagcaaaagataaaattgatttacacagtatcgtacctattgggaaagatccccacgaatatgaacctttgcctgaagatgttcaaaaaacttcaaaagcagatttgattttttataacggtgttaacttggaaactggaggaaatgcttggtttacaaaattagtaaaaaatgcgaacaaagaggaaaacaaagactattttgcagcaagtgatggcatagatgttatttacttagagggtcagagtgagaaagggaaggaagatccccatgcttggttaaatttagaaaacggtattatttacgctaaaaatattgaaaaacagttagcggaaaaagatcctgataataaaaaattctataaagaaaatctagataagtatattgaaaaattggattctctagacaaagaagctaaatctaaatttgcttcaattccgaatgataaaaaaatgattgttacaagtgaaggatgctttaaatatttctcgaaagcgtataatgtgccttctgcttacatttgggaaatcaacactgaagaagaaggaacaccagatcaaataaaacacttagttgaaaaattacgcacaacaaaagttccctccttattcgtagaaagcagtgtggacgatagaccaatgaaaacagtatcaaaagataccaatattcctatctattcaacgatttttactgattcaattgcagaaaaaggacaagatggtgatagttactatgcgatgatgaaatggaacctggataaaattgctgaaggcctttcgaaataa

SEQ ID NO: 891 - DNA (genomic), 489 bp, Enterococcus faecium; double-stranded, circular
  misc_feature (B) LOCATION 1...489
  hypothetical: NO
  anti-sense: NO
ttggaggatttttatacaatgatggattacttaattagtcaaaatggtggaatggtatttgcagtattagcgatggcaacagcgacgattttttcagggattggttcagctaaaggtgttggaatgacaggtgaggcagcagcagcgttaacaacaagtcaacccgaaaaattcggacaggctttgattctgcaattgcttccaggtacgcaagggttgtatggattcgttatcgcctttttgatttttatcaacttaggaaatgatatgtcagttgtacaaggattgaactttctaggcgcttctctgccgattgcttttacaggtttgttttcaggtatcgcccaagggaaagttgcagcagcaggtatccaaattttagcgaaaaaacctgaacatgctacaaaaggaatcatttttgctgcgatggttgaaacatatgcgattttaggtttcgttatttccttcctattagtattgaatgcctaa

SEQ ID NO: 892 - DNA (genomic), 630 bp, Enterococcus faecium; double-stranded, circular
  misc_feature (B) LOCATION 1...630
  hypothetical: NO
  anti-sense: NO
gtgttttttcagatacaatataaaagcagcacaagagatgggggcaacaatgtgaacggactatttattacaatcgaggggcctgatggtgcaggaaaaaccagcatcttgaatgaactttaccctcttttgaaagaagtagcaaaaacagaaatcattcaaacaagagaaccaggaggcattccgattgctgaagagatccgagcagtgatccttgatccaaaaaatgatcggatggatgaacgtacggaagcactgctttatgcagcagcaagaagacaacatctagtcgaaaaggttctgcctgctctggcaaaagggaaaatcgttttatgcgatagatttgtcgacagttctcttgcttatcaaggtgcaggccgacgcatcggcgttaccgagattgctcggttgaatgagtttgctacagaaggtactacgccggattttaccctttatcttgacgtagattcagacaccggattaagaagaatcaagaaaaacagacaaaatcaaatcgaccgtttagattcggaaggtttggaattccaccagcgtgtacgtcatgcttacttaaagctggcagaagagaatccggaaagaatccacaaagttgatgcaagaaaaagcttt

SEQ ID NO: 893 - DNA (genomic), 687 bp, Enterococcus faecium; double-stranded, circular
  misc_feature (B) LOCATION 1...687
  hypothetical: NO
  anti-sense: NO
atcgattttcacttttcaaaactcagatatcaacctgattttgaacatttctcggatgaagagttccaacagatcaaggaacatactgttcttcgttcctataagaaaggacaaatcctttttgatgatggagattctagacaacggttatatatcttgaccaaaggacttgttcgtttagaacgttacgatgaaagtgccacctattattattatgattacgtgactaccaataacctttttcctatgtcaggaatgtttggagaagagacctacacttatacagctcaagcgatgactgatatcgaaactttctatcttcctgtttcctactatgaaaaattagcacgaaaaaatcctgaacaactaatctatatgattcaaaaaatttctaaagtagtcgaaatacatgagttacgtatccaaattggattaacctccagtgcttttgatcgagtgaaacaaaatctattcattttgaaagaagaacttggcgtaccaacagaagacggtcatatcaccattccttatccaattaccttaaaagaattagcagtgaatagcggtacgacacgtgaaactgctggacaagtaatcaaacaactacgtgattcaggattgttagattatcacaaaaagcattttactttctgtaagaccgctactactccagctttgagagaataa

SEQ ID NO: 894 - DNA (genomic), 1896 bp, Enterococcus faecium; double-stranded, circular
  misc_feature (B) LOCATION 1...1896
  hypothetical: NO
  anti-sense: NO
taccgaaatctttttattttgctgacatactcaaacctttggcacaaagtttcgtgccaaagtacgactatttctctttttagtaagcggatacaattagagtatcaaaaggagagagggagagacaaaatggaacggacgattcccaaaaacaacatttcgctaaaagcgagggtacaaaaattaggcagtactttatcaagcatggtcatgccaaatattggagcactgattgcctggggtgtattaacggctctatttatcccagatggttatttaccaaatgaggctttcgctaccatggtaagcccaatgctaacttatctgattcctttattgatcggttatactggcggaaaagtaattgctggtgaccgcggatcagttgttggggcaattgcaacgatgggtgtgattgtcggaacagatattccaatgatgctaggcgcgatgatcatgggacctcttggtggatatgccatcaagaaatttgatcagctattccaaaaacggatcaaatccggttttgaaatgctagtcaataatttttcagcaggtcttatcggttttggattagcgttattaggtttttctgcgattggtccagttgtcgatgcattgactcaagcaatggcaaaaggtgtagagatcattttatctgcccatttgattccattgacaagtatttttattgaaccagcaaaaatcttatttttgaataatgcaatcaatcatgggattttgacaccattgggaactgaacaagtagcagaggctggaaaatctattctattcttgcttgaagcaaatcctggtccaggacttggcgtattacttgcttttactttgtttggcaaaggagcagcaaaatcttcagcaccaggagccatgatcattcactttttaggcgggatccatgaaatctattttccttacgttatgatgaaaccgttattattcttatcagttataggcggaggaatgtcaggaagtttcattttccaattgatggatgctggactaagagcgccagcttctccagggtcgatcattgcgattctagcgatgacaccgttcaattcttaccttcctgttattttgggcgtgattgttgccgcagctgtttcgtttggtatttctgcagtaattttgaaagcggatgcgaaagatacaaatgaagacttcgaaaaatctgttcaagagacaaaggcagctaagcaagcttccaaaggtgcccaaggtattcctcaaggagctacattctctggcgtacaaaaaatcatttttgcttgtgatgcaggaatgggatcaagtgcgatgggcgcttcgatcttgagaaaaaaagtacaggaagcagacttgcctcaaacggtgaccaatcaagcaatcagccaactgacagatgactcgaatacattgatcgttactcaggtcgaactacaagaaagagcaaaacaaaaagcaccgagcgcgcgttttgtctcagtagaaaactttttgaattcacctcgatatgatgaaatcattcaagaattaagcagcaagcagaaaacatcagtttctgaaattgagaatgagccagcagaagagtttctttcagcaaacatcaaacaaatcaaagagattctacttgtccacgatgatcgttccggatcagcaacaatggggatgaccgtgctcaaagatatattagacaagaaccatttaactatcccgttaagaaaagtcaatatccaagatttaaaagatgaacctgattcactgatcgtagccaaagaaagtttagcggaaaaagtacagatggctgcacctcaatccattcatttatcagtcaacagcatggtcaatccgcaaaaatacgaatcgattgcacaatatttgaaacagacagcttaa

SEQ ID NO: 895 - DNA (genomic), 198 bp, Enterococcus faecium; double-stranded, circular
  misc_feature (B) LOCATION 1...198
  hypothetical: NO
  anti-sense: NO
aatttatttcatcgtttaataggtcgatggtcttgttctattaaattgttaagatacttcacagttcggtgctctgtcttagtgtataaacccacactctgtaactttctaaaggcggagccaagagaaggtgctttatcggtcacaattgctttcggctcaccaaactgtttatggagtcgttttaagaaagcatag

SEQ ID NO: 896 - DNA (genomic), 921 bp, Enterococcus faecium; double-stranded, circular
  misc_feature (B) LOCATION 1...921
  hypothetical: NO
  anti-sense: NO
agaggaaatctcaaaagagaagagaggctttttatgtcatttcaaatcggggaactttttaatttggactattggcagcaaatgttttccggtgacttgttctctctgaattttttggtgaacatacttgatattctggttgtctggtatcttgtatacaaactgatccaactgctgcgaggcacaaaagcgattcagcttctgaaaggtgtagctatttttattgttatccgaatcgtagcggaaatcattggtctgcacaccttgtcttggctgatgaaccaagtcattacgtacggggtgatagctgctatcgtgatttttcagccggaaatccggagaggactggaacatcttggacgcagttcgcttttcaaacaatcaaaaagcgaacagcaggaagatgagaagatgatcttgtcttttgacaaagccatccaatatatgtccaagcgaaaaatcggtgcgttgatcactatcgaacgtcatactggattagatgagtatattgagacagggattgctttagatgcagatatcactggggagctgctgatcaatatctttattcctaatacaccgctgcatgacggtgcagttattgtaaaagaaggaaagatcgcagtagcaagcgcctatcttcctctatcagaaagtatgttgatccctaaagaattcgggactcgacaccgggcagctgtcggtataagcgaagtcagtgacgcgattaccatcgttgtctctgaagaaaccggggacgtcagcatcacgttagataatgaactgatggctggcttatcccagcaagaatatttggcaatcttgcgtagagaactaattgctgaagagaaaacaaaaaacaagaaaaacgtgattcaatctttcctagacggtatgactaagggaggggatcgcaaatga

SEQ ID NO: 897 - DNA (genomic), 723 bp, Enterococcus faecium; double-stranded, circular
  misc_feature (B) LOCATION 1...723
  hypothetical: NO
  anti-sense: NO
agaaaatttcagttactatggagaacagggcaaagaaaaatcaatcattttctttgtatatcatcttaccaatatataggaattgttagtaacaattgcctttcaaggaggaatccatccatgttattaggctcacacgtcagcatgagcggaaaggaaatgctgttaggagcagcagaagaagcagccagttatggatattggacttttatgatatatacaggcgcccctcaaaacactagaagaaaagccatcgtagagatgcatattgatgccgggaaagcgtacatggcagaaaaaggtttaacaaatatcgtcgttcatgccccttatatcattaatttggggaatacgatcaaaccagaaatgtttccttttgccgtccaatttctgagagaagagattgttcgtgcggaagctttaggcgctactcaaattacacttcacccaggtgctcatgtaggggcaggaacagaagccggaattgctagaattattgaaggcttgaatgaagttttgacaaaagaacagacggcacaaatcgctttggagacaatggcaggtaaaggtacggaaatcggtcgaacatttgaggaattagcgcaaatcatcgatggagtaaaattgaatgaaaaattatccgttacttttgacacctgtcatacgaatgatgccggttataatattaaagaagactttttcaggtgtaatggaagagtttga

SEQ ID NO: 898 - DNA (genomic), 3894 bp, Enterococcus faecium; double-stranded, circular
  misc_feature (B) LOCATION 1...3894
  hypothetical: NO
  anti-sense: NO
ctacctcttcaagtggtggttgatgaaagaatagataaccaagaattacaagaaaatgaaactgatacagaagattccgctgaaattcaacgtagcgaagaaaatgagatggaaaagctggacgaaccaatcgtacccagcggtcaagcactccagcgcattcaacgccagttattcaacggtattttggagcgtcttgggccaacagctacgcaagacccctatgaatatatctatcctagcggagaagttgaaaacgaacagcatcgctacccgaagtttacaacgaatgactatacaaaagtgttaggaaattggacacaaagcaatgaacgctatcaaggagacaaaggctcgccatatgacggagagaacttgatcgatgatagtgattatacaaacgggggagcgaactggcgaaattacgactatgctactaataatggatcaactgcaggcgaagaagatagaaacgttccagctcaaaccgttcagctttggggaaatgaacggaattttgaaaacagttacttggattataacggggcgtacatcaaaaaatgggtagaacctgttctgccaagcagcacagcatctgatctacatcctgaagatgcaacaaccctttacaatgtctatctagatgtcatcgggggcgagaaaaaggaaatcagtccaatcgatatcgtttttgttctagataagtcagcgagtatgagtgaattaaccgctgggaccaatagtcaaactaaaaatgctgcgttgattgaggcagtaaacgaaatgagtaaagatctgctctctgacccgagtctggatattcgaatcggtatggtgaatttttaccataatagtacagctatcaataaccatgagcaaatcagttcggacatctttccattgacaaatgatatcaatcgtttgacgggaagtgagaatacagcattaaatcgtacaccaatcggaggaactccgcttacactagggcttaaaaatggctatgaaacattgtataaagacaatggcggagaaaatagaaatccagaaaaaatcctaatcgttgtgggagatgggacaccgaccttcagttatgcaccgattcagtcaagttatcgtacgagcactaatggagcttggagcaactggactgtgatggaagataagattgctgaagataatgacgttttgttcagaaattttgaggagttttctgggaatacttctaatgcagggtttactcatccagttacctatgcatctgactttaaccgtccagaagatgaagtaaatgtacactatcgttatggagaggtaaaagaaggagataataaagcgactcactgggttggtgatggttcttctaataacaatacgaatggcagtcctacttcgcaagaaaagtcatctgcgatcaacacagttgcttatcatcattggctgaaaaacaagtatcaagagaacccgccaagtatcttctccattggtttaggaatcgatggaaacgttagcgggagacaacgactagatgctattggacgaaatgtattgaaaaatattgctgatttagaagaagatggcgtaacaccgcgatattacaatgcgaacaacaagaatgacattgttacagccttggaggatatctcttctaccttcaagagaacgatccagcaagccacactttatgatgaaactggttttaatgtctcaccatttggagctggcagatcggcagatattcagttttaccatctagatccaggagaaaacggcatgaagtaccaagagccagaaatatgggatgaagaacgtcatggacaagccccaccagaagtagtggcgactccgacaacgtatgtcggacgggaaaaccaagcttataaattttctccgatttctttaggtgaaggggaaatggtcaggatcaagtaccaagtaaaacttgatgcgggagctcaagacggaaatttttgcacagtgaacaatatggcctatattcagaacctggaggattatgagaatgatatcactactggacggatgtatttcccatcttcttccattcgttacgaacataaaggccgtaatttccaagtcagcaagaagggtcaaaatggcgagccgttggctggagtcgaatttgcattatatgaccaaaatccagagagtggggaagccgaaccaatcgaaacaagtaaaactaccacggacggaatagcgatctttgaaacgaagatgccgattttaggagatgaaactggagcagtcagcgacatattttggatcagagagatcgctggaccaccacgttatcagttagtagatgagacgtatcaattccaaatcaaaaaatatgcagccaacgaagatgagatgttaggtcactacgagcttgtagatgaatatacatctggttcgagagtcggcggaccggaaggtaaagatccgaattcctattatgaaggagaatatcacaagctttctgttgtacaagagcctaacatagaaggcacagagtatgatgagttgtatgtcaaactggaaatgcgaaatgaattcaagccaatccacatgaatatcaataaactaattgaaggcagtaatatgccaatcaatggcgcagagtttgaactttatgaaacagatggtaacggactggaaatcggatatccagtagcgaaagggctttctggtgtgaacgaagtagaggaagagaaagggagactcacgttctattcagtagatgaagacgggaaatatgtaatcgtggatggtgagaaagttattcatccaatcggagagccagattcatttgtttataaggatagtgaagaaactaccaactatgcagaatacaaaatcattgagagccagaacccagaaggtttcaaagaacctgatgaaaatgacacatggatcttgcgactttacgataatgctatagggactatccaactcaagcaaacaggtgaagaaaattggcaatatctgacctatacaacagatgaagaggatcgtttatgggtagcattcactgcttacaatacgtttgattatcgggagatccgagttagaaaattagaccatgaaggccatacattagatggtgcaggtttcgatatcaggaaagtgggggattcttccttcccgctgtatcgagcatacactggtaatccgttagaaccagaagaatcgaaacgtttgcctgggatcggatacttctattctcgtgccgtaggagtagaaaagtatgtcgatttaaattacgaccaacctctgcatctgtctattggtgaatatgaggtctcggaatctgtcgcaccaaatgggtatcggctatctgatcaagtgttccagtttgcactgaatgaagaaggtaagtttatcattgaagatacggtcatcgaagacgaaactgctcccttgccggaaggctatgaaatcatcgatggtgtactacaagtaaccttagaagatgaactagcgccaatcgatttggaacttttgaaaattgacagtatgaatagccgacgtcttgaaggcgcagaattttcaattgagaaacaaaatagtgcaggagagtatgaaatcatcgagggaggcttggcaccagatccaaacgattcttccctattcaatgcttcagacttgttggaaggggtctatcggatcaaggaagtgaagtcacctgacagctatagaaaacttccaggttactttattttagaaattagttatcgagaagaacctgacatagaaaatgatcgggtagttccaggaaaagaagcgggtacactaaaagttgagatttcgtattatccaaacgaagaagcagagacgcctgatctacagcaagagttagaatatgaacttttggagacaaatcgaatcagatga

SEQ ID NO: 899 - DNA (genomic), 348 bp, Enterococcus faecium; double-stranded, circular
  misc_feature (B) LOCATION 1...348
  hypothetical: NO
  anti-sense: NO
gcagcgaatctgcaagtggtttattcaaaagaagatcatacggtttatttcgatgaagaaaacgggtatgaattggaatggctcgtggctgattcgaatgaaaaagaaatggagcctgtcttgctgacttttgaaggtgcaggagaatataagacgtttgaaccttcattatctgaaacgtttatttttgtattagaaggggaattagagttaagcttaggagagacggtctatgtggcaaaagcaggacagtcgatctattatcaagcgacaaaacaacatcaattaaggaatcatctcaaaaaacgaacaaaagtattgattgttgcaacgcaatcatatttgtaa

SEQ ID NO: 900 - DNA (genomic), 1725 bp, Enterococcus faecium; double-stranded, circular
  misc_feature (B) LOCATION 1...1725
  hypothetical: NO
  anti-sense: NO
tcagctattcaattcctttttttctgtaaaaataacctctattcgtttagtcgctcgaatgacgaaagttatggtaaaatcaaattagtcatatatgggaggaaaattatggaaaataaaaacaatcatttatccccgaaacctctcttccttatcctgtttatattaatcgaagtattggtagtcttaattttaccatttcgttttgttagcgcttcggtcattctattgatgaatttatggggtgttcgctattggttgaaaatgaaacgttggcttattttaaataaacgtgaaaaaatccagcaggcttcgactgtagctgaaaccaatctagcttatgtctcagaagtcatgcctgtaggagtgattgcttatcagccatcaagccaaaaaatcgaatggctcaatccattagcattgaaaatcaaagatcaaagtggattaacagaggaagaattgctagatactttttttactgcaaaagaaaaaaagaaaaaccaagtctatctagcagataaaacatttcagtttgatatggatacagtaaagggtgttgtttattttaatgatattacccaaaaccagttgttaaaactccatcagacgaacagtcagccggtgattggtattttatctattgataactatgcagatgccattgataaattagatgacaaagagatttcttatttgaactctttcgtcactacactagtttctgactggatgaatgaataccatgtctttttcaaaagaatcaacgcagaacggtttttcttcgtagcacagatgatcgatctgaaaaagatgatggataaaaaatttgatttgctggatcgctttcgagcagaagctgaaaaacagagctcgcctatcacccttagtatggggattgcttatggctcaagaaccctcgatgaaatcggtggagaagctcagaataatttagatgttgctttagtccgtggaggcgaccaagttgtcgtgaaagaggtaaaagaaggagcaaaacctgtttattatggggggaaatctgctaagaatgtcaaacgcacgcgtgttcgttctcgagcgatgagtaccgctttgcgtcggatttttgatgaaacaggcgatgtgtttatcatggggcacaagtttccggatatggatgctttaggctctgcttttggtgtcagttgtctggcacgcttcaaccagaaaaaagcttacatcgttatcaatgagaacgagatcattccagatgtagaacggtgtcttgaagaaatccataagcatcctgaattagaaatgcaactaatctctccagaacgtgccatagagctgaaaaaagaagaggacctcctcgtgatggtggattaccataaaccttctctatcgatctctcagggcctatatgagcaatttgataagattgtgatcattgatcaccatcgtcgtggggaagagtttccaagtaaacctctgctgacttatattgaatcttcagcttcttcagcttcagagctagtttctgagctgatccaataccaaagcagcaaaacaaatcgcttagatcgttttgaggccacattattgcttgcagggatggttgtagatacaaatagtttcaatgtccgtacaactgcacgaacttttgacgttgccagctatgtaaggtcttgtggagcagacgcatccttagtacaatatttattaagcttggatttagcgggacggccg

SEQ ID NO: 901 - DNA (genomic), 189 bp, Enterococcus faecium; double-stranded, circular
  misc_feature (B) LOCATION 1...189
  hypothetical: NO
  anti-sense: NO
tttaacattcatttttattcctcctctattaaatatcctcatatgttactaactcaatcaaaggatcatttttcactttttgagcaaatgctgaatgaattaaaaattcgacttggtgggtacgaggatacacaaaacttgaaccatttaacaattcctgcaaatccaaatacgctgcgtgacacatga

SEQ ID NO: 902 - DNA (genomic), 1155 bp, Enterococcus faecium; double-stranded, circular
  misc_feature (B) LOCATION 1...1155
  hypothetical: NO
  anti-sense: NO
acaaacattcaaaggagatacatcatgaaagttactttaaaccgagctagctttatgcaggaattgcaaactgttcaacgagctatttcaagcaaaaccacgatccctattttgacaggtgtaaaaatcacactgacacaagaaggtttgactttgacggggagcaacgctgatatatcaattgaaacttttttgtctgttgaaaacgaaaaagcaaatatgcaaatcgaatctactggttccattgttttacaagcacgtttctttagcgaaatcattcggagacttcctgaagaaacatttactttagaagttttagaaaataaacaagtagcgatcacttctggaaaagcgaattttatcgtaaatggattagatgcagataactatcctcatcttcctgttgtcgaaagccataaccagatgaaattacctgtacacgtattgactaaactaatcaacgaaacagtttttgctgtctcacaacatgagagtcgtccaatcttgacaggtgtgcatttcattttatctgataattctttattagctgtagctactgattctcaccgtctaagtcaacgcgtgattccagtagaacaagcggctgatcattttgatattgttattcctggaaaaagtttgatcgaattatctcgctcattaacaaatgaagaagaaatcgtcgaaatcagcattatggaaaaccaagtgttgttcaaaacagaaacgatgtatttctattcccgtttgctagaaggaaactatccagataccaatcgtttgattccttcaagttttaatacagaggttgaattttctgttcctagctttttagcggcgatcgaacgggcttctttactttctcatgaaggccgtaacaacatcgttcgtttatctattcgtccagatgcggttgttttatacggaaattcgccagaaatcgggaaagtagaagaaagcttgagttatacagcaagcagtggcgatccattagatatttctttcaatccggattatatgaaagcagcgttgcgtgcatttggagatatgagcatcaaagtgaaatttatctctgctattcgtccatttacattggaaccaacggaagatggcgttcaatttattcagctgattactcctgtacgtacaaattaa

SEQ ID NO: 903 - DNA (genomic), 453 bp, Enterococcus faecium; double-stranded, circular
  misc_feature (B) LOCATION 1...453
  hypothetical: NO
  anti-sense: NO
atgagcattcaaaacgttggcagggtgattaatatggaaaaagaaacgatagttgaagtaaccaaactaggtttcacgatccaagctgctgttaaagtaatcggtaaagacttattgatcactttaacaggcggagatacaccacatatcggaacagtcactacattttctcgtgatacagagatgcaaactgtacgtttccctagccacgatggtcggttccataaagacgatgtcttagccgaaaaaatagctgtgatcatcaaaactgccgttccgggaagttgtacgatcacttccggtatccatgttgaccatatctccaatgcacaaatcaacgcctcttttccgatgtcagaagagttaggttacaagattttagattggttggaaaaaatagatttccatatcaaagaaccagtttattataaagatggtgaaaaaccattatga

SEQ ID NO: 904 - DNA (genomic), 222 bp, Enterococcus faecium; double-stranded, circular
  misc_feature (B) LOCATION 1...222
  hypothetical: NO
  anti-sense: NO
gaagaaattcacgaaaattgcttttcaaatttttgtgaatttcagcttatttccgaaggagttgcttctgattccgccgtttatacgtgtttagagcgtgagacaaaagtgttctttacttttgtcccacgctcagtttttttatgcgtgttgttgtgcgttgtagtattcttcttccattttttgcatacgttcacgttctttttggttataccaaggtga

SEQ ID NO: 905 - DNA (genomic), 2142 bp, Enterococcus faecium; double-stranded, circular
  misc_feature (B) LOCATION 1...2142
  hypothetical: NO
  anti-sense: NO
aaggaaattcaaaatatgttaaaaaaaataaacgctgttttatcactttttgtctgcattacaatactattcttttctactaatgttataaatggtataaagacttctgaagcgctatataaaaataccgctgaaattcatatgcaatataaagatgatatggactttaacagttatataaacgctttgtatgaaatatctacacaagaaaatattaatatttctcaatatagttttactgctgttaaccaactaactattcttgctacaaaccctaacgctaacaaacactggaaattttctaaaaaaaatatattagcaagaaacgattctaaagtccattatactaataacaaaaattctaagtaccaattaaaacttccaaataattttttaaatataaatatttatcctttttctcatgtggaaaatattggattaagtgaaatattatatgtacaaggaaactcaaacaaattaattcctgtactgaaaaaatatggaacacctactatttccaatatcaatcaatcagatacttttcaaattaatactaatattgttcttgttatctgctatcttagtatatttattgtaattactacaattatatttgctttttcaaaaatgaaagaaatcactctaaaaaaaatgttaggctataactcttttgatactataaaagattctattaaagagttaaacctcttattttgttctttgattataactttcattttatctatttttttgagcatatattacagtaacgaaaattttttcctatcatttcttctatgtagtatttttcattttataattagttttttatttatcatagttactctaagtatctatcatttatctagtataaaaaattatctaaaaaattcacgaccacttaagttaaatctttgtatattaaatatctgtctattcttaagcatgatccttctgttaatagcttctacaaaagtaataaatatccataatgaagccgaaaataattctcttaaatattgggaaagaactactaatttatataaaacaaatattactaatcaattaaatagaaacaacaccgtagaagaaaataactacttgaaaaaagctagtaaatttgtttataaaatacagaagaattataaaacttttattatcgcgccatacaattacgcaactatccaagaaaataataaagaattttttattggacaaaaagtttatccaaattttgaagactatgttagtcaacctgctggtgcaggaatatgtgttgatttaaactatctaaaatattacaatcctatttcttttgaagaatctactgacttaaatttaataaactctgatccactaactacttacattctagtacctaaaaaatataaagaatatgcaaaaatgattgaaaaaaattatttagaagacatacagtttagacttgaagactctcctcctcaagctccttataaaactcctaatttgaaaaatttaaaaataaaactaatatttgttaataataaccaaaagtattttagttttaataccttatatggaaaggcaaaagataactatacaataactgatcccatagttagagttattaatccagaaataacagaatcattattttggggaaatatattgactagtgatggtggattattttttgatcagaaacatacttcaaaccaaaacttttttaatcaaattaatccgtatataaaagaatttaacctagaaaatatcataaatttttcttattctgtttttcaagaaactggtgaattattatctcaaaaaaaagtaaataaattaaatgcatatctacaatatcttttaatattaggattatttataataattaattttcaaatgatttttgttagttttactataaattcaaaaaaaatagctttaaaaaaaatatttggatattcaccaataagtcaagttttagatttatgtttactcccttttacaatagagttatttgctactatgtgttttcaattgatattttcaaaaaacacttacttgtattttataatttttatgatctttttaataaatctaattacttctattattatttataaaaaaaatagttttaaatattttaaggagaatattttatga

SEQ ID NO: 906 - DNA (genomic), 258 bp, Enterococcus faecium; double-stranded, circular
  misc_feature (B) LOCATION 1...258
  hypothetical: NO
  anti-sense: NO
gaaggaattcacgaaaattgcttttcaaatttttgtgaatttcagcttatttccgaaggagttgcttttacttccgccgtttgtacgtgtttagagcgtgagacaaaagtgttctttacttttgtcccacgctcttttctgtgcgtcttccatacttcactaagtcgatccctcttgcttcgcaccaatccttcactggtccggaaaagatcagagattgttggtgtagggccgcggtattcgttgcgccgaccatag

SEQ ID NO: 907 - DNA (genomic), 597 bp, Enterococcus faecium; double-stranded, circular
  misc_feature (B) LOCATION 1...597
  hypothetical: NO
  anti-sense: NO
aaaatgattcaagcacatgatattgtcctttttgataaacatgaaatagaagggttcaccttgcctgaatgggtcgttctaactgaaaagatgttcggaacagttcgtcgtgcgtcgacggatcacgcagaaatactaccgattggtttacgtggacctgcccgcaatcagagatggtcaacagaaatctcaaaacatgccgtcaaacaagtcattcatccgtgggacatcatcgaacaagaatcgtatagacaagagaaaatcatggattatcctgtttatcagcaatttcatgctgctagaaacatattatcaggatgtaaatggggaatcggcggcagcttaggatttgaattatcgactgggattccggcagtaaaagaaaccagtgattttgatttgctgctgtacgcaaattcaccgattgaattgccaattcaggtaattcaatcgcatcctgctttttttgagcaattcgatacccaagtagtgactcggcaaggcggtttttcactaaaagagtatttgagagagccagagaaaaaaattctattgaaaacagtcgaaggacctaaattaaccaaagaactttggtaa

SEQ ID NO: 908 - DNA (genomic), 1203 bp, Enterococcus faecium; double-stranded, circular
  misc_feature (B) LOCATION 1...1203
  hypothetical: NO
  anti-sense: NO
ttatgggttcatggcaatataaatactcaggttgaccgtgcatcattaagagaaaatggacaaaaaaatcctgtctggatccatttcggtggcggaaatctttatcgaggatttcatgcagaaatcgctcaacgtttagcggatctaggcgaattgtccactggtgtcattgtttgtgaaacattcgatgaagaaataattgaaagggcttaccaagattttgatgatttgattcttgaagtggtcatgccaagcagtggagagttcgtcaaacgtatattagctgcgacagctgacagtctgtattgtcatccagattgttctgaacactttgataagatgattcgacactttgaaaatcctagtttacaattagttacttttgctattactgaaaaaggttatcgattgaaagatacaaataataaatatataggaccgattgcagtcgatataaaaaatggtccaaagaagccatcacatacaatgagtattcttgctgcgctactttataaacgttttttatctggagcttggccgattgcacttgtctctacagataatttttcacaaaacggtagtcaattacgtacttctttgctaacgatcgcaaaagaatggcaaaaggaaggttatgtacaaaatacatttatccaatacttatcgaatgaagaaattgttgcgtttccatggacgatgattgatcgtatcaccccgaatccttccttgtcagttagcaaaatgttggcaaaagagggcttttcaaatatgtcgattttccaaaccgcaaaaggagataatattgatccatttgtcaatacagaggacatccattatttaatcatggaagatcattttcccaatggacgtccgaaattcgaaaaagctggagtattcttgactgatcgtgcaacggtagataaagcagatacgatgaaggtgacgacttgccttaatcctttgcatacgtctttagctattatgggttgtttactggggtataggagcatagctgaggagatgaaagatccagatttatcgctgctagtttttgaaatcgggtacaatgaaggcctcccagttgtggagtctccaggtatcattgatccaaagatctttctggaagaagtaattactgtgcgctttggctcatccaccatatttctnttntatgattcgggccgggtgcccnncggaaagtag

SEQ ID NO: 909 - DNA (genomic), 1023 bp, Enterococcus faecium; double-stranded, circular
  misc_feature (B) LOCATION 1...1023
  hypothetical: NO
  anti-sense: NO
aattcttctcatttgagttcgaagtattttattttaatagataaactgttattcttacatttggaataccaaagtaggggagaggtgcttgtgagtaaaattatgactgcgtatcataaaaatgaaagattaaagaaaatagtggttattttgataaccggattgaccgctgcggtcgctttaaattattttttgattccagccaatgtcttttctgcagggatgaatgggatcgctcaaatcatttcctcgcttttatatgaatggtttcatatcaagatagacacaggaacatttatttttcttttgaatatccctgtgtttgtattagggtttctcaaagtaggaaaacgagcaacgatccttagttttgtgaatgttgtatgtgtatcggtgatgacgatgctgcttccagtcggacagatcactgataatattttgatgaatgccctagtaggcggtgttttattaggtcttggcgtaggattatctttaaaaatgggctttacaactggtgggatggatatcatctctcttgtactttcacaaacaactggaaaaacagtcggaaactacatgctgattctaaatggtatcattgtagtcatcgcaggcttcttctttaactgggaaagtgccttgtatacgattatttccatttatgcaatgactcaagtaattgatgccatccacacgagtcatcaaaaagtaacagcaatgatcgttaccgtcaagccagaagaggtaacagaagaactagcaaaacggatggtacgtggaatgacattactgccgtctgtcggtggctattcaaaaaaacaagggaacatgatcatgatggtcatcacccgctacgaaatgtatgatcttgatcagatcgttcatgaaatcgacgacgatgcatttatcaatattttaccaactcattcagtatttggccggtttgcaaatgaaaacgaacaaaaaatgtatcgaacaactggcgtattgccagaaataaaaaatcgttcacaaaaaaaatga

SEQ ID NO: 910 - DNA (genomic), 1755 bp, Enterococcus faecium; double-stranded, circular
  misc_feature (B) LOCATION 1...1755
  hypothetical: NO
  anti-sense: NO
cttggccctcaaacgtctcaatcaatgaaagtcaaagtcatcagtattgatgtcttagtcagtattgcagcgattggtgcgctttttattcaaaactatgaagaatcggctattgtcacgttcttattcttattcggacactacttggaacaacgaacattgaaccaaacgcgatctgctatcaaagaattgactgaaatggcacccgaaagcgccttgaaacaaatggataatggcgaatttgaagaagtagacgtggatgatatagatgaaggggatatcttactcgttaaaacgggtgcgaaagttccagtagatggcatagtccttacgggtgaagggcatatcaatgaagctagcattacaggggaagctgttccggtcaataagcaagctgatgcagaagtttttgcaggaaccattttagaaaacggaacgattcaaatcagagctgaccgagttggtgaggacaccacatttggtaaaattattgaactcgtggaagaagcacaagattctaaatccgaagcggaacggttcattgatcgcttttctaaatactacacaccagctgtcttggttctggcaattgttgtatgggcgttcagtcaaaatattgagttagcaatcaccatcttggttctaggttgcccaggcgcattagttatcggagtgcctgtctcaaacgttgccggtattgggaatggtgctcgtaacggtgttcttttaaaagggagtgaagtcattcaagacttcagcaaagttgatacgattgtgttcgacaaaacaggaacgctgactgtcggtaatcctgaagtcgcggaaacagaagtgtacggagacaatgtagaaaaagcctacagttatttagccagcgtggagactgaatcagaccatccactagccaaggccgtcctccagcataccggcaaggtagaactgttcccggtagaagacacagacgtcgtcaaaggcggcggcattgtcgctcaagtggacggacaccgcatcgcggttggaaatgtggcgttgatggaaaaagaaaatgtgcagttgagtaaaaaagcgcagaaagacgtcaaacaattcgagaaaaatgggaactccttagtattgacagcagtcgacggggaattgaagattctgatgggaatccgcgaccaaatccgtccaggagtgaaacaagacttgcaggaattgaagaatttaggcgtgaaagatttagtggttctttccggcgacaaccaaggcacagtggaccggattgcgcgtgaactgaacctcaccgaagcgcacgggcatatgctgccggaagacaaagcggcttatattgaaaaactccagcaaaaagggcacacggtcgcctttgtcggggacggtgtcaatgacagcccgtccttggcgctagcagatatcgggattgcaatgggaagcggaacggacgtagcgattgaaacatccgatgtcgttttaatgaactcgaacttcagcaacttgcctcacgcattaggattagtaaaagccaccgcaaataatatgaaacaaaatatcgtgatttcaattggagtagtgttggtcttgttgaccagcgtcttcttcagcgaatggatgaatatgtctatcggaatgttggttcatgaaggtagtatcttggtggtaattttcaatggcatgagattaatgaagtataagttgaaaggtcgaaaagaacaaaaagaagtatcagcacctgcagagaaagtaaaaatatcttaa

SEQ ID NO: 911 - DNA (genomic), 183 bp, Enterococcus faecium; double-stranded, circular
  misc_feature (B) LOCATION 1...183
  hypothetical: NO
  anti-sense: NO
gaagaaactcaagaaaattgctttttaaatttttgtgaatttcagcttatttccgaaggagttgcttctgcttccgccgtttatacgtgtttagagcgtgagacaaaagtgttctttacttttgtcccacgctcttttttacagataaacaatgtgttagaagtagtatcttcttttacataa

SEQ ID NO: 912 - DNA (genomic), 183 bp, Enterococcus faecium; double-stranded, circular
  misc_feature (B) LOCATION 1...183
  hypothetical: NO
  anti-sense: NO
atggccgatcttggtcaccttcttgaccttgccaattgtgaagaagcatttggatcaattcaagcaaacgttaccccagcctatcagtttcagctattccatcaaaaatatggtcttattcaatgccagttatgtattggggctattactaacaatcattatgcaagccatttaacagcatga

SEQ ID NO: 913 - DNA (genomic), 576 bp, Enterococcus faecium; double-stranded, circular
  misc_feature (B) LOCATION 1...576
  hypothetical: NO
  anti-sense: NO
gcgcctgctcaaagtgaggttactggtagggcttggcttttgcataatctttttggattcgctccttctgtcacttcactgctttttaatttacctttattgcttatctcattgtttctttttggaaaacacgcttttctccggacgatcgtcggaacatttgcgctagttttctttttacatttatgggagagccttcatatacattttgctgtatatagtctactgatcaatagtttgatgacaggtattctttctggcattggttgcggtctcgtctttcgattcggcggaagcacaggcggaacagatatcatttatcaagccattgaaaaatattttcatattaagattggcaaaagtcttttcttgattacttttggtattttagttgtctccttgctttatttggatctcacacattttctgtatacattacttagctgttctattctatcttatacattgaataaagtgaagtatctggaaattggatctgttttgccccaattggaagcaaaacagactacagaaacatttgaaccacttgatcctcttgaacagttagagcactga

SEQ ID NO: 914 - DNA (genomic), 747 bp, Enterococcus faecium; double-stranded, circular
  misc_feature (B) LOCATION 1...747
  hypothetical: NO
  anti-sense: NO
ctttgcgctcatatgttaagaattggaaggtgtgaattcgtgcgttcggtttgtatagctacctttaatggaggcagatatttaagagagcagttagatagtattttatctcagctttcagcagaagatgaagtagtcatttctgatgatgggtcagtagatgatacatgggatatattaactgaatacgcagaaaaagataagcgaatccagcttttttcggggcctcgtcaaggattgatcgctaattttggttatgcgatccagcagacgaaaggagatctaatctttttggcagaccaagatgatgtttggttggagacaaaagtgaaaaagatcactgactattttgagcagaatccggatcagctagtagtagtttctgatttaatcattgtggacagcgagctgcaagagatccatgattcgtatttttcgtttcgaaattccaaagaaggatggcttaataatgtgataagaagtcactatattggtgctggtatggctttccgtttttctttaaaacccgatattttgccgatcccgtcagaagtgccgatgcatgatatgtggattggtttgctgggaggaaagaagactgggttcttaagagaaccgttaactctgtaccgaagacatgatttaaacgcgagtgagattgaaacacattctaaattacggcaaaaaatttcttggcgtgttcatctgattacggcgttgatcaaacgaaaatggtttaaacgttga

SEQ ID NO: 915 - DNA (genomic), 522 bp, Enterococcus faecium; double-stranded, circular
  misc_feature (B) LOCATION 1...522
  hypothetical: NO
  anti-sense: NO
cgagcggctcaatcagaaaatagaagaagacgaattttaggaggaagaaaaatgattgtattgacaagagtcgaccatcggttattacacggacaagtagctttttcatggacacaaacaataggcgcagactgtattttgattgctaatgatgatgtacctacgaatgagatacgaaagacaacgatcaaattagccaagccacaaggagtcaaactagtgatcaaatcaattgatgactcgattgccgcgttgaaaagcggggtgacagataaatataagttattcatcgtagtggaatcgatcgaggatgcatataagctggcagaagcgtatccagaaatcaaaaccatcaacttaggagggatcaaggcaaaacctggtactcgcagcatcggaaaagcggtaaatattttaccagaagaggaggaacgcttgaaacgattaattgacaaacaaatagaagtagaaatccgtcaagtaccagcagataaaaaagtggatgtaagagaagttttgtaa

SEQ ID NO: 916 - DNA (genomic), 1143 bp, Enterococcus faecium; double-stranded, circular
  misc_feature (B) LOCATION 1...1143
  hypothetical: NO
  anti-sense: NO
ggattttatcagggattgcaatcgggatcgcagcgaattatcttttacgacatgtgcagacacttcaacgattccaaaaagattatgagcagggaaccaaacaaaaatggagcccaatgtttaccaaaaaataatcgtcacacaaggagtttttttatgaagctacatccaatgtgggaaaagtatcctgctttaagtaaagaattgacagaaacactaaaacggatggaagaaactgtccgcctgaaaaacaaacctgtcgaacaagcaatcaaagaaacgatccatgccggcggaaagctgttgcgtcctgcctatcagctattgttctcacaatttggaccagagcaagatcgagacaaagccatcgctttggcagcttctatcgaaatgctccatacggccacactgatccatgatgatatcgttgatgaagcggatctgcgacgtggtcagcctaatatccgtagtcagtttggtaatgtcgtttctgtctatgcaggagactatttatttgtctgctgttttaaactattgtctgattactccacttccttgaaaagtctccaattgaattctcgcagtatggaaaaagtattgaatggcgaattagggcagatggatgatcgctataattatgaactttctgtaaaagaatatttggaaaatatttcaggtaagacagctgaactgttccaattaagttgttctgttggcgcttttgaaagtggaacaagcgagcgcttcgcaaaaaaagcaggagatatcggactttctatcgggatggcctttcagattatcgatgatattttagattatacaaaagagagccaggaaatcggcaaacctgtactagaagacatgcgtcaaggggtctattctttaccgttgatctactctttgcaaaaaaacaaaccaaagctactaccttatttagagaagaaagcggcaatgacagaagaagatgtcgacgccgtacgcaaaatcgttgaacatacaggaggcgtggaagaagctaggaagttagcggcctcttacacagaaaaggctttgaaggaaataaagaaattacctgccacctctcttcgaacaaaagagaatctcttttcccttacccaactgattttggatcgcaaagactga

SEQ ID NO: 917 - DNA (genomic), 246 bp, Enterococcus faecium; double-stranded, circular
  misc_feature (B) LOCATION 1...246
  hypothetical: NO
  anti-sense: NO
tctatttatcatacaattataaaaaaggaggtgctgcttatgaaagctatccatatttctttgctttttttcgctagtgcattgattttatttgctattcatctttgttcccagccttatatcaataacaacggaatattagtggaaccagcattcttttgcttaccactcggctttttgtcccttcttgcctccgcaggcttcggatttgttgctttttttaaacgatcaaaacaacaaatctga

SEQ ID NO: 918 - DNA (genomic), 339 bp, Enterococcus faecium; double-stranded, circular
  misc_feature (B) LOCATION 1...339
  hypothetical: NO
  anti-sense: NO
gacacttatcaaaggaggtgcgaaacagttatgtttgttaaaaaaggcgataaagttaaagttatcactggaaaagacaaaaacaaagaaggcgttgtactagcagcgttcccgaaaaaagataaagttattgtcgaaggtgtaaatgtcgttaaaaaacaccaaaaaccttctcaagctgctcctcaaggtggaattgttgagatggaagcgccaattcatgtttctaacgtgatggtggttgactctactggtgtagctggccgagttggctacaaagaagtagacggcaaaaaagtccgtgtttctaaaaaaaccggtgaagttttagataaataa

SEQ ID NO: 919 - DNA (genomic), 210 bp, Enterococcus faecium; double-stranded, circular
  misc_feature (B) LOCATION 1...210
  hypothetical: NO
  anti-sense: NO
caacgttatcaaacgaatattcctgatatntatgcggtgggggatgctatcgttgtaaaacagcaaatcactggaaaagaagcacttaattctcttgcttcaccacccaatcgtcaaggtagacaagttgggggacacgatttcccggattttctcgaangaaattcaagcggtattggaacaacaaattattccaaacttttggaatga

SEQ ID NO: 920 - DNA (genomic), 222 bp, Enterococcus faecium; double-stranded, circular
  misc_feature (B) LOCATION 1...222
  hypothetical: NO
  anti-sense: NO
caggaatatcaagcagttggggccacaggaggggttgttatagggccaattgaagaagcccaatcgttcaggggttcccaaaacacgggaattaaagcggagcttataaggaagttccgcccgaacaagaaagaaatttcttgccaggccatggcgcgagagattgccccagcagagaagccgcaaaagaaagccttgagagccctagaatgggcagggtaa

SEQ ID NO: 921 - DNA (genomic), 195 bp, Enterococcus faecium; double-stranded, circular
  misc_feature (B) LOCATION 1...195
  hypothetical: NO
  anti-sense: NO
gcctttcatcaatccccaattcgaccagaacattctcctgacgcagacagagcgtgtcatggtggggagaaacaaaatccccaagtacaatatcaacaagaatgtgctggtaatcggcggttccggcagcggcaagacccgcttccacatcaagccgaacctcatgcaaatgaacgccagctatattattactga

SEQ ID NO: 922 - DNA (genomic), 231 bp, Enterococcus faecium; double-stranded, circular
  misc_feature (B) LOCATION 1...231
  hypothetical: NO
  anti-sense: NO
tccgttcatcagattttggggaatattctcaacgaaggtgttgactgggccactaccggccaggatgccgatgaaggagatggaagcgatgatcacgtaatagatcacccaagtcccataatggagggcaaccaccattttttcattgccttcacgggcagctttatccaaagaaggtgcgaagatattcataaagacgtttttcaagaacataacaacaacggcagctaa

SEQ ID NO: 923 - DNA (genomic), 195 bp, Enterococcus faecium; double-stranded, circular
  misc_feature (B) LOCATION 1...195
  hypothetical: NO
  anti-sense: NO
aaaagccatcactttgagtttgcttcacttcgtaccaatggttttctagaatcattctggctagcttttgtcgattccacaaacttcgccaatgatcaggaaaaaaatgaatataaagcaacatcatacttcctgaaagagcgagacttccaagcagacatactaaatctttcatggaccaagcgatttcaatag

SEQ ID NO: 924 - DNA (genomic), 261 bp, Enterococcus faecium; double-stranded, circular
  misc_feature (B) LOCATION 1...261
  hypothetical: NO
  anti-sense: NO
tccggacatcatcttattgatgaactaacaagtgcgcttgatcctgtttctactgggaaaatcgaaagtatgctgttagaattaagagagcggtatacgatgatcatcgtgacccataatatgtctcaagcttcacgtatttcagataagacggcattctttttagatggtcacttgatcgaatacaatgatacgaagaagatattcatgaatccagaaaaacaagagacagaagattatatttcaggtcgatttggataa

SEQ ID NO: 925 - DNA (genomic), 222 bp, Enterococcus faecium; double-stranded, circular
  misc_feature (B) LOCATION 1...222
  hypothetical: NO
  anti-sense: NO
atatttaatcatgaaggaggaaaaagaatgagtgaagaaatcagagaaaacatccatgatgtcaatctaaccagcgaaatgaaagactccttcatcgattatgcgatgagtgttattgtcgcacgtgcacttcctgatgtcagagatggtctgaaacccgttcatcgccgtattttatacggcatgaacgaattaggtgtaacaccggataaagcccagtaa

SEQ ID NO: 926 - DNA (genomic), 870 bp, Enterococcus faecium; double-stranded, circular
  misc_feature (B) LOCATION 1...870
  hypothetical: NO
  anti-sense: NO
atttataatcaacgtataggagacatggatgaaatgaaactaattggtatagatttagacggtactcttttgaattctgaccagagcattagtcaaaaaaatgcaagaacaatgaaacatttaccggaagactgttttccattcatttgttctggaagagaagtagaagacattaataatattctcaaaaaatctggtttaaggataccagcagtagggttaaatggttctgttggatttgatggagaaaaaaagatatttgagtcttccttcgataaaaatgatgtaaaaaaaattgattctgtcctatcgaaatttccaaccaaaatatatacaaatctcggaagttatgaatctcagaattataaaaataaaatgaaaaaaatttttcacgaggtagggagtgaattttctatcaaagagctaaactatgagcttgagtatgaaaaatctatttgttcaatcccttataataatattgaggaaattatagaaaaggatgctatcagcatttacaaattttttatttttattcctaatcgtcaattgaaagctaatatatttaaccatttgaaaaagatgctaaatgtgtctgttactgaatcggcacctgtaaatattgaaatcgtacctcaaaatgtatctaaaggtgtggtgtttgatcgtttggaatcaatctacaatttaaagaaacctttgagaatcgcgatcggagatagtttaaatgacttatctatgtttgaaagtgcagatattagttttgcaatgggaaatagtcatcaagaaatcatgaaaaaagctgattatgtcactgtttcaaatgataaagacggagtatctcaagcatttgaaagaattcttaccatataa

SEQ ID NO: 927 - DNA (genomic), 795 bp, Enterococcus faecium; double-stranded, circular
  misc_feature (B) LOCATION 1...795
  hypothetical: NO
  anti-sense: NO
gcagccaatcaaataggaggagaagagatggcacaaataatatctgttgcgaaccaaaaaggtggcgtcggcaaaacaacgacgacggtgaatctaggtgcttgtcttgctagccttggcaaaaaagtattgctagtggatatggatgcacaaggaaatgctaccagtggtgtcgggatcagaaaacctgatgtgacaagagacatctatgatgttctagtcaatgaattgccaattgatgaggcaactttgatcactgaacacgaaaatttgagtattgtgcctgcgactctccaattagcaggagcagagatcgaattgacgtcaatgatggcaagagaatcaagattaaaaggatctttagcagaagtaagcagtcagtatgattatattttgatcgattgcccgccttctcttggccatctgacaatcaattcatttacagcaagtgattcgattttgatacctgttcagtgtgagtattacgcattggaaggattaagccaattactgaatacggttcgtttagtccaaaaacactttaatccagaattagagatcgagggagtcttactgacaatgtatgatgcacgaacaaatctgggaaatgaagtcgtagaagaagtacgtaaatacttccgcgaaaaagtttacgaaacgatcattccaagaaatattcgtttatcagaagcacctagtcatggaaaaccgatcatcgactacgatccacgttctcgaggagctgaagtctaccaagcattggcaaaggaagtggtaagtcgtgaagaaaagtaa

SEQ ID NO: 928 - DNA (genomic), 498 bp, Enterococcus faecium; double-stranded, circular
  misc_feature (B) LOCATION 1...498
  hypothetical: NO
  anti-sense: NO
atgaacaatcaaatcacactagcgtatttagattatgatgatctagatgctttacaagttgtaagtgttgtcagtttttatgaatcgtttatcgatggcgcagatccacttgatatgcaaggatatttacagacacaattgacaactgaaatattggcagtagaattggcacagtcaaccagtaaatttattggtattaaggatcatcaaatactcattggttatatgaaagtcaatgatgaaaaagatgctatagagattcaacggctctatctgctcaaagattatcaaaacaaagggttagggcaacggttactcgatgaagcgaatcgttatgctaaaacgaaacaaaaacgttatttacgtttgactgtttatgaaaaaaatcatgcaggtattcgtttttatgaacgtcatggatttaaaaaaatcgggatcaaacattttcctttaggaaaacaagatcgtatttgtccgattttagaaaaagaaatctaa

SEQ ID NO: 929 - DNA (genomic), 498 bp, Enterococcus faecium; double-stranded, circular
  misc_feature (B) LOCATION 1...498
  hypothetical: NO
  anti-sense: NO
atgaacaatcaaatcacactagcgtatttagattatgatgatctagatgctttacaagttgtaagtgttgtcagtttttatgaatcgtttatcgatggcgcagatccacttgatatgcaaggatatttacagacacaattgacaactgaaatattggcagtagaattggcacagtcaaccagtaatttattgggtattaaggatcatcaaatactcattggtaatatgaaagtcaatgatgagaaagatgctatagagattcaacggctctatctgctcaaagattatcaagacaaagggttagggcaacggttactcgatgaagcgaatcgttatgctaaaacgaaacaaaaacgttatttacgtttgactgtttatgaaaaaaatcatgcaggtattcgtttttatgaacgtcatggatttaaaaaaatcgggatcaaacattttcctttaggaaaacaagatcgtatttgtccgattttagaaaaagaaatctaa

SEQ ID NO: 930 - DNA (genomic), 816 bp, Enterococcus faecium; double-stranded, circular
  misc_feature (B) LOCATION 1...816
  hypothetical: NO
  anti-sense: NO
atatcaaatcaaagggatcaaattaaaccagaaaacaatcaaaaagttaaatattggagggtaaaaatgacagaacatcgaagttattatgcgattataccagccaacgtaaggtacgacaaaagacttaaaccaaatactaagttgttatacggagagataacggccttgtgtaatgaaagaggcttttgttgggcaggcaatgagtactttgcagatttatatggtgtgaataaagagaccatatcgcgatgggtaagtgatttgattaagtttggatacttgaatcgggaaatcatttacaaagagggtaccaatcaaataatcaataggtacctacgaattaatcaataccctattgacgaaaaacgcaatacccctattgacgaaaaagtcaaagataataatacatctattaataatacatttaataatacaaaagaatatataagagagttaccgccttcgaaaaaatcgaaggctaagcccgtccgtcataaatacggagagtataaaaatgttcttttgtcagatgagcagatggagaaactcaaaacagaattccctaatgattaccaagagcgaatcgaacgactgtcagagtattgtgaatcatctggtaagacttataaaaactatttggcaactattcgaagttgggcaaggaaagaaaaaagtgaacctaagaacgcaagcagtggatacaagcgcacaggaagacgagagaagcttcctgaatgggcaatcgaccaagaagcctatctcaagaaaaaggcgctagaacgagctaatagacaatcaaaagcaccattctaa

SEQ ID NO: 931 - DNA (genomic), 330 bp, Enterococcus faecium; double-stranded, circular
  misc_feature (B) LOCATION 1...330
  hypothetical: NO
  anti-sense: NO
gtaccaaatcaagttcattatttacttttcctgtgctgctttcgctgctcgtgcttcctgtgctactctcactactcatgcttcctgtgctactttcactactcgtactctccgtactgctttcgctgctcgtgcttcctgtgctactttcactactcgtactctccgtactgctttcgctgctcgtgttttctgtgctactttcactgctcgtactctctgtactgctttcaccgctcgtgttttctgtactgctttcactacttgtgctatccgtactgcttggcggtccaacaactgtccaactgcttggtttcaaattctccgtga

SEQ ID NO: 932 - DNA (genomic), 879 bp, Enterococcus faecium; double-stranded, circular
  misc_feature (B) LOCATION 1...879
  hypothetical: NO
  anti-sense: NO
aataaaaatcaaggagcggataaccatatgtttttattaactggaggaaatggacaattaggtacagaattgcgccatttattagatgaaaaaaatctgccatatgtttcaacagatgcaaaagacttggatatcacagatgctgagaaaacaatggcttatattacagaattaaaacccgatgttattttccattgcgcagcttacacagcagtagataaagcagaagaagaagcaaaagaattagatgagaaaatcaatgtcgatggcacaagaaatgtagcacttgcagcaaaagctgtgaatgcacaattcgtctatatcagtacagactatgttttcgatggaaaaaacaaaaatgtagaatacgaagtagacgaccaaacgaatccactaaatgaatatggtcgtacgaaattattaggcgaaaaagcagtagaagagattttagaagactattatatcatacgaacttcttgggttttcgggatctatggacacaatttcgtcttcacgatgcaacgcctagcggaaacccgcgacaaactgactgtagtaaatgaccagtttgggcgaccaacttggacacgtactttggcagaatttatggtatatgtcatcgaagaaaaagcaccatttggtatttatcatttgtcgaacgaaaatagctgttcttggtatgagttcgcaaaagaaatattgaaagatacagatgtagaagttgcacctgttacgtcagaagaatttccgcaaaaagcaacacgtccgcagtattcagtcatgagcctgaaaaagacagaagcgttaggttttgtcataccaacttggcaagaagcacttgcgcaaatgctggaagctgccaaaaaaatgaataagtaa

SEQ ID NO: 933 - DNA (genomic), 942 bp, Enterococcus faecium; double-stranded, circular
  misc_feature (B) LOCATION 1...942
  hypothetical: NO
  anti-sense: NO
gctatgaatcaagaaataaacttggctcaaatgcaaccgatcgtgtatcagcagcttcaacggagttttgagcatgggcgtatcgctcatgcttatctttttgaaggggagaaaggaacaggaaaacatgaagtaggtatatggcttgcacagcacctgttctgtacccaaatgaaagacaatctgccttgtggaaaatgcaacaattgtcagcggatcgaaaagaaagaacatccagatgttttggttattgaaccggaaggacaaaccatcaaagtcgatcagatcagacgtttgcagacggaattcagtcgcagcggttacgaatcaagaaaaaaagtttttttgatcaaagaagctgaaaaaatgaatagcagtgcggcaaacagtttgttgaaattcttggaagagccccctggagattttttagcggtgttagaaacagatgcagtaggaagaattctccctactattcaatctcgttgtcaagttctgcattttcaagaactttcgaaagaagcactgatccatcgattgcaagaagagcagattccattggaaaaagcaaaacttttggctttcttaacaaacagtttaggaaaagcagttgaaatctctcaagatgaatggtttaatgatgctaaggacttgatttatcaatggttcgtttacttgcaaaagcaagatactcaagcctttatctatgtccaaaaaaaattggtaaaatcatttaaagaaaaaacacaacagtttacaggattatctgtcttgatgttttattatcaggaagcacagcgtcaagcagtagcaaacggcgaatatggcaaagtgaaacagataaaccagataattgaacggatattgatcgcagagcagaaactacgcagcaatgtcagttttcaggctgttgcggaacagttcgttttgcatacgattttttag

SEQ ID NO: 934 - DNA (genomic), 720 bp, Enterococcus faecium; double-stranded, circular
  misc_feature (B) LOCATION 1...720
  hypothetical: NO
  anti-sense: NO
acgatgaatcaactagaccaacgaccaattattgcattagatttttcaactaggcaagaggtagaagactttcttcgatttttcccgaaagaagaaaaattgtttgtgaaaatcggaatggaattgttctaccaagaaggacctgaaatcgtacgttatctaaaagaggctggtcataatgtatttttagatctgaaacttcacgatattccgaatacggtcgaaaaagcaatgcggggattggcaaagcttggtgttgatctcacctgtgttcatgccgctggcggtattcgtatgatggaggcggcaatgcgaggattagaagaggggactccagaaggtggaaaacgtccgctacttctagctatcactcagcttacttctacaagtgaagaagaaatgcatgccgatcaactaatcgaagtttctttagaaaaaagtgtgatccattatgctagctgtgccaaaaaagcaggattagatggtgtggtttcttctgcttgggaagtagaagcgatcaaagaaatggcaggagacgaatttgtttgcttaactccgggtataagaccagaaggaacagtcgcaggagatcagacaagagtagtcacaccttctcaggcaaaaaagatcggctcaacttttatcgttataggtcgaccaatcactcagtcaactaatccttataaagcatatcaaacgattcaaacagaatggagctaa

SEQ ID NO: 935 - DNA (genomic), 336 bp, Enterococcus faecium; double-stranded, circular
  misc_feature (B) LOCATION 1...336
  hypothetical: NO
  anti-sense: NO
ctgaagaatcatcatcagctacacaatcttcagcaacagaagaatcaacaacacctgaatcttcaacagaagaatcaacagcgcctgaatcttcagcaacagaagaatcaacaacagcgcctgaatcttcagcaacagaagaatcaacaacagtgcctgaatcttcagcaacagaagaatcaacaacagtgcctgaatcttcaacaacagaagaatcaacaacacctgcgcctacaacaccatcaacagatcaaagtgttgatacaggaaacggcacaggaagtagtactccggctccaacgccaacaccaacacctgaacaaccaaaacctgtaa

SEQ ID NO: 936 - DNA (genomic), 399 bp, Enterococcus faecium; double-stranded, circular
  misc_feature (B) LOCATION 1...399
  hypothetical: NO
  anti-sense: NO
tttaggaatcaatcagtcagaaatcagtgcattattctcatatataaaagaaggagcgtcaagttagtgaaaatgtcagacgaggctttaaaaattatcgaggaaagtcaaaatcgggaaaagttaaaacaagtgattgatctaattgaagagcgattagtagaacatgctattgtaccaaccgagttgcagtggaccattctaattaatcacttgaatgagatgctgaaacgttctcaaagaaaggaaacgattcccgtagtcgatcgggatttgttcaaagaagtatccaaagaagccataactatttctgatgaaatagttagaagtatcggtaatttaaccgatgatgaaatatatgttttgtcgattcattttgaaacagcaaaaaataattaa

SEQ ID NO: 937 - DNA (genomic), 231 bp, Enterococcus faecium; double-stranded, circular
  misc_feature (B) LOCATION 1...231
  hypothetical: NO
  anti-sense: NO
attattgatcatagctgcattgatcatgatttcatcagaaataaactttattttcgaaccgatcggaacatttttttccacgttatttgcacctgtactgattgcaggctttctttactatttattgaatcctattgtcaagctgttgatgaaagcaaaaatcaaaagaatatgggctgtcgcaattgtgctgctccttttagttgcagcaattatttggattttacttag

SEQ ID NO: 938 - DNA (genomic), 213 bp, Enterococcus faecium; double-stranded, circular
  misc_feature (B) LOCATION 1...213
  hypothetical: NO
  anti-sense: NO
tcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaa

SEQ ID NO: 939 - DNA (genomic), 213 bp, Enterococcus faecium; double-stranded, circular; identical to SEQ ID NO: 938
  misc_feature (B) LOCATION 1...213
  hypothetical: NO
  anti-sense: NO

SEQ ID NO: 940 - DNA (genomic), 951 bp, Enterococcus faecium; double-stranded, circular
  misc_feature (B) LOCATION 1...951
  hypothetical: NO
  anti-sense: NO
aatgtcgatcatatgattggcctttcaagtctttcttttttctatatggaaaggaagaggtgtatgacagaaccaatcaaaaatttatgcaaacgtgcaactgcagcagctttagtccttatcagtttgtttgcgttaagtggttgccagacgacgaagataaatactactgaagtgtctgataaagaaaaaacggcagaatccagtaaagtgatagaaaaaaccactattccaacactttttttccacggctacagcgggacagaaaattcctttaaagggatgttgcggcgtttggaaaaaaatcagcaagcagtaaaagaattggttttaacagtaggaacagatggacaaatacaagcaacaggagatttgtctggaaaagcagacaatccgatggtccaagtattgtttgaagataataaaaataacgagtggaatcaagcagaatggatcaaaacttgtcttttgtatctgaaagaaaactacggcataaataaagtcaacatagtggggcattccatgggaggagttagtgcactacgctatttaggaacgtatggacaggatacgtcattgccacaagttcagacattaacagcaattggcgcgccttttaatgattttgtcgatgatagtgcgcagtctctgacagatgagttagcaaaggggcctgctgtcgtttctaaccgctatcaagattaccagcaaatgatcggtaatattcctataaccactcgatttttcttgattgctggtcaactagatgaaacagacttgagtgatggaacagtaccgttaaacagtgcattagcggtctatgcgttgttgaagcaacgcggaaatgaaatagaggaaaaagtagtgacaggtgaaaatgcctctcatagtatgcttcatgaaaaccaagaagtagatcagcttgtaagtcgatttatttggaaagaatag

SEQ ID NO: 941 - DNA (genomic), 1497 bp, Enterococcus faecium; double-stranded, circular
  misc_feature (B) LOCATION 1...1497
  hypothetical: NO
  anti-sense: NO
cggtcagatcaaaatagaaactgcagtagcaagaaagtgctgggaggatgcaatcgtatgtcttatgaagtgaagagtttaaatgaagaatgcgggatcttcggtgtttggggtcatccagacgccgctagtgtggcatacttcgggctccatagtcttcagcatcgaggacaagaaggtgcaggtatcgtgtccaatgatcgaggaaagcttaaggggcatcgagatttggggctgctttctgaggtattcaaagatcaaagaaaattgcagcagttaacaggagaagctgcaatcggacatgtacgttatgcaacagcaggcaatggaagtgtggacaatattcagccttttctattcaaatttcatgatcagtcgatcggcttagcgcataatggtaacttgatcaatgctcgttcccttagaaaagagttagaggaaaatggggcgatcttccattctaactccgatacggagatattgatgcatttgatccgacgaagtgaagaaacagattttttaaataaattaaaaagtgctttgaatgaagtcaaaggtggctttgcctatttattaatgacagaaacggcaatgattgccgctttggacccaaatggttttcgtccattagcaatcggacaaatgaaaaacggagcatacgtgattgcctcggaaacttgtgcattagaagttattggggcacgttttataagagatgtccagcctggtgagatagtgatcatcaatgacgaaggaatccagattgattgctttacgaaggacacgcagctttttatttgttcgatggaatatatctattttgccagaccagattcaaacatcgcagggatcaatgtgcatactgcacggaaaaatatgggacggaatttagcgaaagaatcgccagtaaaagcagatatggtcgttggcgtacctaattcttctttgtcagccgcaagcggttatgcggaagctagtggaatcccttatgaaatcggattagtaaaaaatcaatacattgcccgaacatttatccagccaacgcctgagctaagagagcaaggtgttcgaatgaaattatctgctgtacgaggagtagtggaaggtaaaaaggtgattatggtcgatgattcaattgttcggggtacgacaagcagacggatcgtccatcttttgaaagaagcaggggcaaaagaagtccatgtgaggattgcttctcctcctttgaaatatccatgtttttacgggattgatattcaaacgcgtaaagaactcattgcggcaaatcacacgattgatgaaatcaaagaatgtatcggtgcagattctttaggttttttaagtgaagagggtctgatcgaatcgatcggtctggaaaaagatgctccgtattcaggattgtgtatggcttatttcaacggagattatccgacgccgttatatgactatgaagaaaaatatcaggaatcactaaaagaaaaagtatcgttcttttaa

SEQ ID NO: 942 - DNA (genomic), 207 bp, Enterococcus faecium; double-stranded, circular
  misc_feature (B) LOCATION 1...207
  hypothetical: NO
  anti-sense: NO
tggcaggatcaaggcgtttcagttgcaaaccttcctctctttcaattagaaaaaccgcagcaggaagaagtttgtgtgctggtcaccgatgctggtgaaattcgtctccgcttatttcctgaccaagctcccctggctgtagccaactggcgctccctagctgagcaaggcgtttatgacaacacacctttcggctcgtgtcattaa

SEQ ID NO: 943 - DNA (genomic), 459 bp, Enterococcus faecium; double-stranded, circular
  misc_feature (B) LOCATION 1...459
  hypothetical: NO
  anti-sense: NO
agctggtgtcattggcgctgcctcattagccttgaaatttgcttaaaaaaacggaggcattacatggttttatgggtaattaatatcattttgctattgattgtgcttgcaatcatcttttgggaagtctatctacgagtaatggccaagcgttcagcaacgactttgacagaagaagagtttcgagaaggaatgagaaaagcacaagtaatcgatgttcgcgaaaaagatgtgtttgatgcagggcatatcttaggtgcaagaaacatcccttacactgttttgaaagattcactaggatcgattcgaaaagaccaacctatctatatctacgatcaaaagaaaagcttgagtatccgtacggcaaataaattacgtaaagcaggttataaagagatttatttgcttaagggtggttatgacggctggtctggaaaaatcaaaagcaaaaaagtataa

SEQ ID NO: 944 - DNA (genomic), 819 bp, Enterococcus faecium; double-stranded, circular
  misc_feature (B) LOCATION 1...819
  hypothetical: NO
  anti-sense: NO
ttgaggtgtcacatgcgtaaagaaattaaaaatgcaaaacgaattattgtcaaagtaggaacaagtacattgatttatcccaatggaaatatcaatcttgcggcaatcgatcagttagcttttgtcctttctgatcttagaaatcggggaaaggaagtgatcttagtctcatcaggagctgtaggcgttggtatgcataaattacatttgtcagaacgtccgactttgattcctgaacagcaagctgcggcggctgttggtcaagccgaactgatgaatatctataatcaaagattcagtgtatataatcaacagacggcacagatcctcgtgacaagagacgtggtagattatcctgaaagtcgtaaaaatgtgaggaatacattggaacagcttttgattatggacacgatccctatcgtgaacgaaaacgatactgtagcagtggatgaattagatcatctgacaaaatttggcgataatgatcagctgtcagccatcatggcaaaacttgtcgcggcagaccttttgatcgtcctttctgatatcgacgggtgttattcagataatccgactacaaatcccgaggctcagatgtatcgctatatcgataaaatcgatgaaaagattctggcacaagcaggtggtgctggtagcacatttggaacaggcggtatgcaaagtaaattaaaagccgcttctaggatatttgaagcaaacagcgcaatgattttagcaaatggaaaaaatccggcaattatttttgatattcttgcaggaaaagaagtaggtactttatttaaggaagacttgaaatga

SEQ ID NO: 945 - DNA (genomic), 243 bp, Enterococcus faecium; double-stranded, circular
  misc_feature (B) LOCATION 1...243
  hypothetical: NO
  anti-sense: NO
ttgtttcgtcataccatctggttctactttttcattttttccttctttataggcccagtgtgcagcaaccccgaattcagcgatttcatgcatttcctgtgttcggatttgaatttctaccggatttcctgccggaccgatcacggtagtatgcaaagattggtacatattagcttttggcatggcaatataatccttaaatctgccgggcattggtttccattttgtgtggattgctcctaa

SEQ ID NO: 946 - DNA (genomic), 225 bp, Enterococcus faecium; double-stranded, circular
  misc_feature (B) LOCATION 1...225
  hypothetical: NO
  anti-sense: NO
cccgtacgtcaagtaacacagattttctttcccatattgaagcaaaaacatgggattatatcctgcggcgtaaataatcgttatggtcacacgcacagcgaagtattggagacactagaagaaaatcagataaaaacatggcgaacggatcaacaaggaatgatcacctatcgctggcatccagtttgtcatcctcatgggctagtggaaacaatgatagactag

SEQ ID NO: 947 - DNA (genomic), 645 bp, Enterococcus faecium; double-stranded, circular
  misc_feature (B) LOCATION 1...645
  hypothetical: NO
  anti-sense: NO
ttacatagtcatacatttgctaaaaaagaagggaagagaatgaacaagaagttggctcaatacaaaagactactcgcactttctcaagctggtctatattatggaaaagatgtatttgataaagagcgttttgaggagatccggacgatttcattggaactgatcagtgaaataggaaaagaaactttcgaagaaataaaagcgctcacaacgattggagaaggacatccaacaccaaaagtagatgttcgtgcctatatcaaaaaagatggcaaggtcctactaatcgaagataaacggacgaaagaatggtcacttcctggtggatttgctgaaataggattgtctcctgaagaaaatgtgcgtaaagaagtctatgaagaaacaggattaacagtagaaactactcagttgcgagcagtttttgatacgaataaacaaaaagatattccacagctttttcagtattataaacttgtttttgcttgtgcgatccacggtgaagaggccaagtttattgagaataatgaaacttccaacatgggattttttagtatagaagagttgccaaagctatcagaaaagcgaacaacgaagaaacagttacttattttagaaaacaaaaaccagatctattgtgattga

SEQ ID NO: 948 - DNA (genomic), 282 bp, Enterococcus faecium; double-stranded, circular
  misc_feature (B) LOCATION 1...282
  hypothetical: NO
  anti-sense: NO
actctaagtcaacttctttgtcttcttcaacaaataactatgatagttctacgtttactcctgatcaggcacaagctttacaaatactttacggataataaacctgatctaaatgattatgatatcagttttgcattttttaaaatgatttgctcgggctatcttcttaaggcaactagtagatccattcgacaactggacggctctggtactatagatttttatcgagtttcttcacaaggtattgttacagaaacagattctctaggcgaacctttttaa

SEQ ID NO: 949 - DNA (genomic), 1254 bp, Enterococcus faecium; double-stranded, circular
  misc_feature (B) LOCATION 1...1254
  hypothetical: NO
  anti-sense: NO
aagggtggtcatttgttagagaagtttttggatatgtcgttagttcaacgtattgttgttggtattttagtcggaatattgtttggtatctttttccccacatggacatttatttcaatattgggaacgttgtttgtcagttgcttgaaggcaatcgcacctattctggtttttttcttgacgatggcgtcaattgccaagcataaaattgggaataagacattcgtgaagcctattttgatcttatatttagtgggaacattgctttctgcacttgtagcagttattgtaagttcaatttttactgttcctattactttacaagaaacagtatctgaaaaagcaccgcaaagtttggaaagtgttttatctactatgttgacgaatgtcacacaaaatcctgttcaatctcttattgatgcgaattaccttggcgtcttattctgggctgtattgttgggactagcttttcgagcacgttcagaatcgacaaaagagttggtggatcagatatctatagcgttgtcacaagtcgtacaagtgattattgcatttgctccgatagggattttaggattggtttatcaatcaattgctacgactggaatagctggattggcagagtatctgcagcttttacttgttttgatcggtacgatgctgtttgtcgcattagttgtgtacccattcctcacgtttttgtttattaaagaaaatccctatccattgattttcttttgtttgaaagaaagcgcacttcccgctttctttacccgaagttctgccgcaaatatcccgataaacatgatgttggctgaaagattgaaattgacaaaagagtcttattccatatcgatcccgttaggtgctacgatcaatatgggcggtgccgcgattaccatttccttgatgacgttgactgctgtacattctttagggattgaagcaccttttgttttgaaagtccttttatgtattttgtctgctttagctgcttgtggagcttcaggtgttgcgggcggttcactgttattgattccattagcatgtagtttgtttggtatctctaatgatgtcgcgatgcaaatcgtcggtattggatttattatcggtgttatccaggattcaatggaaactgccttaaattcgtcaagtgatctgttgtttactgcaataggagagctaggcgcgcgtaaaagaagtggggaaaaaatcaaattgaaagattgtttagatggattaagtgaacgttga

SEQ ID NO: 950 - DNA (genomic), 2283 bp, Enterococcus faecium; double-stranded, circular
  misc_feature (B) LOCATION 1...2283
  hypothetical: NO
  anti-sense: NO
attggaggtcacttaatgatgaattttaagcaattattattgcatgtcaatgcgcgcccttttatcgaccaagctcgatttggtatagaacgggaaggacagcgggttgatcttgcaggaaatctagcaaaaaccgatcatccagcaatctttggcgatcgatcctatcacccctatatccaaacagattttagcgaaacacaaacagagatgatcacccctgttaccgattctattcccgaattatttcagtatctcgctgctgtttatgatgtgactgctcgttctataccgaaagaagagatgatctggccattaagtatgccacctgccttaccggaaaaagacgaagagatcattattgcaaaattaaaaaatttcgaagatgtcttgtatcgacgttatttagcaaaagaatacgggaagcgaaaacagatggtaagcggtattcatttcaattttgaatttggcgatgagttgctaagaacattgttcagccatcaggaagaatttcaagatttttccgaattcaaaacagaactttatttgaaaacagcgagaaactttatgcgctatcgctggatgatcacttatttattcggtgcttcaccaatgagtgagaagaactactttttagatgaatcacatccgcaagaacctgttcgcagtattcgcaacagtgcgctgggctatacgaatcatccaaatgtgaaagtttcctatgcttctatgaaacagtatttagcagatatcgagcgaatgatcgaagaagggaaactttcggaggagaaagaattttatacaccgcttcgtttccgaggcggaaagaaagtcgcagatttagcaacaacaggtgttcgttatattgaattgcggaatatcgatttgaatccttatgcaagattgggtatcaatccagagcaagttcggttcttacaattattcctgatgtacatgttatggacagaagaaaaagaagactgtgaccaatgggtagcagaaggtacgactcgaaataacaaagtagcactagaacaaccatcagatcaaacagaatttcatcaagaaggtagagaaattcttgaaggaatgaagcaaatgctggttgaattggattggttggattctctttatttagtagaggaagcattgactcaaatggatcatcctgaacaaacgttagcagcgaaactctatcaagaagcacagctatcgagtcagcaagaagttgctgtggcattgggacatcaatattataaagaaagccatgaacgtccctatcagttggccggttttcgcgaaatggaactttctactcagatatttatgttcgatgccatccaaaaaggtgtccaagtcaaagtattagatgagtcggatcaatttttgcgtctgcaattccaagaccatgtagaatatgtgaaaaatgcaaacatgacaagtaaggacagctatatcgtcccacttatcatggaaaacaaaacagtaacgaaaaaagtcttaaaagaagctgggttccgggtaccaggaggcgcagaattttcatccatggaagaagcggtaaaagcttatccgagatttgccgagcaggcatttgtgatcaaacctaaatcaaccaattacgggttaggtatcacgattttcaaggaaggagctagtctggaagattatcaagcaggtttagccattgcttttcgtgaagacagttcggttttagtagaagaatttatgccgggaacggaatatcgtttctttgtgatcgacggagaagtccaagccatcatgttgcgagtccctgctaatgttattggtgacagtatccgaacagtgaaagaacttgttgaagaaaaaaatagtgaccctttgcgtggaacgaatcatcgtgcacctttagaattgatccaattaggtgaattagaacaattgatgttgaaagaacaagggttgacgatcgaatcagttccccaagccaatcaaattgtttatctaagggagaactcaaatatcagtacaggtggtgattcgatcgatatgactgatgaattttctgaagcttacaaaaaaatcgccgtttctgcggtagaagcactaggagctaagattagtggtatcgatttgattataccagataaagaaatcgatcctacaactgataaaaaagcatatgggatcatcgaagcaaatttcaatccagccatgcatatgcatgtttatccttttgcaggaaaaggcagaagattgacgatgaatgtattgaaattgttatatcctgaagtattttaa

SEQ ID NO: 951 - DNA (genomic), 660 bp, Enterococcus faecium; double-stranded, circular
  misc_feature (B) LOCATION 1...660
  hypothetical: NO
  anti-sense: NO
tcagtgggtcaaaaagtacatccaattggaatgcgtgtaggcatcatccgcgactgggatgctaaatggtatgctgaaaaagagtatgctgagttcttacacgaagatttaagaatccgtaaatttatttcaactaaacttgctgatgctgctgtatcaacagttgaaatcgaacgcgcaacaggtcgcgtaaacatttcaattcacacagctaaaccaggtatggttattggtaaaggcggttctgaagtcgaaagcctaagaaaagaattaaacaaattaactggtaaaagaatccatatcaatatcgtggaaatcaaaaaaccagatctagatgcaaaattagtaggtgaaggaatcgcacgtcaattagaaaaccgtgttgctttccgtcgcgctcaaaaacaagccatccaacgctcaatgcgtgctggcgctcaagggatcaaaactcaagtatctggtcgtctaaacggagcagatatcgctcgttcagaaggatactcagaaggaactgttcctcttcatactttacgtgcggacattgattacgcatgggaagaagcagatacaacatacggaaaactaggagttaaagtgtggatctatcgtggagaaattcttccaactaaaaaaaacactgagaaaggagggaaataa

SEQ ID NO: 952 - DNA (genomic), 204 bp, Enterococcus faecium; double-stranded, circular
  misc_feature (B) LOCATION 1...204
  hypothetical: NO
  anti-sense: NO
atatttttccaatttgcagcgggagggggttttatattgggaggttttttgcgagaaggggcattctttttcattcaggggggaaaaagtttttcattgaatggtaacaagggaaaatatgtgccgcaatacgcattccctgaaaatcaggttatggtttttgacccagggcagggtattctcccaccgcttttaattttatga

SEQ ID NO: 953 - DNA (genomic), 795 bp, Enterococcus faecium; double-stranded, circular
  misc_feature (B) LOCATION 1...795
  hypothetical: NO
  anti-sense: NO
acagtcttccagcaagatcacaatggatatagccaccaagatccaggaatattgacacatttggcagaaaagaaggcggagttcatccgtgaatatctgcctgcggatgcaaatacattgctcgcagtcatggataaagcattccgctcgtcagaaaaaatcaatttgatcatctcttccaaacatccgcgtgctcaattttactcagcagaagaagcagccgtcttagtgaatgaaggcttgaaaatcattgattgggcttcgacagcaaaagaggaggaacctgaattggtcattgctgctgcaggaacggaatctaacttagaagcattagcagctgtaactttgctgctggaagaattcccaaaactaaaaattcggttcatcaatgtcgtagatttattgaaattacgtcatccaagtcaagatccgcgtgggttgagcgatgaagaatttgatcaatattttacaaaagacaaaccgatcttatttgctttccacggttatgaaacattggtccgcacgattttctttgatcgtcataaccatcatttaatgattcatggctacaaagaaaatggagatatcacgacaccatttgacatgcgtgtagtaaatgaacttgatcgttatcatttggcaaaagacgcagctttaaaaatcaaaggaagtcaagcagaagattttgcgaaaaaaatggatcagaaattacaagaacatcaaaactatattcgtgaaaatggtattgatctgccagaagtattggattggaaatggaaaaatcttgaccaataa

SEQ ID NO: 954 - DNA (genomic), 810 bp, Enterococcus faecium; double-stranded, circular
  misc_feature (B) LOCATION 1...810
  hypothetical: NO
  anti-sense: NO
cccaaattccataagagaggtgattgtatgaagccaaatccttcagaagcaggaaaacgaatcaaacaattacgcctttcatgtggttttactatggaagaacttggaaggaaaatagataattcaccacgtgcgaccatatccaactgggaacgtgggaccaatttaccaaatccacaaaagctgaaattattatcaactatcactaattcaacaattgactggattaaatggggaactttagaagaatatataacttcataccttatcgatatagggtatgagctatatattaaggactttccagaaatacctcacaaagtctttaaagacattcaagaaagatatagtaatacgttttcgctaaataaagactatgagttattgaatcctataataaaaaatatatttacaaaatattactcaaaagattttgaagattatcgagacatagaagttaaaccagaccctaaaaaggtagggagaaaaattcgttctattagaaaaaaattaggacttactatgcaggaatttgggtacgaggtttctaattctcctagaagcactgtgtcaacatgggaacatggtggtaacttaccgaacaaagccaaactaaaaaaaattgcagacattgcgaattgtagtgtagaagatttgctttttgatgaaggctttatttctgaaaaatcccaagttaaattgataaatgaactcaaagaagaaaattcaaagctaaaagaaaaaataaaatactatgaatgtttatttgatggtatagagagtctgctgaactcacgaaaaaattcctag

SEQ ID NO: 955 - DNA (genomic), 792 bp, Enterococcus faecium; double-stranded, circular
  misc_feature (B) LOCATION 1...792
  hypothetical: NO
  anti-sense: NO
acaatgttccagatgctacttcgagttgtcggaagcataatctttcgttatactctagaagaggtgaataacgtgccaaaatacgaagaaatcgcaaatattttaagagaacgtatccgttcaaaagagtatcctctcgatagttttttgcctaatcaagtcgacttggtaaaagaatttggtgcgagccggatgacaatcaaaaaagccatcaatatcttagcaatggaaggacttgtctattcgcagcgaggatcaggaacgaaaatcttgaatcatccatttatgcaaaaagacacatcgcccgctaacgagtatgaaggtttgagtctccaaatgaaacgcagacatcgttctttgaagagtcaaatcattcattttgatgttgaattccctaatcaatatatccaagaacgattgatgatcgatgccgagcaacctgtctacaatattcaccggttaaggatcttagatggcgagccatatgttttagagcatacctttatgccagtccatcttgtgccgggtttaaaaaaagaacatttgttagcctctatctatgatcatcttcatcaagaattgaatgtccattttgcaggggcttatcgtgctatttctgcagataaaagtgatgaatatgatcagcaatatttgaactgtgcagaaaacgatcctgtactggaagttcagcaagtcgtctatctcaaagatggacagccgattgaatattcttccagccgaaaccgatttgatgttcggaactattctgtgctggatgtgcgttcaacttaa

SEQ ID NO: 956 - DNA (genomic), 1059 bp, Enterococcus faecium; double-stranded, circular
  misc_feature (B) LOCATION 1...1059
  hypothetical: NO
  anti-sense: NO
tcaaaactccagttggcatcaaaaaactcctctctttttctacgaagcgaaaaaaatcagaaaaatttctgtaattattgctttcgctgcaagaaagattgtaacagacagagaagattacaccaattcattttttgtgttaaagtattctttattggaataagtaggaggaatatgatggatatccataaattcgaagtttttcttgatttagccgaaacaatgaatttcaccaaaactgctgatcgacaattcaccacccaaggaaatatttctaaacagattctttcgttagaaacagaattagacgtcaaattattcgaacgcgcccatagaaaaatcgaattgaccgaagctggaagcttattgctcccatatgtaaaaaatgtcgtagaacaataccatgctatgcaagaagtgcttgaaacctatacgaaagacaacaatctttcattaaatatcttaacgataccgacaatgatcaattataaaggtttttccaaaatcaccgagtttttgaaacgccatcctgaatttacagtccagttgaaagaagtggaaagtgtcgaattaacttacaatgacgccaatgaacatagtgacacgatccactttgctagaagtttccaggccccaccaagttcgattgagtggttgcctactgaaacagacgattttgtagcagttctacctaaaaatcatcctttagctagtaaaaagaaattggatctaagcgaactgaaaaaggagaactttttgctccttggccccactacgaacttgtatcaacctgtactagatctgtgtcgcgaagctggatttgaaccaaaaatctcttataaaggagcaagaatcgacttgatcatcaatatgattgcaaatgacatggggattgctattgttatggaaaaaacagtcaagaatctattaaaagaaaatactgtgattctccctatttctccaacaacagagagttatcttgcatttactcgtaaagtcggtgagcattctttggcttcagatacattttgggagtatttaaatcaagaagaaaactaa

SEQ ID NO: 957 - DNA (genomic), 465 bp, Enterococcus faecium; double-stranded, circular
  misc_feature (B) LOCATION 1...465
  hypothetical: NO
  anti-sense: NO
ggagtaatccaaatgaaagtaatttttttacaagatgtaaaaggaaaaggtaaaaaaggggacatcaaagaagttccagcaggttatgcacaaaattatctaatcaaaaataacttggcaaaagaagcaacgaaaagcagtatcagtcagttagcaggacaaaagaaagcacaagaaaaacacgaagctgaaatcttggaagaagctaaaaagttaaaagaattcttggaaaaagaagatactgtagtcgaattgaaggcgaaagcaggggaagacagccgtttgtttggttcgatcccttcaaaacaaattgctgaagggttaaacaaacaatacaaaatcaaattagataaacgaaaaatcgaattagaaaatccgatccgttcactaggctacacaaacgtacctgttaagcttcatcatgaggtgacggctacgatcaaagttcatgtcgtacaagaataa

SEQ ID NO: 958 - DNA (genomic), 612 bp, Enterococcus faecium; double-stranded, circular
  misc_feature (B) LOCATION 1...612
  hypothetical: NO
  anti-sense: NO
ttagcagtccagccttttgtgctgctttttagaattaggtggaaaacaaaaatgaaaatgatcgtcgggttaggaaacccaggtaccaaataccaatatacaaaacacaatatcggctttatggtcgtggataaaattgcacgcgagcatcaagctactttcaaaaaaaatccgttcgaagcagaagttgccgaattttttcataatggagaaaagatccttttagtcaaaccacaaacattcatgaatgaatctggtcgtgcagtcggcccactaatgacttattttgggatttatccagaggaattagtcgtaatctacgatgatttggatctggcagtgggaaaaatccggctccgtcaaaagggaagtgccggcgggcataacggtatcaaaagtattatttcccatttgaatacgaatgtctttgatcgaatcaaggtgggaatcggcaggccagaagggaaaaaaacagtagtccagcatgtgcttagtcctttcagcaaagaaaatcagcctttgatagaagaaagcatgtgtcaatctgttaaagcagtcgaatatctcatagaagggcattcgttcgtggatgcgatgaatcgattcaattga

SEQ ID NO: 959 - DNA (genomic), 573 bp, Enterococcus faecium; double-stranded, circular
  misc_feature (B) LOCATION 1...573
  hypothetical: NO
  anti-sense: NO
aagaaatgtctctatgataaagacggtgaattggaactaagtgaaacagcttatcatttcttaggtggtttgctgaaacatgctcgtgcctacacagccgtttgcaatccaacagtcaattcttataaacgtctcgttccaggttatgaagcgcctgtttacgtcgcatggagcggtcgtaatcgttcgccattagtacgtgtaccagaatctcgcggtttatccacacgtttggaattgcggtcagttgatccatctgcaaacccatacttggcaatggcagtattgttgcaagcaggactagacggtatccgtaatcagatcacaccgccagcagctgttgaccgtaacatttatgtaatggatgaggaagaaagagaagctgcacatatccaggacttaccttcaactatccataatgctatcaaagaattgcgtaaggataatgtaatgattgacgcattaggacaacatatcttctcaaattttgttgaagcaaaacgtctcgaatgggcggcattcagacaaactgtttccgagtgggaaagagaacaatatctagaactttattaa

SEQ ID NO: 960 - DNA (genomic), 189 bp, Enterococcus faecium; double-stranded, circular
  misc_feature (B) LOCATION 1...189
  hypothetical: NO
  anti-sense: NO
aggctctcccataaatgtaaaaagaaaactagcgcaaatgttccgacgatcgtccggagaaaagcgtgttttccaaaaagaaacaatgagataagcaataaaggtaaattaaaaagcagtgaagtgacagaaggagcgaatccaaaaagattatgcaaaagccaagccctaccagtaacctcactttga

SEQ ID NO: 961 - DNA (genomic), 1176 bp, Enterococcus faecium; double-stranded, circular
  misc_feature (B) LOCATION 1...1176
  hypothetical: NO
  anti-sense: NO
ttgctatcccaattcttagtgcaatcgagaggatatttccaaggaaaaaatgatctgcggccttatggaacttctttgattatcgaacaggctgtgcgagtgatcgttatcttggctggtacttattacttgcgcgtattgactgacggaaccatattagaagctgtattgatcagtacagtcgcttctttcttcggtgggttagctgcgattatccatatgtatatcgtcggacgcagaaaagacttcttcgaacttaaagattttttgatttccagccgttatttcgaaagagaaaaccgatctgcctctgtctctatcattcgggaaacactaccgtttatttttgtcggctcagtcattactatcgttcaaatgatcgaccaagtaacgatgaaaccactgcttcactttttccgtccagagatcgcagatcagcaactggaattcttattcagccgtgcttctgtcaatccaaataaattgacattgatcctgatctccatggtaggaacagtagctataagcagcttgccaatattaagcacgatgaagaaaaaagatcggatacaaatcgaaaaaacagtaggagatagtttttcgattgcgttattgattcttcttccttcattgactggaatgtctttattagctggaccactatacacattgttttttggctatgatcctgaaagtgtcggcatatatccaaatggctttgctagcttctttgtttttctctttattcacgatcctatctacgatgcttcaatctttgaatcaccatcgttttgcgatccgattaactgtagaagcaattatcctgaaagtcatcttccaagtaatcggattaggattagttggcggatacgggatgagcttatcaaatggcttagcattcggtattgtctttgttcgcggctatcactttatgtgcaaagaataccgaatagcacctttagcaaagatcagcaattttttcttaaaaactttccgctccaccctgattatgcttgcagtatgttttgccgttttctttttgctgaatcagcgattgtcaatggaatcaaaaagctatgcaatgatttattgtgtggctgtaggaagtattggcggcttagtatttttattttctcaattcggaaaaaatgggtttcgaatgttgaaaaatgttaa

SEQ ID NO: 962 - DNA (genomic), 1491 bp, Enterococcus faecium; double-stranded, circular
  misc_feature (B) LOCATION 1...1491
  hypothetical: NO
  anti-sense: NO
ctaacatcccaaccagaaattattgactggagaagtatcatgacaaaaaatttaagcataaaacagatttttgcccaagcaaacaaagccatgcttctatttgctgttatccctttgctactgagcatactgttatattcgcaacagcttttgatttatcaacagacgatcgcaaatatccaaaaagcagatgcaattgctttgaaggttgatcaaaaagttttggaaagtatgtgggacttgatttctggccaagtaaccgtagatgagttcaatgaggaaaatatcctagaagaacttaggaatgatattcgagagatcaaaaataatacaaatacacttaaagaaattagtacgttagatgtatcgctacgtacgatcgatacactggaagattatcaaaacgagctgatcaataatatcttggcaaaagattttatggataccaatgaagagatcatcaatcaggtagattctgtcactcaactgctgtcagatatcttacaagattttgttcgtgtggagatcgacttagcaagcaaaaaaaatacgacacttgtccgctcgctcattctattaacaatagtggaacttggagttcttagtaccatttttttctatgcgaaaaagaatcgtcgctttttagagagaaaggtccaagaaccgatcaatcagctgatcgagatgtcagaacaactttcttcagggaaccttggctttcgtttaaccctgccggaaacactggaattacaaacacttaccgctagcatgaataaaatggcggaagatctaaaccagtctttacgggagaacgctttgaaacaataccatttagcacaaagtgaagttcgtgtattgcaagctcagattactccccattttatttataacagtttggatgccattatttctttgatcgaacaagactgctttgaagaagctctgactatgacccatgcactttccggcttttttcgtacgtctttaagcaaaggacaagactggattcctcttgaaaaagaaattagccatatcaatgattatctagtcatcttaaaaataagatacggccatatgcttgactataagatcgatataccagaaacactttttcctgtttctattttaaaaatgatcttgcagccattgattgaaaatgctgtataccatggaacgaagtacgtccgtcacaaaggatttattcgtattaccacatgcaaaattgatgagatgatccaattcaaagttatagacaacgggattggcatccctgcagaaaaactggcagaaatacgtaaagagttagccaaagggatcgattcagatttcagtatcggctacggactttacaacgtaaacaagcgtctccttctttattacggaaatgatcaaaaacctatcacgattgacagcaaataccgagaaggaacaactgtcacactgatgatccctctatctcccaaaacaattggaggaaacaaacatgtataa

SEQ ID NO: 963 - DNA (genomic), 540 bp, Enterococcus faecium; double-stranded, circular
  misc_feature (B) LOCATION 1...540
  hypothetical: NO
  anti-sense: NO
aggcctccccagttgtggagtctccaggtatcattaatcccaaaaatctttctggaagaagtaattactgtgcgcttttctaatccaaatattctgaatatgcctcagcgaatcgccacggatacatctcaaaaggtggcgattcgttatggtgagacgattaaaaaatatatggaaatagaagttaaagacccgcagacacttgtattcataccattgactctcgctgcttggcttcgataccttattggcattgatgatcaaggaaaaccattcatcccgagtccagacccactattgacagactttcagcataagctttccgatattcaactgggtacgcaagatacatcacatattcatgagaaaatggctcctattttgtcaaataaagaaatttttggtgtagatctttaccaagcagagcttggcagaaaaatagaagaaatgttcatcaagatggtagcaggaccgaatgccgtacgaaaaacattacaggattacttacaagaacatggaggaaatttatcatggaaatga

SEQ ID NO: 964 - DNA (genomic), 273 bp, Enterococcus faecium; double-stranded, circular
  misc_feature (B) LOCATION 1...273
  hypothetical: NO
  anti-sense: NO
ccagctccccaccagaggttctggatcattttctttcgcgtttgcttagctaaatcaaggaaatgcaaaatatcttttggatcgctgtttgtcaagacgacatccgcagaatcgattgcgatatctgttcctgcacctattgccatcccaatagaagcacgggctaaacttggcgcatcattaatcccatcacccaccatgattacttttttcccttggtcaagatatttctggacaacagcttctttatcatctggtaataaaccgccgtaa

SEQ ID NO: 965 - DNA (genomic), 1032 bp, Enterococcus faecium; double-stranded, circular
  misc_feature (B) LOCATION 1...1032
  hypothetical: NO
  anti-sense: NO
ccccccccccaacccttgtgtgaatatgtaaagcttgtggttctacatagtggtagaaatggaaacgggaaagcaattatagtgaaaaatggaaaaaaggaaacgattgtccgttttgaacaatacaatcatatgcctttggttatgcgcctaaaaaagcaacgctatacctgtaaaaactgtcgcacccattggacggctcaaagttattttgtccaacccagacattcaatcgcaaatcatgttagatataaaattgcttctttactgactgaaaaagtatctttatcttttattgcgaaaagctgtcaggtatctttgaccaccgttattcgtacattgaaagagtttaaaagctatttaccaaagcaatctaagaagatcctccccagagtattgatggttgacgaatttcgttcgcatgcttccatagaagataagatgagctttatttgcgcggatggcgaaacaggaaaattaatagatgttttgcctacgcgtaaattacctcgattaacaagctatttcttaggttgtaccaatccagaagaagtagaattcttggtgacagacatgaacgccgcctacttccagctcaccaaacgtgttctgccaaatgcgaaagtcgtgattgatcggtttcatattgtcaaacacatgaatcaagcgttcaatgagttgcgtatccgtgaaatgaatgaacttcgtaaagccggacagaaaagccaggcagaaaaactgaaaaagaactggcgctttttgctaaaaaatcgtgcaaacatcaaccattatgaatacaaaacatggaaaagtttccgagcaccaaaatacccatttcttactgaagcaatgatgattgatcgattgcttgagttttctccgcccctaaaggaggcgtatcccttttttcatgaattagttgaagcctttcgagacaaagaccctgacttatttttctccttattggcagaacttcccgaaacgttagatgacagctttcgggaaaagcttcaaaaaccttctgacctatga

SEQ ID NO: 966 - DNA (genomic), 327 bp, Enterococcus faecium; double-stranded, circular
  misc_feature (B) LOCATION 1...327
  hypothetical: NO
  anti-sense: NO
gaggagtgtctttatatgattagaaatccatatttacctttaactgaaacaactttttatattctgctagttttaactacacctgctcatggatatgctattattcaagaaattgataagttaagcgagggatcagttaaggtagctgctggaactatgtacggagcgattgaaaatttacttaaacttaattggatagaagaaattccaagtagggaaaaaagaagaagagtttacaaaattactgatctgggagaagaagttttaagactagaaatagaacgtctaggaagtttgattaagctatcttctgattttggatattag

SEQ ID NO: 967 - DNA (genomic), 477 bp, Enterococcus faecium; double-stranded, circular
  misc_feature (B) LOCATION 1...477
  hypothetical: NO
  anti-sense: NO
ggaattgcccaatatggctattctagggggcatttcgtgcaagacggcaaactgattaaagttctggatgcaagccaccataaaccgggtaaaggaaatacagttatgcgtatgaaactgaaagatgtccgttcaggtgcaacatacgacacaacgttcagaccagattcggtcggtgaaaaagcacatatcgacacaaaacctgtacaatatttgtacacgatggatgatacagctttcttcatggatttggaaacatatgagcaatatgaaattcctgtagaaacagtagaagaagaaatgaaatatatcctagaaaacatggaagtaaaaatccaatttttcggtagcgaagtcatcggcgttcaattaccaacaactgtcgtattacgtgttgtggaaacacaaccttccatcaaaggtgcaacagtcactggttcaggtaagccagcgacaaatggaaactggcctaagtag

SEQ ID NO: 968 - DNA (genomic), 201 bp, Enterococcus faecium; double-stranded, circular
  misc_feature (B) LOCATION 1...201
  hypothetical: NO
  anti-sense: NO
caaagagcccatttttggcacaaatacaaaacaaacccctgtaccgcaaaggatacaggggttatttatacgttcctgactggaattgaaccagcgacctatcgcttaggaggcgattgctctatcctactgagctacaggaacaatttcaataaatcaattgtagcttgtttgttttttacttgcaagcttatctgctaa

SEQ ID NO: 969 - DNA (genomic), 1326 bp, Enterococcus faecium; double-stranded, circular
  misc_feature (B) LOCATION 1...1326
  hypothetical: NO
  anti-sense: NO
tttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataa

SEQ ID NO: 970 - DNA (genomic), 444 bp, Enterococcus faecium; double-stranded, circular
  misc_feature (B) LOCATION 1...444
  hypothetical: NO
  anti-sense: NO
tttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttgccatgacggaaatcgctcgtcagaaaaataa

SEQ ID NO: 971 - DNA (genomic), 1326 bp, Enterococcus faecium; double-stranded, circular; identical to SEQ ID NO: 969
  misc_feature (B) LOCATION 1...1326
  hypothetical: NO
  anti-sense: NO

SEQ ID NO: 972 - DNA (genomic), 924 bp, Enterococcus faecium; double-stranded, circular
  misc_feature (B) LOCATION 1...924
  hypothetical: NO
  anti-sense: NO
tttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaacattacttcaattggcatacatccttcaaaatatttttctttctcaaaagatttaagttctgccacttcggcattgattag

SEQ ID NO: 973 - DNA (genomic), 1179 bp, Enterococcus faecium; double-stranded, circular
  misc_feature (B) LOCATION 1...1179
  hypothetical: NO
  anti-sense: NO
tttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccatcttcaccacggggt

SEQ ID NO: 974 - DNA (genomic), 189 bp, Enterococcus faecium; double-stranded, circular
  misc_feature (B) LOCATION 1...189
  hypothetical: NO
  anti-sense: NO
tgttttcaccagatattcctcttagggtgcggtgtaatgaaacagatacacttgcaaaagaaaattcaccgcgaatttactaaaattatgaataattatgttaatcttccgaaatttttttccaaaattaagggatcaagctggtgttatagattgtttaaggttggcaaaaaaataacttctttttaa

SEQ ID NO: 975 - DNA (genomic), 1416 bp, Enterococcus faecium; double-stranded, circular
  misc_feature (B) LOCATION 1...1416
  hypothetical: NO
  anti-sense: NO
cgaactaaccagactcgtgacgatgccggattgggtgcaagcaaagcggattatccagacagcaaaacgattactgcaaaagtcagcgaagaagataaagcacagcacacgaataagattgatcaaacatacgtcgattacgtaacagacatcgatcctaacttaagtaataatatcggatttacccgtactacaggaatcaatcttttacgtgatgtaaatggcaaagtacagcctgtcagcttctcgaatcaaaatcctgatacggaatctctttctttatctagtacgatgtcagcaatgacaggtgtgggagtgtcaagtttccctacacagcttgacactagcaaagaaaactttttaaaagacaattattctttacttgccggaagttatccagcctcagcaacagatgtcgtgctgatcgtagacggcaataataatactaatatcaacgcattgaagaatcttggatttgatgtgaaagaagacgaaaaacttgattttgatgatatcgttggtacaacattcaaattagtaaacaacaatacttactatacaaaacttccaactgggaattttatccctaatacagattatgatgcgatgtatcagaatgcttctgatgaattgaagatctcggggatcctacgcgtgaaatcttcttctacaatgaatctcttatctccaggaatcgcttatagcgatcaattaacgactcaaatcgtcaacgaaaacaaagaatcagaaatcgtcaaagctcaaagagacagtggtgtaaatgtcttaactactgaaaaagttgacgaaaatgccaaacaaacattgcttagttatttaggtggagacagctttccttcaagtatcatgatttatccgaacaattttgaagacaaagaaaagatcttggattatctagatgattacaataaaggcaaatcagatgaagataaaatcatttatactgatttagctggaacgatgactgaactgactggcggattgatggatgctatcacttatgtccttattgcttttgcagggatctctttagtaacaagtatgatcatgatcagtatcattacttatacatctgtgattgaacggacaaaagaaatcggtgtactaaaagctttaggtgcacgtaaaaaagacatcactcgcgtatttgacgcagaaacgtgtattttaggtatttcttctgggatattaggtgtgtttattgcatggctagctacgttccctatcaatagcatcttatacaacatgacggatctaaaaaatgttgctcaactaaatcctgtccatgcgattattctagtgatcgtctctactatattgacgatgcttggcggtcatcttcctgcacgaatggcagcgaaaaaagacgccgctatcgctttgcgtgcagaataa

SEQ ID NO: 976 - DNA (genomic), 186 bp, Enterococcus faecium; double-stranded, circular
  misc_feature (B) LOCATION 1...186
  hypothetical: NO
  anti-sense: NO
gggggtaaccaagaagaaaaactgaatgattatttgtatctaattccatggtatatcaaccatttcctatatagactgattatgacatggattaaaataaaaaggcactatgtcttaattgtcggttttcgagttaccgaatggcattcatcacccacctatagaggatgggcgacttctgcctga

SEQ ID NO: 977 - DNA (genomic), 2553 bp, Enterococcus faecium; double-stranded, circular
  misc_feature (B) LOCATION 1...2553
  hypothetical: NO
  anti-sense: NO
ggagaaaaccataagggagtgagcaatatgaaaatagaaactcgccagcaattattagctgttttatccaataacgaaaccggactgaccaccgctgaagtcgcccaacagatcgacttaagccgctccgccaccagtctctacttaaacgagctcttacaagagggcactgtcaaacagaccggcacgaagcccgtctattggttgcccgccagcgctgcctccgagactactgatgacgtcttcaaagcctttatcggcagtcaaggcagcgcccgggaagccatcaaaaaatgtatcgccgctgtgatgtatccgccgttaggtctgcctttactgatccatggccccagcggcgtgggcaagagcttcttagccaagctgatctatgactacttgaaacaaaacaacgccaaaggagcagagaaatttttcgtcttcaactgtgccgattatgccaacaacccggagctgctgtcgtcgattctttttggtcacaccaaaggggcctttaccggcgctgaaggcgagcggaaaggtctgctggcgcaagcggatcaaggcgtcctcttcttagatgaagtccaccgcctatcaaaggaaaaccaagaaaaacttttccaatttatggatagcggcaatttccgtcctatcggtgaagacgagaaactccaacattcccaagtccgccttttattcgccaccaccgaaacaccggaggaagttctgctgcccaccttttatcgccgaatctctgtgatcatagatctgccttctttccatgaacgaccgatctatgagcgctttgagctgatcaagtatcttttcctgcaagaagccaaacggatcaagcgggacttggccatcagtcaggaattattggactaccttagcgagcgggcctatcccggcaatgtcggcagtctggctaacgagatccgcatgtattgtgccggcgctttacaaaagaatccgacagcggagaccattgcgctcattttaggcaacgaacgcccctccttggagctgcatttcgaccagatcaacgaggcctttgctcctgatgacctgcaaacccaacaagtccagcttcaacaactgttagctagcgaccaaacgctgctccagattcaagaggagctggcgagccttcatcatcacttacgccatgaagcaggcagtgtctgcaccacggccttgggggaacgagtgaccgctagcatccaagagcaaaatcgacgcgtactaggggatctgcccttgacggaggaagccaccgccaccgtcagctgtttcttggactttaccaagaatcaactgccgatgaccctctgggaaaaccttcagtatcgcttattgaaggaacagccccgaacctatcacttggctcaattattgaccaaagaactgcctttggagctgattccggcagccaaatgcttgttggcgatcctactcataggttctgtcaatgaagagatccgctatcacgccctcttggtggctcacggggagcgcaccgcctccagtatccaaggggtcgccaacaaaatgtgcggcgagtaccttttcgacgccatcaatatgcccctcacctcctcggtccatgatatcgtggctcaggtgaagaactggctctcggaacgggagaccggtgacggcgtgatcatgctggtggatatgggctctctgacccagctttacaagagcttgaagccccagattatgggagaacttttggtaatcaacaacctcaccacctccttcgctttggagatcggccaacagctgttgaacggcagccgtttccacaccatcgccaaggcagcggaagaaaacttcgtcaccaacgtccaatattttgaaggcttctccgtggagaaaaacatcatcatctccagcatttccggccgggacgtttccaagaaactgcggggcatctgccaacaatacgtgaagccggatatcaagctgatcattctgaattacaacgaactcagcgccgccatcgaccgcgccgccgacgaaacggaatacttgaaggagacttccttgatcctgaccacttcctacttggataccgacgtcgctgtaccaacattgaatctgttggacgtgctggatgacaatgctgaacaacaattggagcagtccttccatcacttgatccatcccaacaacgtcaaaccgatgctgaatgaattcatccacttcttctccaaagaaggcctttcggagaaactggaatttctcaaccctgacgtgatcattcgtcaggtggaagacaccaccgacaagtgtgaacgccgcttcggtctgcagctgaatgccaagatgaaattcaacttgacgatgcacctggccttgatggtggaacgtactattctcggcggtgccgattacccgctaccggaagaactcagcagccttaagctcaacgacaaacctttcgaagcgaatatcaaaacgattttgtataatctggagcagttttaccggatcacgatttctgattgggagctgtatgtgttgtatgagattttgggtgggtag

SEQ ID NO: 978 - DNA (genomic), 1830 bp, Enterococcus faecium; double-stranded, circular
  misc_feature (B) LOCATION 1...1830
  hypothetical: NO
  anti-sense: NO
actatgaaccaacgattcgaatataattttgaagatgtagaacctaagttactgaaaaaaggaaaaggattaaaaaagaaaaataaatatactctcaaacaagcagaagcattagtaggatggattcaacacaattggtcagacaagacaacaattaccttgatctgttcagacacagaagaaggaacaaagtatgcttttgatggaattgaaattactccattttcgattggcggacaagaaaaattattgtttcctgatattgaaggacaaattttacaagcgccggacagcatgatttccgatcctaataaactgattttggatattaacgatcaatacaaacacgaaccagacgtagcagaaccaacaaaagaatcaaagtcaaaattaaatttgaagctcccttcagtagtattaccatttgctaagaagaaaaataaacttatgaacgaattgattgaaccagaagaaacggatatttatgaagaagaattagaagaacaagaagagatcgaagaattagttgtgtcttctgaagaaacagaagaagtagaagaaattgaaactgtttctgaaaatgaagaagaaacagaagaaatctttgactttgaagatgaagaagaagtggaaaatgtacagaaaggcgatctatctacaagtagtcaaaatgggttggaagctgtaaatgatccacaagttccaccatatatatcttcacaaactcccaattactctccacagtatcaagcgcctaatgtcttacaaccattaagaaaacacgaaacagtgcagttagttacgcttaaagagtactgtgatttgggagaagaaattgaaacttcaatttctcaaatggtcgaaaagttgaaaccagaatctttattcaaattcatagggattccttctacaggtcttacaaatactcgtattgatgaatatagaagtaaccatgctatgttgcgattagctgaagtaaaatttgaaaatttaagagagcattattcacggcaaattatttcttttaaagcagaagccctagatcgtttaagaactgcggtagatattgcttggaagaagccttacgatttagatgtgaagaaaaacaaggccgaagagttatcaaaaatggaagcagaagcagaagctaaattaaatgagttcgtgaaacgtcaggaaaacaatgtaaatgataaaatcaaaaagtttgagatcgaacaagaaatagatttaaaaaactttattgcaagacaagaggcagataaagcggtatttattgctacagagaaagatcggactcaaaatttaattgattctaaagcggaatcaatcaatgcagatttacttgaaacaaaagataaatttattgatgaagaaatgtacaaaatgaaaattgaaatgaacaaaaatttatttgatggcaagcaaaaaattaaatcagaattggctactgaactcgctaaggcaaatgataatgtttgggaaaatgcgctgaaatttattcaagaaattcaagatgaaattgaagctaaaacaccaatttgggctgctgaaatcaaggagtttaatagtttagaagaacaagaacatgaacgtatgaagcaaactaaagaacttcaattaaaagaggaaagtattgaaatcaagcgtttggaagctgaaatgaatttgaagcgtatggaagaattagatcatgaaaataaaatgcttaaaattaaacttgaaactgccctttcaaaaaatgagttattagctatggaacaagatacaaagcaagtggtgaatggatcaaacagagttggtgcacttaatttatttagtaaacgttaa

SEQ ID NO: 979 - DNA (genomic), 1131 bp, Enterococcus faecium; double-stranded, circular
  misc_feature (B) LOCATION 1...1131
  hypothetical: NO
  anti-sense: NO
cacgttgaccatggtaaaactacattaacagctgcaatcacaactgtactatctaagaaaaacggcggccaagctatggcttacgatcaaatcgatggtgctccagaagaacgcgaacgcggaatcacaatctcaacagctcacgttgagtatgaaacagatacacgccactacgctcacgttgactgcccaggacacgcggattacgttaaaaacatgatcactggtgctgctcaaatggacggagctatcttggtagtttctgctgctgacggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactccattcttcactaactaccgtccacaattctacttccgtacaactgacgtaacaggtgttgttgaattaccagaaggaactgaaatggttatgcctggcgacaacgtaacaatggaagttgaattaatccacccaatcgctatcgaaaacggtactaaattctcaatccgtgaaggcggacgtacagttggtgccggtgtcgttacagaaatcaaagcttaa

SEQ ID NO: 980 - DNA (genomic), 414 bp, Enterococcus faecium; double-stranded, circular
  misc_feature (B) LOCATION 1...414
  hypothetical: NO
  anti-sense: NO
gatttggaccaatttcgggagttggatagagctcaaataggtagggtggcacatgtggtggctctggtaaagaaagttgagaggtcntggaatggattcaaggacgcccaaacacattgggttgttctaaatggttcacgtcttccaaggttcaatttcttggagcgggtttcccgaatcaattgtgggtgcccgcaccaacttgatttcaaatcaggggaccagcaattgtccactcttgtaaaaggtttattcgatttcgtttttcggaatctttcgccaattcatctatcaaaactctcgttggtaattgtccagaacttgttggagtttttttcgaaagaatcaggcttcccaggggttctttcggagcgactcagtattcttatcaggtcggtagaaacatgtcaataa

SEQ ID NO: 981 - DNA (genomic), 270 bp, Enterococcus faecium; double-stranded, circular
  misc_feature (B) LOCATION 1...270
  hypothetical: NO
  anti-sense: NO
aatttttgccatttaaaaagaaaagtgacagataggaataaaaacttattaaatgtagttatgatctgttatatttcatttctaatactaggtcttccacaagcagtgtttcctgaaatgttttctggagactggggtattgtcagctattctatattaacattgattgctatggttttaggtacttcattttataatgcttttgtaagtaagcatgttgaggaatatgaagtattaatgtacttaaaagagaaaaaaacaagtaattaa

SEQ ID NO: 982 - DNA (genomic), 720 bp, Enterococcus faecium; double-stranded, circular
  misc_feature (B) LOCATION 1...720
  hypothetical: NO
  anti-sense: NO
aaaacaagccaggcattagcctacgcaagtgctttaaaacaaagcaccaaaaaagacggttattttgagatcaaagacccactatttacagatgaaacgtttatcacctttgattttgggcatttagtggaattagcagaaccaggtcattatgacgaaaagtggcaaaattggaaacttgaatctttgccgatttttcctgatcgatacgattttgaagttgcaaaagataagggaaagcagtttaaaattgttgcagaacttctcaaaaaggcaaatacaattattgttgcaacagatagcgacagagaaggtgaaaatatcgcctggtcgattatccataaagcaaatgccttttcaaaagataaaacatttaaaagactatggatcaatagcttagaaaaagatgtgatccgaagcggttttcaaaatttgcaaccaggaatgaattactatcccttttatcaagaagcgcaaacacgccaaattgccgattggttgatcggcatgaacgcaagccctttgtatacgttaaatttacaacagaagggcgtacaaggtacattttcactaggacgtgttcaaacgcccaccttataccttatttttcagcgccaggaagctagtataaaagtaaaacaagggccatttaagggcgttctaagccacacacagcgttttaaaacccaagaggagcttttttgcttttgtttcttctaa

SEQ ID NO: 983 - DNA (genomic), 849 bp, Enterococcus faecium; double-stranded, circular
  misc_feature (B) LOCATION 1...849
  hypothetical: NO
  anti-sense: NO
ctagtgagccatcacattctgttgagggggaaatcgaagatgacgaaatctaattacaaattaacaaaagaagattttaagcaaatcaatcgaagaagtttgttcacttttcaattaggttggaactatgagagaatgcagggttctggctatttatatactatcttgccacaactaagaaaaattcatggagacaatacaccagaattaaaagagatgatgaaaacacatacgcaattttttaatacttctaatttttttaatacaatcattactgggattgatcttgcaatggaagaaaaagagggaattgcttcaaaggaaaccgtatcggggctgaaagctggattgatgggttcctttgcagcgattggagattccgtatttgctgctttgattccaacgatttttggggctttggcggcgaatatggcaactgatggaaatccgataggtgtgtttatatggatttttgctcagattgttgtcatggtttttcgttggaagcaacttgaatttgcatacaaagaaggaatttccttagttactactatgcaatctcgcttaactgcattaacggacgcagccactttattaggggtattcatggtaggggcattagttgcgacaatgatcaatgttaaattttcatgggcaccaacgattggcgatgtgacattgaatatgcaaaactatatcgatatgatcttacctaaaattttacccgctgggatcgtcggcggtgtttattggttgttaggaaagaaaaatatgactcctactcgagcgatttttatcgtattaattgtgtgtgttgctttatctgcattgggcgtgatttcgaaataa

SEQ ID NO: 984 - DNA (genomic), 1587 bp, Enterococcus faecium; double-stranded, circular
  misc_feature (B) LOCATION 1...1587
  hypothetical: NO
  anti-sense: NO
acaaggagccatgctctctgcgaatgcgcagatattaggaccggtaacgatcggaaaaaacgccaaaatcggtgcaggtgccgttgtgttgaaagatgttccagacgacgctacagcggtaggagtaccagcaaaagtcgttcgaatcaaaggagaaaaagtgaggagatcagaatgataaaaatctacaatacattgaccagaaaaaaagaagaattcatccctatacaaaagggacatgtcggtatgtatgtctgcggaccgactgtgtataattatatccatatcggaaatgctcgtagcaccattgctttcgatacaattcgacgctattttgaatatcgaggctataaagtcgatttcgtatcgaatttcacggatgtagacgataaaatcatccgtacagcaaacgaattaggtattacagcaccagaagttgctgatcgtttcatccgagcatttgaagaagatacgaaagcgttgaatgtcgagcctgctacactgcatccaagagtcatggatcatatgccagatattttagcatttattcaagtgttggttgaaaaaggctatgcttatgaatcttcaggtgatgtgtattaccgtacccgtaaatttgaaaattatgggaaattaagtgaccaatccatcgatgaactggaagtcggagcaagtcagcgtacaggggaagaacagcagcaaaaagaagacccattagatttcgctttatggaaacaagcaaaacctggcgagatttcttgggattcaccatggggcaaaggacgtcccggttggcatattgaatgttccgttatggcaacaaaacatttaggagaaacgatcgatatccatggtggcgggcaagatttagaatttcctcatcatgaaaatgaaatcgcacaaagtgaagcgaaaacagggaaaaaattcgctaattactggatgcacaatggctatgtaacgattggcgaagacgatgaaaaaatgagtaaatctctagggaatttcatcactgtacatgaaatgatcaaaaacgttgatccacaagtcttgcgtttcttcatggcgaccacacaataccgtcgtccgatccgctacagtgaaacgacgatgaaagaagcagccaccaatttacaacgactgaagaatacgtttgacaatttgaaattccgccaagaaactgcctcagagaatttggcagatgatgcggataaaatcgctttgttagaaaatttagaacagcgattcatcgaagaaatggacgatgattttaatgcagcaaatgggatcacagtggtctatgagcttgctaagtggctgaacacttatctagaccagccgaaagtttctgccgctgtcttggcacaaggagaagctttattctcgcaatggctttcgatcttcggtattttatttacagcagaagagttattagatgaagagattgaacaattgatcgaagaacgaaatcaagcaagaagcaatcgtgattttgtccgaagcgacgaaattcgtgatttgttgaaagaaaaagggatcttattagaagatacaccgcaaggaacccgatggagaagagaagcatga

SEQ ID NO: 985 - DNA (genomic), 204 bp, Enterococcus faecium; double-stranded, circular
  misc_feature (B) LOCATION 1...204
  hypothetical: NO
  anti-sense: NO
cttaaaggccaccctgcgcctgaccccggacgcaaaactcaacagccgggacaagcggcggcttgcggcatcggtcagcaaggcaaagcgggacggcaggcttcccaagaccgcccagcagaccatcccctaccaggaaatgtgccgggacggtatctgtatcgtgggcgaccgctatttcaccaagcaaatccagttttatga

SEQ ID NO: 986 - DNA (genomic), 198 bp, Enterococcus faecium; double-stranded, circular
  misc_feature (B) LOCATION 1...198
  hypothetical: NO
  anti-sense: NO
cgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccaaagtttgaaaaatgctatttcgaggtagaaggatattatataagcacggttgactaa

SEQ ID NO: 987 - DNA (genomic), 186 bp, Enterococcus faecium; double-stranded, circular
  misc_feature (B) LOCATION 1...186
  hypothetical: NO
  anti-sense: NO
cgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccaatgagaaaaagcatggaatgcgctgcatcaggtatcgaggcttag

SEQ ID NO: 988 - DNA (genomic), 186 bp, Enterococcus faecium; double-stranded, circular; identical to SEQ ID NO: 987
  misc_feature (B) LOCATION 1...186
  hypothetical: NO
  anti-sense: NO

SEQ ID NO: 989 - DNA (genomic), 186 bp, Enterococcus faecium; double-stranded, circular
  misc_feature (B) LOCATION 1...186
  hypothetical: NO
  anti-sense: NO
caaaaattacaagcaattgatggattgactgtttatggtccacaagacccgaattttcggacaggagtcgttgcattcaatttggatgggttacatccccatgatgtcgcgacagctttagacatggaaggggtagccgtcagaggcaggtcatcattgtgcgcaaccgctattgaagtaccttga

SEQ ID NO: 990 - DNA (genomic), 864 bp, Enterococcus faecium; double-stranded, circular
  misc_feature (B) LOCATION 1...864
  hypothetical: NO
  anti-sense: NO
agagaattacaatttattcctaacatgtatgttgaaaagttgtatgaaatgattttgatagtaaaatatcgagtggaggtactttttatggtaacgcgtatatttattttggatgatagtttggtttttgaaaaaatgctagtagaaattttggaagaatccagaattttattaagtccttggaaatttgagatcgttcagggattgaacgttatacaatttgttgaattcattaaaaataatgaaatctattcctcagatatttttttcctagacatcgatttgaacgcctattatagcggtatcgaactaggcgaaatgcttagagaaaagaatgaaaagtgtaaaattgtttatctaacgtctcatccgaataaagcaataactgttattaatcgaaagattacgcctagtggttatttgataaaagaattcacttatgaaaaaaataaaaaaagcatccaaagttacttattgaaagaaaaagaaaactatcctgttcaacatgctacgaaaaaaaggtggacaactgtccgttatggtaatagcgatcactatatccattacgatgaaatcctttatctaatgagcatgccaggttataaaaataaaataggcctagtattgaaagatgaagagattctcgtaaacggcacaattaaaaaatataaaaaatcactcgaatatgagtatttatgtaaagatttaaaagcttatatcattaatactgaaaacattacatctattagcagagtaaacgaaatagtaacatttgcaaatggagaacaactagagatgggaaagagaagtattgataaactaaagaattttatgcaagaaaagatagaaaatgaatcattttaa

SEQ ID NO: 991 - DNA (genomic), 528 bp, Enterococcus faecium; double-stranded, circular
  misc_feature (B) LOCATION 1...528
  hypothetical: NO
  anti-sense: NO
aattttctacagattcatttttgtcaaaatgaatttcttcattaccagatagtattggttgtgattggaaagattctgttgattctatttgctgtggtgtcgaaaaagtttttgtttgtccttccgtttttggcgcttccttttttgaagattctatatggtttggttttgtcactttcgaagaagttatttcacttgtactacttgaagttgttgaagattcggtacttgaaatcgtactactttcacttgacgaagttgttgaagactcggcatttgaagtcgtactactttcacttgatgaagttgttgaagactcggcatttgaagtcgtactactttcacttgatgaagttgttgaagactcggcatttgaagtcgtactactttcacttgatgaagttgtcaaaagttcactactctctgctgttacatcggaattactcatttcagtcgtctcggttctttcttttgcaattttgtatgttgaattttcgcttgccaacacatggaaaggtgttgctataa

SEQ ID NO: 992 - DNA (genomic), 603 bp, Enterococcus faecium; double-stranded, circular
  misc_feature (B) LOCATION 1...603
  hypothetical: NO
  anti-sense: NO
aatacactacatacttctttacaaatatcaaaaagaagcaattggaaggagaacctgatgttggaaaaggatattgagagaattttgatctcacaagaagagatacaagttcgttgcaaagaactaggcaaagagttaacagaaatttaccaaaacaccaatcccctagtagtaggtgtcttaaaaggagcggtaccattcatggcagatatcgttcgttctatcgatacgtatttggaattggatttcatggatgtttcaagctacgggaatgcaacagtctcgtcaggggaagtaaaaatcgtcaaagacttagatacgaatgtagaaggtcgcgatctgttgatcgttgaagatatcattgacagcggaagaacacgtgcttatttagtggatcttttcaaataccgcaaagcaaaatcagtcaaaattgttacactacttgacaaacgtgaaggaagagtagtaaatatcgaagcagattatgttggcttcaacgtaccaaatgaatttgtggtcggttatggcttggattatgcagaagcatatcgtaaccttccgtacatcggtgtattgaaacgtagtgtttatcaatcaaattaa

SEQ ID NO: 993 - DNA (genomic), 438 bp, Enterococcus faecium; double-stranded, circular
  misc_feature (B) LOCATION 1...438
  hypothetical: NO
  anti-sense: NO
aaaaggctacataaagtgatttatgtagccttttttttggatggaagtgatgtaatgctaagagatatgcccaaaatgattcttttaatgtttgttgggttctttttaattttagtgattgcgtactattcattaaatggctatacacaagattcgtctgtgaaaggtatgcaagaaacgttaagaactacagcaatagcaaacagggatgatagtattcgagtagaaaaaggacgatttgctttaattaagtctgattttgaaaaagattttaaagaaaaatttgggaaaagtaaaaatctaaataatgaaaccgctgattataaatttgattatcttacagatgggaaggacggtattaaagcaattaaagtgaaggttgaaagtggatcaaaagaatatcaagcaacttgtattttaaatgttgcaaatgattag

SEQ ID NO: 994 - DNA (genomic), 330 bp, Enterococcus faecium; double-stranded, circular
  misc_feature (B) LOCATION 1...330
  hypothetical: NO
  anti-sense: NO
caacttatacagaatgttattttattggttcactatcgaaaaattttggagctttatttttccggtatttctcaacgaacgattagtttaactgtgggaagctccagacatacgattcgagaagttacttctcgagcagacaggaagggggtgactgaactaaccgctgatatgagcgatacttggctgcaggaatatctttttccggaaaaacaaacaacagcacgaggttaccttcctgtagactgggaatatgttcataaagaactaatgaaaaagaatatgacattgaaactccttcatagagaatatggggtacatggaacatag

SEQ ID NO: 995 - DNA (genomic), 396 bp, Enterococcus faecium; double-stranded, circular
  misc_feature (B) LOCATION 1...396
  hypothetical: NO
  anti-sense: NO
ggtctcatacatatcacttctatcataaaagggagaataaaaatgaaacaaaccactaacttgactgaagttcaagacatactgcaacagtcatccgttgccgtcatttatctttcgatgcctaattgcagtgtttgtcacgctgttcgtccacgactagaggaacttctcacacattatgatattccggcacttcatttggatgcatttgaaacaccagaagtagctagtaaatttgaagtgctgactgcgccagttgtcctgatttttcatcaaggaaaagaagtctttcggcaagcacggttcatcgactttaaaaaaatccgttatctactagatgaactgacagcagaagatgattccctttcttatgaagaaatcttccgaacaaaataa

SEQ ID NO: 996 - DNA (genomic), 195 bp, Enterococcus faecium; double-stranded, circular
  misc_feature (B) LOCATION 1...195
  hypothetical: NO
  anti-sense: NO
caaggtgtacatgacaccgactgcgtggtattgagtggccccagtccggctggcattcatggtccaagaccgccagaagacggaccgcatcatttttttatcttcagggctcatatctttagtcatcttactcatgcgaagaaatcctcctcttcatcttctttcgtcataggggcaccattattgccggaatga

SEQ ID NO: 997 - DNA (genomic), 756 bp, Enterococcus faecium; double-stranded, circular
  misc_feature (B) LOCATION 1...756
  hypothetical: NO
  anti-sense: NO
tatcaagtacatagtcgataccaccctcacttaattgagcttgatttttcttctccatattatgtagttgtgggacaactttctgacaatcagcaattgtgtcaagaacggatcaatcctttattggagttgctcgaaagggtcttctcttattacggacaggctttgctcactgtacatagacaacaaatcattatcctagtcaatcggatttccagagcctcattgctatcattgcttgataaaatccagacaaagtttaataaaatgtatcagttacagctaaactttggaattgggtcgctttgttatacagagcaagagacaccgcaatctttccttcatgccaaacaagtttgcgaatggatagctttccatcaatctgtgaacgagatccgcttttttgaagatttagacctcgggatcgttttaccagcaatcccgtcagatcaacgaacattatatgtaaaacgtattttgaaaagcctgacagaagaagaagtacatttgttcaagaagactttggcatgcttcagtaaaaataacggaagcatcaaaaattgctcagaagaattatttattcataaaaacaccttgcaatatcgattgaacaagttccattctctcactggttatacccctagaaactatgacgattatcatattctaaagctggcttttttgttgggtacaaacatgacaactacaaaaaaaccaggcgaacatatgattgttcgtctggtttttaattattaa

SEQ ID NO: 998 - DNA (genomic), 372 bp, Enterococcus faecium; double-stranded, circular
  misc_feature (B) LOCATION 1...372
  hypothetical: NO
  anti-sense: NO
gaactttcacagttgcttggaaaagaagtaacaaaagatattgaagaactcaaagacgttcttaaagagtcactttttagtggtatcgaatggatagtggtctcattaggtcgaaacggtgcctttgcaaaacatggtgatgttttctataaggtagatattcctgatatcccagttgttaatccagtcggatcaggggactcaacggtagctggtattgcatcagctttaaatagtaaaaaaagtgacgctgacttattaaaacatgcgatgacattgggtatgttaaatgctcaagaaacaatgacagggcatgtgaatatgactaattacgaaacactaaactcacaaattggagtaaaagaggtataa

SEQ ID NO: 999 - DNA (genomic), 954 bp, Enterococcus faecium; double-stranded, circular
  misc_feature (B) LOCATION 1...954
  hypothetical: NO
  anti-sense: NO
gtgaaatcacaagattacttcatcaagcgggagaaagcttggcaagagcaacagattaaagatgacaagaaacgcatgaacgagatcaagaagcgtctgcaatacgcacaggatgcgatacagaaagagatagacgcacagtgggatagtttttccaacgggcagaaaatcactcgtagcgaagcaatgaagcgtgctgatgaaatggatgtaaaagcatttgctcgcaaggctaagaagtatgttaaagagaaagacttctcacctacagcaaacaaggagttgaaactatacaacctaacgatgcgtgttaaccgcttggaattgcttaaagcaaatattggacttgagctgatagccacttttaatgatatggataaatacttctcgggagagcttaccagcgctggtttgaaagaactgcaacgtcaagcaggcatcctagaaatgacgatcgctaaaagcggttatgccaaactagtggagcaagtgataaacagctcgtttcgagcagatggatttgcaacgtttagcgaacgactatggatgtaccaagcagagttgaaagctgatttagataagttgcttgtacgtagtgtgacgatgggtagaaaccctaaacagctggctccagaattgagtaagtttctaacagaagaaggacgagagaatactaagtttaatacacaacggttgatggttacggaaactacaagggtgcagacggggattcaagagcaaagctatcgtgatgctgatattgatcagttcgtatttatatctgaaccaacagcttgtaggtactgtctgcctctaaatgggaaagtatttgatttgaaagatatgtcgccgggtgtaaattgtgcgccaatgcacccattttgcagatgtagtacggcaccttatgttgacagagaagcttttgagaagtcacttaaagaaagagggttataa

SEQ ID NO: 1000 - DNA (genomic), 192 bp, Enterococcus faecium; double-stranded, circular
  misc_feature (B) LOCATION 1...192
  hypothetical: NO
  anti-sense: NO
tttcgatcacatgggcttgtgaagaagaaagaagcagctctaacgaatgtggatttaatggttgagcgtttagttttggcagacaacacgtatatgaatttgaatgatcagcaaataaatggtcttggagttgcccagattgaacaactaatgttcccttatagaaaacttcatgaattggcagcttggtaa

SEQ ID NO: 1001 - DNA (genomic), 723 bp, Enterococcus faecium; double-stranded, circular
  misc_feature (B) LOCATION 1...723
  hypothetical: NO
  anti-sense: NO
atgatcccacaattttttagagtgaaccaatcaaatgcacatagcgatcatgtttgttatgcaacaagggaagaagtagaaaccacatcttcctttaaacagtctttaaatggatcatggcgtttttgttattcgccaaatccttcggtacgaccaaaaacattttataaaaaagattttgatgcatgttcttttgatgaaatcactgttcctagtcatattgaattagcaaattatgacaagatccattacatcaatacgatgtatccgtgggagggacatgtatttcgccgtccccctttcacgacaagccctgagaaagaggcggaagggatcttttcagctgctaaagacaatccggttggttcgtatttgacgacttttcgattagaagaaggtctaaagggaaaacaaatctcgattcattttgctggtgtagaacaagcaatgtttatttggttgaatggtcattttatcgggtatgccgaagattcgttcactccgtctgaatttgatttaacaccttatttggaagaagaaaatattctagctgtggaggtttacaaaagaagtacagctgcattcttggaagatcaggactttttccgattttttgggatcttcagagatgtcttcttagttcgctcgagcgacaacacccatttagaagatctttggatcaaacctcgcttagatgacaaatgtcaaaatggcacaacttga

SEQ ID NO: 1002 - DNA (genomic), 819 bp, Enterococcus faecium; double-stranded, circular
  misc_feature (B) LOCATION 1...819
  hypothetical: NO
  anti-sense: NO
tacaacacacaaacaacaagaaatcgaaaatcaaaaagccaaaattcgttcagaacaggaaaaaatgcgtgccagcaaacgaagactgcagcaattaaagaaccagcaacggattcaaaaagaaatcgaattagatcgataaaatcttcctggttgttgtatacgtataaacttatgttatactatatttataagtttatacgtatacaaaggagggagaaaatgacaaaagcaatggtatataagctactagaagaatttaatggaactttggctttgaaggatgctaaaaaagcgggcatttctcctgttacgatcaaacgtatggtagatcgaggggagctggatcgagagtatccaggttttttcaccttacctggtcaatttcctgatgaattgtttatggcgcaaaaaaaatatgaacgcggcattatttcacatattaccgcgttagatttgtatgatttaacagatatgatccctagacagatcgatctgactgtaccttatggttatcacgtttctgaaaaaggattgaaggaattcgcagttgagctacactatacaaaagcggaatggtatgaattaggtaagattgaaataaaaagtcgctatgggaatcctattatagcttatgatccagaaagaactttatgtgacatttggaatccctggtataccgttgaggatgaaatcaaagtaaaagcaatcaaaaactatatggagtcggacagaaaaaatcttagaaaattgaatgagtatcgacgaattttaccaacagacaaaacgatgcgttcttatattatggctttaaattaa

SEQ ID NO: 1003 - DNA (genomic), 792 bp, Enterococcus faecium; double-stranded, circular
  misc_feature (B) LOCATION 1...792
  hypothetical: NO
  anti-sense: NO
aaaagaacacacttctcacatgtgatttgtgttctttttttattttttatgtgctattcttttagtaatagtaaagcaaagggtgacgttatgaaaaggacacgtgtactatacttggaagtcgcagataaaattaaagaagatattttctcaggaaaatatccagtcggttcgatgttgccgacagaaagtgaattagaagaactgtttcaagtcagcaaaatcactgtccgaaaggcaatcgaactgctggcatcagatgaatatgtcgcaaagaaaagtggtcgtgggacgacggttctaagcaatcgtccttacaatcgattatccaaagcggcaagctttacgcaaatcttggagaactcccgatatgaagtccggaaagaaacgctggatttgcaattggtccatataaagaaggaagatcctttgttttcctttttcggtgagcaagctgtttgttttaagcgcttatattatttgaacaatcagccttatatttattttgttcattatcttccacaagaaatgatgcaattcagcagagaagaatttggcaaagaatctttgtatcgtttgctgacgaaaaaaggatatactattgactcattttctgatgatttctcggcagtatttttaacagaagaagaacaaggaattctgaaaacagacgcacagatcggcatcaaacggatacggaaatcgtctacgcaaattggggaaatgattgaatattcggaggcggtctaccatacggagctgcatccttaccatattgattatgaaacataa

SEQ ID NO: 1004 - DNA (genomic), 846 bp, Enterococcus faecium; double-stranded, circular
  misc_feature (B) LOCATION 1...846
  hypothetical: NO
  anti-sense: NO
aggaggacacataaattgagattgaaacattttttgattaccggtattggtctgatgcttactggtggcctcctagcaggtgcaacttatacattaggcgctcaaaagagtctgacttgggataatggtcctcggttgatcgatatggttactgagacaaaaaaaatcaaggatgcaaacaaaatcgtcatccatgcagaaaatcaaacagtttcggtcatacgcggattggattttgagataaaaacgacttatgataagacagaaaagccagaaataaaggagaaaaatggcgtgttgactgtgaatgcagtcaaaaaatcaacaggtgcaatcattagtttagaagacacaagtgcacaaatcactattgttgtccctgcagatcatgaattatctgaattgacaatcgaagggaataatagtgcaattgatatcaacgaagtatcaatcaaaaaagtgaatactaagacacatgatggctgggtatcgttcaatgaatttacaggaggaacaataactgcgaaagatgaattaggctcacttcgattagatgaggccaatgtggataacttgatcgtcacaggtgaaaacagcaacttccatctagaagacagtttgatcagcaaagaaggaaaagtcatcctaaacggtggcaatttatctttgcatgagatggaaaacagtggctatactatccaaacgtctggtgaatcttatattgaaaaagactaccagccaataacaaatactttgttagaacaaggacagaaaaagctaaagatcactgctaaagacacatcgatcaatattacgacggatcaagaggacaatgaaacagattga

SEQ ID NO: 1005 - DNA (genomic), 384 bp, Enterococcus faecium; double-stranded, circular
  misc_feature (B) LOCATION 1...384
  hypothetical: NO
  anti-sense: NO
ccaacggcacactggacataccgctgcgggatttgccggatgattacgaacagctttccgtgcaggcggtggacgctgcgggaaataaatcaaaaatcgtgcaggtcaagaaccccaactatcaggcggaggataacaagcagaagccctccaccggccagacacagcccccggcgaccaccgcgccggttacatccaccacgcctgcgccaacgacaccggccaccagcgcaaccacacccccgactacaccgaccaccaatccggcaacaacgactgccacaaaaccggctgccggcacgggcagcgcaaagccctccgcttcggcaagcgcagccccggacgaagaaacggacaccacgccccgcgatccgatccctttga

SEQ ID NO: 1006 - DNA (genomic), 1947 bp, Enterococcus faecium; double-stranded, circular
  misc_feature (B) LOCATION 1...1947
  hypothetical: NO
  anti-sense: NO
caaggaggtctaataacgatgactaatcagaaaaaagcttttgcagcaacaatcggctgccttttatttatgatcttcggttttatcttcgaccgattctctcttaccatcaccccacttttttatatcagtgccattatcatcggtggatataaacaaacatcggaaggcttgaaagaattgtggaatgatcggacactgaatgtggatttattgatggctttagctgctattggtgcctgtttgatcggtaattactttgaaggagcaatgttgacattcatcttttgtttaagcggtgcattagaggaatacacaactaataaaagtcaaaaagaaattactgctttgatgaatcttcaaccacaaaaagcccaattattaaaagaaaatggacaaatgcaagaagtagatgtttctcaactaaaggtggataacttggtatttgtcgctaaaggagcagctgttccgatagatggctttttagaaagcacacaggcaacgatcgatgagtctgcattaagcggtgaatctgtgcctgtagaaaaatatttaggcgatgagatgtatgcaggaacgctgaatcaaggaaatcccatcacgattcgagtaacaaaaacgagttccgaaactgtctttgctaagattatccaattagtagaagaagcgcagaatacgccaactcaaacagcttcatttatcgaacgaatcgaaaataattatgtaaaattgattttgcttgctgttcctctaatgatccttctcccccactttttcctaggttggagttgggatgaaagcttttatcgaggaatggtattattagttgtggcttctccttgtgcgcttgtcgcatctgctacaccagcttctctagctgctctttcaaattctgcaaaaaatgggattttaatcaaaggcggtatccatttagaaaagctttctgaattaaaagcgattgcctttgataaaacaggaacgctcactaaaggaaaaccagttgtaactgacagctttttctttgatgaaaaggatttggcacaacaacttcttgttgctatggaacaaaaaacgacgcatccacttgctcatgcgattttgcaatatttcgattgcacaatacctgaagaaatccaatacttaccaatagaagaaattactggttttggattacaaactacctatttaggtgcgcaatggaaagttggcaagcacgcatatgatcctgagacgatgataatcagcaaagagattgcggaaatgatcgaacgtttggaaaatcaaggcaaaaccgtgatttatctttctaaagatcagcagttaattgctgttttaggtctgctagatattccaaaagcaaatacccaacaagtaatttcctactttaaatcccaaaacatccatacaagtatgataaccggcgaccattctggcacagcaaaggccattgctgaacaagtagggattgaacattactatgcaagctgtactccggaagaaaaaacacaactagtcaaaaaagagaatgaactttaccaagtaaatgcgatggttggtgatggagtcaatgatgcgcctgctttagcagccgcttctttaggtgtcgctatggggcaagggacagatgccgctatggatatcgcagacatcgtcttaatgaaaagcgacttaaataaatttgtctacagtcatcggctatctttaaaaatgcggcggatcatcaaacaaaatattattttttcgattcttgttattctcttgttgattgcttctaacttcctgcaatttttaaatctacctcttggagttgtaggacacgaaggaagcacaatattggttattctgaatggcttgcgtttactaagacctttacctgatctttctgattcttcaaaaaaatgtaagtcttgtccactatacaaagcgcggctgtcttctgtcaaataa

SEQ ID NO: 1007 - DNA (genomic), 858 bp, Enterococcus faecium; double-stranded, circular
  misc_feature (B) LOCATION 1...858
  hypothetical: NO
  anti-sense: NO
accctgggtctaggacaatattggaaatttaggaggttcattatgaaaagaaagcatttatttcactcatttgttttcttaatgacaggacttgtgacacttgcgtttggtcatgttgcacaagctgacaacactacaacggcagagtcaagcacaagcgagacaatgcaaaaaatagagcccaaaaaagacgtatacgtaattgccagtgactctgcttttgctccatttgaatttcaaaacgcaaagggcgagtacgaaggcatcgatgtaaaattgatggaaaacatcgccaaactgcaaggatttaacatccgaatggactaccgtggtttctctgctgctttgcaagctttggaatcaggacaagcagacggaatgattgccggaatgactgtaacagatgaacgaaagaaaagctatgatttttctgattcttactttgatagcgggatccaattagctgtcaaaaaaggagatacttcgatcaagtcttatgaagatttgaaaggaaaaacagtcggagcaaaagttggtaccgaaagtgctgaatttttaagcgaccatgaatctgaatatggctattctatcaaatattttgatgctgctgatcaattgtacgacgggttaaaagttggcgcaatcgatgcaatgatggatgattatccggtaatcggttatgcgatcaaacaaggacaagaattggaaacaccgatcaaaaaagaatctggcggaaaatatgcatttgccgttaaaaaaggacaaaatcctgagcttcttaatatgttcagagagtataaaatattttgtgtaaatgaaaaaatccatacaaaaaaggaagtcccttctgtagaataa

SEQ ID NO: 1008 - DNA (genomic), 969 bp, Enterococcus faecium; double-stranded, circular
  misc_feature (B) LOCATION 1...969
  hypothetical: NO
  anti-sense: NO
tcagatcaacaagaaatttggaaggagtttttcatgatgattatcgaaattgataaattagtcaaacgctatggagattttgtagcattgaatcattttgatctgcaagtacaagaaggagaagtcttaggtctgttaggtccaaacggcagtgggaaatcgactgccatcaactgtatgctttctttgttaaattatgacaaaggaaccattaaattgttcgggacaacaatgactcctgaaaattatgctgtcaaggcaatgattggggtcgttcctcaagacgttgcggtctttgacgaactaagtgtgcaagaaaatatcgattatttttgcggtttatatgtttccgaaaaagagaaaaggaaagccttgattgaagaggtgattcaattagtgggattagaaaaatatgtttcgtttcgtccaggagaacttagtggtggcttgaaacgtcggttgaacatcgcatgtgggattgcccacaagccgcggttaatttttttagatgagccgacagtagctgtagacccccaaagtcggaataaaattttagaaagtatcaaggagctgaatcgacaaggagcaaccattgtctatacaacacattacatggaagaagtagaaattctttgcgaccagatcgtgatcatggatcaaggacaggtgattgctaaaggaaccaaagaatctctaaaagatatggtacggacggcggatcgtttgacgatcgacatcccattactcccagaaaatgtgttgtcagcgattcagcgaacaatagcttctgatggaatcgcttataaaaaaggtcagctccaagtaacaactactgaactaaatacagtattgttgccgattcttacaatcttacaagaagaaaagatcagttacggaaaaatagcaaccaaagaagcgtccttgaatgatgtctttttagagattactggcaaggatttgagagactag

SEQ ID NO: 1009 - DNA (genomic), 384 bp, Enterococcus faecium; double-stranded, circular
  misc_feature (B) LOCATION 1...384
  hypothetical: NO
  anti-sense: NO
aatagtcaacatattttaacaaataaagttaaatattttttcttgaacgaaaggaatattgatatgataacgtttgagagaataaaagaattagcgaaaaaacagggaaaatcattaaataaagttgaagaagacctaggctatggtaaaaacgtcttatatagacttaagaactcaaacccctctacagaacgtttgcaagaaattgctgactatttcgatgtctctgtagactatcttctggggcgcgaagaaaaagaggcccctaaacatgtggatttatcagaagacgatactgttttttcttttgacggaaaagaaatatctaaggagacaatgcgtaaagcgattgcaatcgctaaagctttagaggaaaatgaatag

SEQ ID NO: 1010 - DNA (genomic), 495 bp, Enterococcus faecium; double-stranded, circular
  misc_feature (B) LOCATION 1...495
  hypothetical: NO
  anti-sense: NO
aacaaccaacaatcgaagaactttttgaagacgaagaggaagagaatgaataaagaattatcaagacacgagattcgggaaatggcattgcaggctttatttccattagacttcaatgcagacctaacaaaagaagatgcgattttcaacgcaatcgaattagaccaccgcgacatgatcaacgaagatgaatcagagtttgttcctgtttatcttgatacgctagttggcggtgtctgtgcaaaaaaagatgaattggataaagtgattgaaaaacatttaaaaaacaattggcacatcaatcggatctcaaaaatggatttggtgatcttgcgtatcgcgatttttgaaatgacttatgtgacagatgtaccagcggctgttgctttaaatgaagcaatcgagttggcaaaaacatttagtgatgaccgttcacgtaaattcgtcaacggtgttttatccaatgtattgaaagaattagaagctggggcgtaa

SEQ ID NO: 1011 - DNA (genomic), 732 bp, Enterococcus faecium; double-stranded, circular
  misc_feature (B) LOCATION 1...732
  hypothetical: NO
  anti-sense: NO
ccaaaacaacattttactcaaccaccagcacgttttagtgaggctacgttgattcgtgcactagaagaaaacggggtagggcgaccttccacttatgcaccaacacttgatacgatccaaagacgctactatgtaaaattgacacaaaaaagatttgagccgactgaactaggagaaattgtcaattcattaatctgtgaattcttccctcaaatcgtcgatatccatttcacagcagaaatggaaggagatttggataaaattgaagaaggcacggaagcgtgggtcaaagtggttgatcgtttctataaaccgtttgaaaaagaactgacgaatgcggaagaaaaaatcgaaaaaattcaaatcaaagatgaaccagcaggattcgattgtgatgtctgtggacatccgatggtgataaaattagggaaatatgggaagttttatgcttgcagtaattttcctgattgtcggaatacgaaaccaatcgtaaaagaaatcggtgtgacttgcccagtatgtcatgaaggacaagtcattgaacgaaaatctaagaaaaacagactattctatggttgttcccgtttcccagaatgtgaattcacttcttgggataaaccagtgggcagaaattgtccaaaatgtgacggatatctggtcgagaagaaagtcaaaggcggtaaacaagtagtctgtgtaaatggagattacgaagaagacatccaaaaataa

SEQ ID NO: 1012 - DNA (genomic), 360 bp, Enterococcus faecium; double-stranded, circular
  misc_feature (B) LOCATION 1...360
  hypothetical: NO
  anti-sense: NO
cggatgcaacaagcgaacctatcaaatatccgattatacctacgatgcgtctacgccagtcctaaacttgctgaagtaggagttacaaaaagtcacgcctcttcgtcagatcaagtggtagagatggatcttaccagttggttcacctatcatcgtgtcaatgaaccagttgctaaggctgaattgacctttgaccagcaaaattatttgattggtgctgcagtgattagcgagcaagcagacgaattgatcgatgatttgacactcgtcatcaatcaaaaattgactaaaaaagagttggatagctatatcatggggtatcggacattggcaagtgatctctcctatttattgaaataa

SEQ ID NO: 1013 - DNA (genomic), 783 bp, Enterococcus faecium; double-stranded, circular
  misc_feature (B) LOCATION 1...783
  hypothetical: NO
  anti-sense: NO
aagaagggtcttcatatgaacaaaaaacgacgattagaaaaaattttagatatgttaaagattgatgggaccataaccataaaagaaataatagatgaactagatatttccgatatgacagcccgtagagaccttgatgctctagaagctgatggacttttaacacgtactcatggtggtgcacaattactttcctctaaaaagccacttgaaaagacacatatcgagaagaaaagtctaaatacaaaagaaaaaattgacattgctaaaaaagcctgctctttaatcaaagatggcgatactatttttattggacccggaactacacttgaacaactggcattagaattgaaaggtcgtaaaggttataaaattcgtgtcattacaaatagtctccctgtgttcttgattctaaatgatagcgaaaccattgatttattgcttcttggcggtgaatatagagaaataactggagcttttgtaggttcaatggcttcgacaaatttaaaagcaattagatttgccaaagcttttgttagtgcaaatgctgttacccataattctattgctacatatagtgacaaggaaggtgtgattcaacaacttgccctaaacaatgctgtagaaaaattcttattagtagacagtactaaattcgatcgatacgatttctttaacttctataatctagatcaactcgataccatcattacagataaccagattagccctcaacacttagaggaatttagccagtacactactattttaaaagcggactag

SEQ ID NO: 1014 - DNA (genomic), 192 bp, Enterococcus faecium; double-stranded, circular
  misc_feature (B) LOCATION 1...192
  hypothetical: NO
  anti-sense: NO
tccgccaaacaaaacggaacctacattgatcaaaactccagttggcatcaaaaaactcctctctttttctacgaagcgaaaaaaatcagaaaaatttctgtaattattgctttcgctgcaagaaagattgtaacagacagagaagattacaccaattcattttttgtgttaaagtattctttattggaataa

SEQ ID NO: 1015 - DNA (genomic), 351 bp, Enterococcus faecium; double-stranded, circular
  misc_feature (B) LOCATION 1...351
  hypothetical: NO
  anti-sense: NO
aacaacaaacacatgaaagctgcaaggatcgggatatgtggcgagagctggaatccgatgatcagtactcctaggagtgccaacaacacgatcaatacagcgatactttcttttaaagaaatatttttattcatcgtcgatctcctatttcaaatgaaaaggccctgccatgaaaaaactattcacttggcaggacctcctactaaatcagcgacaaaacgtcggctgaaagacttatttttttatttttcttctaaacttttttctacctcaatcccccaaagactctttcttgaagtgattgatgatcaatggaataacgaacatgaccactgtgatagctgctactaa

SEQ ID NO: 1016 - DNA (genomic), 261 bp, Enterococcus faecium; double-stranded, circular
  misc_feature (B) LOCATION 1...261
  hypothetical: NO
  anti-sense: NO
caaataaaacagttttctgctcgtattttttcatttttttgcttaaaaaatataaaaatattttacattaaaactgtccaaaaaagcttagcacaatcatccataaagataactctgctaagctttttaaaatcattctttcagataaaaagaaaaagatactcaaaaagtatcttccatgacccgtacgggattcgaacccgtgttaccgccgtgaaagggcggtgtcttaaccgcttgaccaacgggccaataaaataa

SEQ ID NO: 1017 - DNA (genomic), 903 bp, Enterococcus faecium; double-stranded, circular
  misc_feature (B) LOCATION 1...903
  hypothetical: NO
  anti-sense: NO
tcatcaaaacaacgatcggaatttgccacaccgcatatgaatcaagtgaaaacatatattccaacctttgacttcagttatttcacaaccgtctctatgttagtatttgcagttggaggagcggaaaaaatatccccttatgtcaactctacaagaaaccctgcaaaagaatttcctaaagggatgattttcttagcagcaatggtagggatttgtgctgtattaggttcagtcgcaatgggcatgctgtttgctagcgataatattcctaaagacttgatggcaaatggggcatacagtgcttttcaaattttaggtaattactatggtatcggtaactcattgatgattatttacgcattgacaaatatgatcggacaaatctccgcattagccttttcaatcgatgcaccgttaaaaatcttgttagcagatgcagatccagaattcgtaccaaactggctacgtaaacgtagtcataaaggtacattagtaaacggctatcttttgacaggtatcctagtaggaatcattattttgctgccaatcttcggtatcaaagatatgaatgaattacttaaatggttgacgaacttgaactcagttgttatgccaatgcgttacctatgggtattcttggcgtatatgatgttgaataaagcttataagaaattcaattctgaatataaatttgtcaaaaatccaaaaatcgggtttatcttccgtgcttggtgctttgccttcactgggttcgcctgtatcttaggaatggtgccaaaaataaattacactgccgatcctaaagcatggtggtcccagctattcacgaatatcaccacaccaatcgtcctggatcttattaagcatgatcttgccggccatcgctcctcgagaacaaaataa

SEQ ID NO: 1018 - DNA (genomic), 1203 bp, Enterococcus faecium; double-stranded, circular
  misc_feature (B) LOCATION 1...1203
  hypothetical: NO
  anti-sense: NO
cgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 1019 - DNA (genomic), 1203 bp, Enterococcus faecium; double-stranded, circular; identical to SEQ ID NO: 1018
  misc_feature (B) LOCATION 1...1203
  hypothetical: NO
  anti-sense: NO

SEQ ID NO: 1020 - DNA (genomic), 450 bp, Enterococcus faecium; double-stranded, circular
  misc_feature (B) LOCATION 1...450
  hypothetical: NO
  anti-sense: NO
cgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaatttgtggtaaatccgtctctaagtccttcgtttctagcttaa

SEQ ID NO: 1021 - DNA (genomic), 1203 bp, Enterococcus faecium; double-stranded, circular
  misc_feature (B) LOCATION 1...1203
  hypothetical: NO
  anti-sense: NO
cgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagccttttttattatcagaaaaaaattatccttacttaatgaccgatgtactttatataaaagtacgagaagaaaatcgagtactctcaaaaagctgtcatatagcgattggaataaccatagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 1022 - DNA (genomic), 834 bp, Enterococcus faecium; double-stranded, circular
  misc_feature (B) LOCATION 1...834
  hypothetical: NO
  anti-sense: NO
cgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaaatatctttaccaccattcctaa

SEQ ID NO: 1023 - DNA (genomic), 1077 bp, Enterococcus faecium; double-stranded, circular
  misc_feature (B) LOCATION 1...1077
  hypothetical: NO
  anti-sense: NO
atggaaaaacaaaaaaggttaaaaaacagccgctacatcactgggtttgatgggctccgttcattagctgtggtgggtgttatcttctatcaccttctgccaactagtatgaaaggcggctatttgggcgttccgatttttttcgtcgtatctggttatttgatcacggatctgctgcggcaggaatgggaacaaaatggaaaaatcaatatttggcaattttatgtcagaagaatgaagagactctatccggcacttgtttttatgcttgtgacagcttcggcttatatcactttgtttcagcgagggctgttaaacaatcttcgaggagttgtggtcagcagcttactgtatgtcaacaactggtggcaaatcaataacggtttatcttatttcgatcgatttgctaatgagtcaccgtttacgcatatctggtctttagcagtagaaggtcaaaactatttggtttggccgatcttgtttgtattgttgatggtatttgttcgtaaaagaaaatggatcttttatactgtgttaggtacatccttcctctccgccatcttgatgatgatcttgtatacaccaggaggcgatccaacccgtgtttattacggtaccgacactcgtctgttttctatatggttgggaagtgcgcttgcgtttgtttggccaagtacgcgtttaaagaaaaacatcccgaaacaagcgaaaaatattctgaatatcgctggaggaatctcgcttttggcactgattctttgcttcttctttttagatgatcattacaatttcatctattacggaggaatgctcctagtgagtctgttatgcgtagtgctagttgcagtgacagcacaccccggagcaagtttgaatcgatggctgacaaatccagtatttacttggattggcaaacgaagctatggcatttatctgtatcagtttccagttatgaatttttatgaagcaaaggtgactgatattgccgatcatgtattgttgcatacctttagtggaaatcacattgattctaatcatccagtgaactttcttatcgatatgtggagcgtccgctag

SEQ ID NO: 1024 - DNA (genomic), 339 bp, Enterococcus faecium; double-stranded, circular
  misc_feature (B) LOCATION 1...339
  hypothetical: NO
  anti-sense: NO
ggaggaaaacagatggctgaaaaaataaacagtgaaacactacaagtgacttcttttgatatcattttccatagcggaaatgcacggacactgatacatgaagcatttcgctcgatgcgtaaagagatgtttgaagaagtagaagagaagttgcgacaagcaaatgaagagattcttcatgcgcatcagtcacaaactcaacttctgaaagaatatgccagcgggacaaaaatagaaatggaaattatcatggtccatgcacaagatcatctgatgacgacgatgacattattggaagttgcacaggaaatgaattatttgtatcaaaaaaataaatag

SEQ ID NO: 1025 - DNA (genomic), 2640 bp, Enterococcus faecium; double-stranded, circular
  misc_feature (B) LOCATION 1...2640
  hypothetical: NO
  anti-sense: NO
gaactgaaacagcaccagaacctttactatagaagaaggaggcggcttccgatgcagccagaagaaatgccttatttcgttggtacagttgccgcgattttttttcaaaatcctagtaatttttacaaagtgcttttggtacacatcagtgaaaccacagctgattaccgtgaaaaagagattgtagtcaccggaagtttcggcgatattcaagaaaatgagacttatcgtttttatggagaattagtggatcatcctaaatacggaaggcagcttaaactcgaaagatatgagcaagaaaagccaacaactgcaaatgggatcgtagcgtatctttccagcgaaaaattcccaggaatcgggaagaaaacagcagaaaaaattgtagaattgctgggagaagatgctatcgaaaaaatcattgctgatccttcggtattaaaacaaatctccggtttgacgaagccaaaaagagaaatgcttgctgagacgattcggctaaaccacgggatggatcaagtgatcatgggactgaatcgttacgggttcggtagtcagttagctttcagtatctaccaggcctataagaacgagtctttggatatcatcgaagaaaatccgtaccagctagtcgaagacatagaaggaatcgggttcaaacgtgcagataatctagccgaacaaatcggtattgcagcagattcaccgagaagaattcgagcagctatcttgcatcagatttttcagcatgcagttcaaacaggagatacatacgtaccggcggagacattgcttcagcaaacgatccgtattttagaaacaagtcgcccaattgaaatccagcctgatcaggttgctactgtaattatccaacttgttgaagaaggaaagatacaacaagaagagactaatctttacgaaaacagtttgtacttttctgaatgggggatcggtaattcgatccagcgccttctcagtcgtaaaaaagaaatccattatcctgaaaaagaagtgcagaagaatattcggcgtatcgaaaaaatattcggcatacagtatggaccttcgcaagaacaagctatcgctgaagcaatccgttcccctctatttattttaacaggaggaccaggtacggggaaaactactgtgatcaacggaatcgtcaatctttttgcagagttgaacggactggaattggatccttcaaaatatacccaagaaatttttcctattctacttgcagcaccaactggccgagcagctaaacgaatgaacgaaacgacaggtctgcctgccagtacgatccatcgtcttctggggctgaatggacgggaaaaaacaccttcagtcagtacgaaagaattagaaggcggacttttgattgttgatgagatgtctatggtcgatacatggctggctaacacattattcaaagcgattccgacgaatatgcaagttatcttagtaggagacaaagatcagcttccctctgtcggtcctggtcaagtactccatgatcttttggaaatcgaacaaattcccaaaatggaactcaatcagatttatcggcaaggtgatggttctagtattattcctcttgcccatgagatcaaagaaggacgtctgccaaaagatttcacaaagaatcaaaaagatcgttcctatttccgaagtgatgcttatcaaattgaacccttgatctctaaaattgtggaaaaagcgaaaaataagggattccgtgcacaagatatccaagtattagcaccaatgtatcggggacctgcagggatcgatgcgttaaataaaatgatgcaggagatattcaatccagggaaacctggaaaaaaggaagtacattggaacgacaccgtttatcggataggagacaaagtcctccaattagtcaatactcccgaattgaatgtattcaatggagatatgggagaaatcacgggtatcatcttggcaaaagattctgaagataaagtggatgaattagttatccagtttgatgcaaatgaggtcacttataaaagaaacgaatggaataaaatcactctttcttattgttgctcaatccataaatcacaaggcagtgaattcaagatggttattttgcccatggtccatcaatatcagcggatgcttcagcgtaatttgctctacacggcagtgactcgcagtaaggaactgttgattttgttaggggaagagcaagcctatgtcacttgtgtagcgaatgaatcagcaagccggatgactacgttgaaatcaaggatcatggataatgataaaatgaatatcactctccggaccaaactagcagcttatgaagattctttggtcggaaatgatccatttgaagatgggaactatacaaaagagccacgggttgtaaaagaaaagctacctgtagaagatgacagtgggacgaatgaaacgaaaaaccaagtaatggaaacagtggaaccagatctgttttcttcatttgttggagaagaaaagaaagaagaggtagaacctgctgtttctaaagatttcgttcttacagcagaagtgatcgataaccagttagtagatccgatgattggtatggaaaacagttctccctacgattttataccggcaaaaaatgcttga

SEQ ID NO: 1026 - DNA (genomic), 201 bp, Enterococcus faecium; double-stranded, circular
  misc_feature (B) LOCATION 1...201
  hypothetical: NO
  anti-sense: NO
attatgaaacatttaaaaattttgtctattaaagagacacaacttatctatgggggtaccactcatagtggaaaatattatggaaatggagtgtattgcactaaaaataaatgtacggtcgattgggccaaggcaactacttgtattgcaggaatgtctataggtggttttttaggtggagcaattccagggaagtgctaa

SEQ ID NO: 1027 - DNA (genomic), 915 bp, Enterococcus faecium; double-stranded, circular
  misc_feature (B) LOCATION 1...915
  hypothetical: NO
  anti-sense: NO
aaacagaaacatttaatttattttgaggaggagcctatctatatgaaaaagaaagtctctataggagaaagaagttttacacttttcaacaatacgtttctaattttgctagctttgatctgtatcgttccttttttaaatatcatcgctacatcttttgcttctacacaagaagtcgtcgcgaaaaagtttatcctttttcctactaccttttctttagacgcgtatcgctacattctttctacgccgaccatttttagagcacttgctgtttcgattggtgttacaggtgtcggaacgatcgtcagtatgtgtgcaacttcactgatggcctacggtctttccagaaagtatttgtttggtcgaggtttcgtcaactttcttgttgtattttctatgttgttcagcggggggatgattccaacgttcttagttgttcgttctctagggctggtcaattcttactgggccatgatcctgcctgtggctgttaatgcaatgaatatgatcattatgagaaactttttccaagccttgccggatagtttggaagaatcagcaaaaatggatggttgcacagattttggtgtatttttcaaaattatgctgccattagcgttaccgtctattgctactatctcgcttttttatgctgttacttactggaacacttatatgactgctattttgtatatcaacgattcatctaaatggccgatacagattcttttacgccaaatcgtcattgtatcaagtgggatgcaagcagaaagtagtgccgttgatgtgattccaccagcacaaacagttaaaatggctgttatcgttattgcaacagtgcctatgctgattgtttatccttttgttcagaaatattttgtcaaaggagcactcgtaggttctgtcaaagggtga

SEQ ID NO: 1028 - DNA (genomic), 1773 bp, Enterococcus faecium; double-stranded, circular
  misc_feature (B) LOCATION 1...1773
  hypothetical: NO
  anti-sense: NO
tgggagaaacagacgatctgcttgcccatccagaaaaaagtgtcttcagaaaaaatgaaacatttccttgcatattatcaactggcaaacgattatgaccgaagaaatgagttgcatgctcaaccgcttcaacctataatcgaaaaagttgaatcattgcagtctttcgacgaattgaataagcaatttccagaatggctgttggatacattaccattgccatttaatctggatgtagatgcagatatgaagaatgcgcaaacgaacgccttctttgcttatccgccttctttattccttccagataagacgtattatgcatcagaccatcccaacggtgcacaactaataggcgttttctttgatatggctgttcagttattagagcttgccggcaaagaaaaaagtcaggcagaagcaatcacggaacaagcagtgcaatttgataaattgattgctcctcatgtaaaaagtgcagaagaaaacgcagattacagcaaaatgtataatccgcaatcttttgatacatttattaaatacacagataaactggacttgaaaaaacttgtcacgggtttgattgggacaactccagataaagtgatcgtaactgatccagtgtacttcgatcatttgaatgacatcctgacagaagctcattttccgttattcaaaagctggatgatcattaaaacagtacgttctcttagtggttatctatcagaagaattccgccaagtcagcggaatctattctcgcgtattgtctggaacagacgaagcaatgcctcagaaaaaagcagcgtattaccttgcctctggacaattcgatcaagtagttggcgattactacggaaaaaaatattttggcgaagctgctaaaaaagacgtagaacaaatggtgaaaaaaatgatcgccgtttataaaaaacgtctagaagaaaatgactggcttggggatgcaacaaaagaaaaagccgtcataaaattaaataacttaggtatccaagtaggctaccccgataagatcccagcattattcgaccagttcaaaacagtacctgcagatcagggtggtactttgctttcaaatactcttgttttcagcaaactcacattaaaagatcgtttcagcaaatggaacaaaccagtggatcgttcagaatgggaaatgagtgctgacacggtcaatgcttattatcatccatttcggaatgtgatcgtctttccggcagcgatccttcaagcaccattttacagtctagaacaatcaagctctgctaattatggtggaatcggagctgttatcgctcatgagatttcccatgcatttgataataacggcgctttatttgacgaatatggcaacttgaacaactggtggacagaagaagatcttacacaatttcaaaacaaagcacaagcaatgatcgaagaattcgatggtctgccttttgctgacggaaaagtaaacggaaaattaaccgtttcggaaaatattgctgatgcaggcggtctaagctgtgcattggaagcagcaaaaacggaatcagatctttctatcgaggaattctttgtcaattgggcaacgatttggcgtacaaaagcaaaaaaagaataccaacaacttttactgcaaatcgatgtccatgcccctgctaaactccgagcaaacgtgcaaccaaaaaaccttgacgaattctatgaaacatttggtatcacggaacaagacgctatgtatctagcgccagaaaaaagagtgcgaatctggtaa

SEQ ID NO: 1029 - DNA (genomic), 1821 bp, Enterococcus faecium; double-stranded, circular
  misc_feature (B) LOCATION 1...1821
  hypothetical: NO
  anti-sense: NO
ttttggaaacagaatcgggaagtgcggtcagacgaatggctggtgcagacacctttttacctctcacaagctgaagaggacttttcgttggtgaacgaggattattcattaaacggacaaaacatgatcattgcgtataattctcctgtaaaggatattacggttatcggaaaaccattcaactggggattctttttcctcggaagagatcgaggactttccttttattgggcgatgaaattagtcgtcatggtcttgcttggattcgaagtactgatgatattaacgaagaggaaaaaagctctatcgctaatcggtgcatttgcgctgacattttctccagcagtccagtggtggttcatgcaacatgtgggcgatttgattttctttactttgggactgatgattgctttttatcattatttctacaatcatgataaaaaatggctacgaacgttgatgatgcttttggtggttattttcggtattgggtttattttagtgatttacccagcccatcaagtgatgctggcgtacttgctgattttttattttgttggcctgcttatttactatagcaagaaagtttcatgggatctgttggatgtagtgttgattggaggggcagttttatttattggcggagtcatggttcatttctggctaacgtcaaaagacgcattgttagcttctttgaataccttatatccaggaaaacgggtaagtactggaggaaagtggacgattggcgaatttttttctttccttacaaattggaaaattccttttgaagatatcaactattcgaataactctgaagtggccctgttctatcacttttttccaactgtattcctagcaagtccatttgtgttatttggcaaaaaagatagcgaacaaaagttactgggacgtattttgatgattttttgtctgttttctatcttttggattaccgttgggttgccaaaatggctagcagaaatcactctgctgtcttatgttcctccattaagagccatccttacttttagttttgcggcttgtttattatcgatctggtttatcgcttatatttggagagaagatgttattcctatttggtataaattcattttgttggcagtaaatgcatggtcttatttctatgcgattacgcattcgaaaatggataattatttttcggattttgaaaccatcgcagttgctgtgttgggaacagtgattttagcttttgcattatttggctggagacgcttgttttacctcgcttttgtcgccttagttatcgtatctggctttttcgtcaatccagtcgtagaaggtacaggagcgatttttgaaaaaacactggcaaaagaaatccaaaaaatcgatcaacaagatcctggtaaagtttggttgtctgaagatgaattatataacttcaccccaacattgggagtgaaatccttcaatacagtacgcttttatccagatatagctgcatggaagaaaatcgatccgaaagaagaatacgagaagtattataatcggtatgctcatacaagagcttttatcgctaaggaagatacaaagttcattttagatcgtccagatatgttttcggtcacgttgaattttgaagacgcagaaaaattagggatcgactatgtgatcagtaaacgaccattaactgattacaaccaattatatgaagcgcagttcacgcagctatatggaccggataaagacggttatatgatttttaaagtagaatatccggattatccagatgtaccacaaacacaaactcaggaaaatcagctagtcgtacagtaa

SEQ ID NO: 1030 - DNA (genomic), 720 bp, Enterococcus faecium; double-stranded, circular
  misc_feature (B) LOCATION 1...720
  hypothetical: NO
  anti-sense: NO
atatggaaacataccgatatgaaatcaaaaaaatggaggaagtataacatgaaatttgcggtcatcgtttttccaggttcaaattgtgacgcagatatgttatgggcagttcgcgagatcatgggcgctgatgccgaatttgtacggcatgatgagtcctctttagaaggatttgatggggttttactgccgggaggattctcctatggtgactatttgagatgcggtgcgattgctcggttttctacaatcatggaagaagtgattcgttttgctgaagaagggaaaccagtattcggtacatgcaatggattccagatattgacagaagcaggacttttgccaggtgtactgagacgaaatgagtctttgcattttatttgcaaaactgtaccattgaaagtcaaccccaagacggcctttacttcagagtatgaagccgacgaaataatctatcttccagttgctcatggggaaggaaattatttctgtgacgaagaaacacttcaagaactaaaaaaaaataatcagattgcctttacttataatgacaacatcaacggcagcgtggaaaacattgcagggattacgaacaaagcagggaatgtgttaggaatgatgcctcatccagaacgtgcagtagaagacttgctaggatcagaagatgggaaacggttctttgcttccattttaaaaaacttcggaaaggtgaccgtatag

SEQ ID NO: 1031 - DNA (genomic), 435 bp, Enterococcus faecium; double-stranded, circular
  misc_feature (B) LOCATION 1...435
  hypothetical: NO
  anti-sense: NO
tgttttgaacacaaaaatttgcgatcgatatggcagaaagagaacaagttcatatcattatattcgcctctatggctggaaaaaatgcaaactgcaaaatcaacggtttattctgccacgaaatttgcagtccttggcttctccaacgctttgcgattagaattgaaaccacttggcgtagctgttacgacagtgaatccaggtccaatcgagacaaatttcttcgataaggctgatccaagcggaagctatttggaaaaagtcggacaaatcgttttagaacctgccaagttggcaaaaatgatcgtccgcaatatgagacatccaaaacgggaaatcaatcgaccgtttattttagaagttgcatcaaaattttatacgctgtttccaacgattggtgattatttagccagcggaatttttaacaaaaagtag

SEQ ID NO: 1032 - DNA (genomic), 300 bp, Enterococcus faecium; double-stranded, circular
  misc_feature (B) LOCATION 1...300
  hypothetical: NO
  anti-sense: NO
tgttttgaacatacgcgtggtgatgaatttcgcccatntgaattaatccctgtaactaaggggcgaggaaagaacacgttcgataaatggtttaataatttgaaaaatgaactgaaagaattgccaaatgtgcgacaaatcggtatttcacatgcggatgcaaaagaattggcgcaagaattcaaagagggtttgcaagaattattcccggacatgcatatccctgtactgcatacgaatccggttatcgctacgcatactggtaaagacgcgtttgcaatcatgtattatgtagattag

SEQ ID NO: 1033 - DNA (genomic), 261 bp, Enterococcus faecium; double-stranded, circular
  misc_feature (B) LOCATION 1...261
  hypothetical: NO
  anti-sense: NO
atgatagaacaagaaaatagaaattttttagaaacgcaaggtgaatatcgtcaaattaataatagtcattttgtaatttgtgaagatgtacaaatcgcttttaaaatggctttgaagtacggaaaaagtattagaaaaaagataattagagaaaaaaagagcaagaagataggcttttgggagttatctcttagggatgggctaaactttattttctgtacagaggattattatgaaaaatacaagtgtaccttatcgtaa

SEQ ID NO: 1034 - DNA (genomic), 1197 bp, Enterococcus faecium; double-stranded, circular
  misc_feature (B) LOCATION 1...1197
  hypothetical: NO
  anti-sense: NO
aagaaagaacaaaaaaacttgcaagggaggacacatgtgaagcagagtaagcaaaaacagtctcgtcgacttttgtttcgtttgtttttattaatatgtatcgtcgtagggttactgatcgctttatatccattttatgtggattctttaaatagttttattgatcaaaaacgtatcgaacaagtacaaaaacggaccgcagctgaaattgaagtgcagcgaaagaaaatggaggagaaaaaccaacgattaactgaccaaggattcaatcctggtactgatcctttcaatgaaaagaacagaaatgaaagtacaacatccagccaattagaggaatggctgatcggaagtatcaatatacctaagatccaattaaatatttcactttatgatcggctcaatggtaggatccttgaaaatggagcaggcgtcttgcaaggaacctctttcccgcttggtggaaattcgacgcattcagtgatctctgctcacagcggtttacctaatcgacggttatttaccgaattagatcgtttagaaaacggagacacgtttattttgactgttttgggggagaaattggcttatcaagttaaaaatatacaagtggtactgccagatgacacgtctgttctaacgatttcagaaggagaagacttagttaccttgcttacatgtacgccgtatatgatcaacacgcatcgtttgctagtgacaggacatcggattccttataacgaatcggtaaaaaaagaagaaggaaaaggaaatcaggaaagaaccatgcggcaatggtttattcttgcaggaacgataatagctgtagtcatactgttagtgtttatcggacgactaatctatcagtatagattaagtaaaaaagtgcttgatttttcatttattattagtgattcgtcagggaaaccggtaaatggtagttcattcattttgaaacataagaaaaaaacacttactagaaatggtgtgccgttttcagtacaaagcgaccatcatgggaaagtcaagctggatcaattgcctggtggaacttatcgaatcgtttcagctgatgatcctaaagttgctgtttcttttggtattagaaaagtaaaacaagagaagatatacttttttgaggggcgaaaacttgtaaaagagcttcaaaaaaatggtttttattttaaaatcaatgaataa

SEQ ID NO: 1035 - DNA (genomic), 189 bp, Enterococcus faecium; double-stranded, circular
  misc_feature (B) LOCATION 1...189
  hypothetical: NO
  anti-sense: NO
tttggagaacagcgaatgatgatgccaaaagaaatctattcagatgcattaagaggtgctagaaatcaattgaaaatggcgaaaagaacatacgaaattcggcccacaatcgaaaatgaacgcagagtaaaagcaattagacgcagatgttcaatttacggcgagttacagaaggaggacagcaaatga

SEQ ID NO: 1036 - DNA (genomic), 1359 bp, Enterococcus faecium; double-stranded, circular
  misc_feature (B) LOCATION 1...1359
  hypothetical: NO
  anti-sense: NO
ggaggagaacaaatggcacacattcattttgactattcaaaagtagcaccgtttgtcaatgaacatgagttagggtacatgcaaagccaagtaacagcagcccacaacgaattacgggaaggaactggcgcaggaagcgacttccgcggttggatcgatttaccaacgaactatgacaaagaagaatttgcacgtatcaaagaagcagctaaaaaaatccaatctgattctgaagtattagttgttatcggtatcggtggttcttatttaggcgctcgtgcagcaatcgacttcttgaatcacacattcttcaatctattagatagcgacacacgcaaagcaccacaaatcttctttgccggaaattcaatcagctcaacatatatcgctgatttgatcgaagtaatcggtgatcgcgacttttcagtaaacgttatttcaaaatctggaacaactactgaaccagcgattgctttccgtgtattcaaagagcttcttgttaagaaatacggacaagaagaagcaaacaaacgtatctacgctacaacagataaagcaaaaggtgcagttaaagtagaagcagatgcagaaggttgggaaactttcgtgattcctgatgatatcggcggacgtttctctgtattgactgctgttggtttgttaccaatcgctgttagtggagcagatatcgacgcattgatgcaaggagctgctgatgcaagcaaagcttattcaagcgacaaactagaagaaaacgaagcttaccaatacgcagcaatgcgcaacattctttaccgtaaaggcaaagtaactgagttattgatcaattatgaaccaggaatgcaatacttctcagaatggtggaagcaattgtatggcgaatctgaaggaaaagaccaaaaaggcatctatccttcaagcgcaaacttctcaactgatttgcactctttaggacaattcatccaagaaggacgccgcaacatttttgaaacagttgtgaaagttgaaaaacctcgtaaatcaatcacgattcctgaacaagcagaagacttagacggtctaggctacttgcaaggaaaagaagtggacttcgtaaatacaaaagcatttgaaggaacattgcttgctcatacagacggtgacgtacctaacttgctagtcaaaattccagaaatggatgcttacacattgggttacacaatgtacttctttgaaattgctgtaggtatttcaggttacttgaatggcatcaacccattcgaccaaccaggtgtagaagcttacaagaaaaacatgttcgcacttctaggcaaaccaggctttgaagaccttgctaaagaattgaacgaacgcctgtaa

SEQ ID NO: 1037 - DNA (genomic), 951 bp, Enterococcus faecium; double-stranded, circular
  misc_feature (B) LOCATION 1...951
  hypothetical: NO
  anti-sense: NO
aaaatggaacatcaagaaaaaattgctgttctgattccttgttacaatgaggaagcaacaatttcaacagtcattgcagactttaaacgagaattaccagaagcagatatttatgtctatgataataattcgaccgatcgaacatacgaattggccgttcaaggtggagcaatcgtaaaaaaagaacctcgtcaaggaaaaggaaatgtgatccgccaaatgttctttgatatcgatgccgactattatttaatggtagatggcgatgatacttatcctgcagaagctgtacatggtttgctcgagaaattacgttctggtgaagcagatatggtcattggtgatcgcctatcaaatggaacctactttgatgagaataagagacctttccacgattttggaaataaccttgttagaaatacaattactagaatgtataaaacaaaaattcttgatgtcatgaccggctatcgaggattcaatcgtatctttgtcaaaagttttcctattatgagttctggttttcaaatcgaaacggaattgacgatccatgctttagataaaaaattcaagttcgttgaaatcccaatcgattatcgtgatcgtcctgaaggcagcgaatcaaaattgaatacattctctgacggattcaaagtgatcatgatgattattaaaatgtttaaagattataagcctttgcttttctttgggatttggaccatcttcttctttttatttggattggtcacggggattcctgtgattcgcgaatatatgctgacaagctttattacacgcatcccttctgcgattttaagtactggattgatgactttagcacttctttcattagtaacagggttgattttggatacagtcgtcacgaacgctaagaaagaatatgaattgaatctatatcatgtgtatcatgaataccacagtagaaagtaa

SEQ ID NO: 1038 - DNA (genomic), 966 bp, Enterococcus faecium; double-stranded, circular
  misc_feature (B) LOCATION 1...966
  hypothetical: NO
  anti-sense: NO
atgatggaacatgaaatgacgattgacgaagctgctaaacgagcagaagaacttcgtacaagactgaaccaatggtctcgcgaatactacgtagaagataaaccaacagtggaagactatgtttatgataaagaatacgcagaattagtagcaatcgaggaacaatatcctgatttgatcacgtctgattctcccactcaacgagtaggcggaaaagtattagaaggttttgaaaaagtcactcatgatattccgctttacagtttgaacgacgttttcagcaaagaagagctgatagcttttgatcaacgtgtacaaaaagcagtgggacgtgtagttgactattgctgtgaactaaaaatagatggactttccgtttctttgcgttatgaagatggaaatttcgtgagaggtgcgactcgcggggatggaactgtaggagaaaacatcactgaaaacctaaaaactgtccggtcggtcccaatcaaattaaaagaaccaatgaacatcgaagtaagaggcgaatgtttcatgccaaaacggtcatttgtccaattgaaccaagacagagaagcagagggaaaagatatctttgcgaatcctcggaacgccgcagctggttctttgcgtcagttagattctaaaatcacagcgaaaagaaatctggacacttttttatacacagtagctgatttcggtcctatgcaagcaaaaacccagtatgatgcgctagaagagctagaaaaaattggattccacacgaatcgggaaaaacgtctatgtcattcgattgatgaagtgtggtcatacattgaagaatatcatgacaaacgtgtggatttgccctatgaaatcgatggaatcgtcatcaaagtgaatgaattctcgctacaagatcaacttggttttactatcaaagcaccgagatggggcagcagcttacaagtttccgccagaagaagttga

SEQ ID NO: 1039 - DNA (genomic), 1056 bp, Enterococcus faecium; double-stranded, circular
  misc_feature (B) LOCATION 1...1056
  hypothetical: NO
  anti-sense: NO
aagatggaacagttttcgaaggaaaggcttttggtgcagatgctagtgtctttcggagaaatcgtttttaccacaagtatgactggttatcaagaaactatcactgatcaaagttttaacggtcaaatcattacatttacctatcctatggtgggtaattatggggtaaatagagatgattatgaatcgatttctccaacatgcaaaggagtagtagtaaaagaacatgcacgtgtagcttcaaactggcgaaaccaaatgacgttagattcatttttgaaacaaaaaggaattcctggaatatcaggtatcgatacgcgcgcccttactcgcaaaatccgtgaagtcggaacgatgaaagctagtatagttgatgctggagattccttcgaacatgcatttgatcagctgaaagcaaccgttctagcaaccaatcaagtgcagcaagtctcaactaacaaaccttatccaagtccaggaacaggtcggaaagtcattgtcattgacttcggcttgaaacatagtattttacgagaattgagtaaaagaaactgtaacctcacagtacttccctataacacagatgccgagacgattttagcgctatcaccagacggagtcatgctgacgaatggacctggtgatccaaaagatgtgccagaagcaatcgaaatgatcaaaaaaatccaaggaaaagtaccgatttttggtatttgtctcggtcaccagttatttgctttagccaacggtgcagatacctataaaatgaaattcggacatcgaggattaaatcacccggtacgagaagtagcgaccggaagaattgattttacttctcaaaatcatggctatgcagtcgatgaagccacgattgatccagaaaaactcatcgtaactcatgtagaagtaaatgacggaacagtagaaggagtcaaacacagagattatcccgctttcagtgtgcagtttcatccagatgctgcccctggtccgcatgatgcactacatttatttgatgaatttatggaaatgatggacgcaggaaaggagcagtaa

SEQ ID NO: 1040 - DNA (genomic), 216 bp, Enterococcus faecium; double-stranded, circular
  misc_feature (B) LOCATION 1...216
  hypothetical: NO
  anti-sense: NO
aaacaggaacacacgcggttaaaaaacgtaccccgttccgcggcggcggaacttaaacaaggcgtcaaaaagaacagggtcgtgcacgtcaagaataaaccgccccccaaaagggctggaggtggcgttaccttggaacaacacacgttcttcaattacaaattccctaaaaaatcccctttaacaaggaaacctgtatggtccaaaaaatgctga

SEQ ID NO: 1041 - DNA (genomic), 354 bp, Enterococcus faecium; double-stranded, circular
  misc_feature (B) LOCATION 1...354
  hypothetical: NO
  anti-sense: NO
agggaggaacagctaatgcaatatctagaagcaaaaatcccaattccagaaggctatgtaattatctcccaagtggattatgaggagttaaaaaaagctgatgatactggtagatggatgacgttgccagaagtgctagaacggattaacagaaaatatgattggtttacttctagagttttaaagaacccaagatatagaaatattatcgatatcgagaaaaacaaaaatggatttgtctattatccagttgaaggaagagacacatatctatttttaagaagtaaaacacttgaatttttagaaacaaatttttcggaaatcttaaggaggcaagcggatgggaaaatttaa

SEQ ID NO: 1042 - DNA (genomic), 183 bp, Enterococcus faecium; double-stranded, circular
  misc_feature (B) LOCATION 1...183
  hypothetical: NO
  anti-sense: NO
attaatagacaacaacggatgatagataataagaacaatttagaaggagttgaaattcacatccttattcttaatatttccgctgctgtctatcgaagcttaattaaaacgatgagggagatttcctcccttgcgttttattttgtcgaagtcctgtttcctaatctttcgacactaccataa

SEQ ID NO: 1043 - DNA (genomic), 207 bp, Enterococcus faecium; double-stranded, circular
  misc_feature (B) LOCATION 1...207
  hypothetical: NO
  anti-sense: NO
gtaaaaagacaactgctatcattaatgttagcagttgtctttttatttacaataataattgcagaaaaagtaattcaatcatttaaggtcatttattctatatataaatccaaatctgtttcaggatattttaatttgacaagcgaaataatcattttcagttcttccatgttttctggatattctgggtcaaataccttgctatga

SEQ ID NO: 1044 - DNA (genomic), 1002 bp, Enterococcus faecium; double-stranded, circular
  misc_feature (B) LOCATION 1...1002
  hypothetical: NO
  anti-sense: NO
gcctttggacattggatggagcaaggatcgcttgtgaaatcagctcaagatgcttatttgcaatcgattgatttagcggtggaagcagaaaaaatcggagtggacggagcgtttttccgcgtacatcattttgcccctcagattgggtcgccgtttcctttgctagcggcaatcggcgcaaagacaagtaagattgaaatcggtacaggacttattgatatgcgatatgaaaacccttattatatggcagaaaatgccggattgacagatatcatcacgcaaggaagagtgcaactaggagtggggcgtggttcacctgaacaagttctagatggctggaaatactttggttatgattacagtgaagaagaaatcaaagaggtaacacgggaacgcacccttgaattcttggaattacttgaaggaaaaccatttgaagaaccaaatcctcaaccaatgttcccacaaggatcaggaaaattacggatagaaccttattcagaaggattacgacaaagaatctggtggggagctggttcgcagcaaacggcaatctgggcagcacaacatggaatgaatctgcaatcatctacattagtcaattacgaatcccacgagccattccatatccaacaagcaaaccaattacgtgcgtataaagaagcgtggaagcaagcaggtcatgattttgaaccaagaacattagttactcgctcgattcagccaatcaccactgatttggatcgacgcttatttggacaagacggtagtccgcaacaagatgctgtcggctatcttgcttatcaccgaaacccaacgatttttggaaaaacttttgctggtgaacctgatcaattaatcaaggagctagctgaagatgaagcaatcaaagaagcagacacagtacttgtcacgattcctaatactttgggggtagaatataacatgcacttgcttgaaacaatcgtaaaagatatcgctccagaattaggatggcggtaa

SEQ ID NO: 1045 - DNA (genomic), 420 bp, Enterococcus faecium; double-stranded, circular
  misc_feature (B) LOCATION 1...420
  hypothetical: NO
  anti-sense: NO
gtagagggacaagccctcaatataatttcggaggtattgaatatggaaaaattggtacaagtaatcaaactgcgccccggcgaagctgttctgattgtggtggaggacacccctgcaccctgtccctacggtatgtgcagcatgggcgctacccctgatcctgatgacgaacatttcccccatggcattcttctctgcctggatgacgctgcacaggagggagccatgtgttacgttacgatttttgatggtagcggtaagcccatcacggtcgaggtatccagagaaatctatcaggtctttgccgactatgagcgtgaaatggaacgccagcgcaaagaagaataccgccatcagggcttacttcctttgccatttgtgtctgtccgaagaaggcttttgaccacgcagttgcgaacc

SEQ ID NO: 1046 - DNA (genomic), 366 bp, Enterococcus faecium; double-stranded, circular
  misc_feature (B) LOCATION 1...366
  hypothetical: NO
  anti-sense: NO
aaagagggacatgaaatgagcgttcaaaagacaattcagcaaaaagttatcgtctccggtaaaggggaaacaaagcaacatgcttttgcatcagcgttagcagaaattcaaaacaaaataatggaacaatcaaacgtattattgcgaatcgaaccagtcaatgtggatattttaaaggcggtcgaaaacaaatacacagaacgctttctatttttcttcttcccacggcaacgtattagctatgaagtcgaactctctgttactgtggctgtaacagaaataaaattggcagacatatcgttcagccagcaaatgactgaagatccaaatgggattgccattccatttgtaactaaaaaaatctaa

SEQ ID NO: 1047 - DNA (genomic), 750 bp, Enterococcus faecium; double-stranded, circular
  misc_feature (B) LOCATION 1...750
  hypothetical: NO
  anti-sense: NO
gaaaggggacaatcattaaaatcgatcaagaggatcagaatgggggaaagctatatggaaatcatgcttgatacagcaaatacaaaaagtatttattcttgtcaacagtttttgaatttaacaggcgtaacaacaaatcctacaattctgaaaaaagaaggagcgtcaaacttcttctcgcatatgaaagaaatcaaaaaaataatcggacagattcctatccatattcagacaataggaagaacggaagaagaaatgatagaggatgctcgagttatcatagaagaactgggaaaagatacgtttatcaaggtgccggtgaatcaagcaggccttcaagcgatcaaaaagttgaaaaaagaaggttatttgattaccggtacagctatttacacagaattacaagggtatttagctattaataatggagcagattatattgcaccttattataacaggatgcaaaatcaaggcattgatgctatgaaagtgattgattcgttgcggactgagatcgaacgtacgcaaagaccaacaaaaatattagcagctagtttcaaaaattgtgaacaagtcactacagccattcgatctggagctcatgcgataacgttaggtaaagagctactagatcaagtattagagatgccctcgattgataaagcagtgaggggcttccaagaagattgggtgcaaactttccaagcagaaacgattggtgaactaaaaaaggtcgctgattacttctga

SEQ ID NO: 1048 - DNA (genomic), 1008 bp, Enterococcus faecium; double-stranded, circular
  misc_feature (B) LOCATION 1...1008
  hypothetical: NO
  anti-sense: NO
tcctttttgcagttgtggttcccgcacattccagcctgggtatttgtttttatgttggctgttttaactacgatcatcaatctttattcggtacggttattcgcagaaacagaatattggctggcttttgctaaaatcagtgtcattatcttactgatcatttttgctacttatcttgtcggtcagcaaatgttgggcacaggcgttttccctacccttcagcaattgactgaccatggtgggtttactcctcatggtatgaagggaatcatcagttctttgcttgtagttatctattcttacggcggttctgaactgattgctatcacggtaagcgaagcagatgatcctaaacgtgcgattcctaaagcaatcaaaggtgtcatgggaagaatcatttccttttacatcattcctttgtttttgcttttgattctttttccttggaatactttagcaggcacgaatgtcagtccttttgtgatggtatttgaaaaaatgaatatcccatttgcagcggatatcgtcaattttgtgattgtccttgctttgttctcatctatcaattcgggtgtgtatgcatcttcaagaattttgttcttccgtttgaaggatcgaaaaggttcctctagaaaactagctgttttaaacaagcatcaagtaccgcaacgtgctgttttattttgtaccagtgttctttatcttggtgtagctctttcttattttgtcggtgacaaattatttggctatctggcaggttccctttcgtatacagtattattgatctggatcattatcagtgcggcatcctttgtactggcactaagaaaaggaacattatgggataaaggaatcagcttttttgcattagctgtcttaggattgattttccttggtatcctgttcacgaactccattggggtaactgtattgactggcctgctttacctgttcatttatttcagttatcaaaaaaagaatgatgcgttcgtattgacgaatgaatga

SEQ ID NO: 1049 - DNA (genomic), 201 bp, Enterococcus faecium; double-stranded, circular
  misc_feature (B) LOCATION 1...201
  hypothetical: NO
  anti-sense: NO
atcaatttgcagaagcctggtgcatgtggtacagcggctgttatttctccaatcggtgggatttatcacaataacaatcttcatgtattttatagtgaaacggaagtaggaccagtaacaaaacggttgtatgatgaattgacaggtattcaatttggagacatagaagcaccagaaggctggattgaagtcgtggaataa

SEQ ID NO: 1050 - DNA (genomic), 213 bp, Enterococcus faecium; double-stranded, circular
  misc_feature (B) LOCATION 1...213
  hypothetical: NO
  anti-sense: NO
atatcattgcacggcaagaaatcccaagtgcgaggtatgtcctttgctatcaatatgtcaagatgggaaaaatcggatgcgtctaaaagaaaaggcgctaaaaaagaaaccacgcctgtagacgtggtttctttaattgcaaataaatgtatgaattatcttgttattatggagaaaagctgtttcgtttatcttttttgcatgaaaaagtaa

SEQ ID NO: 1051 - DNA (genomic), 825 bp, Enterococcus faecium; double-stranded, circular
  misc_feature (B) LOCATION 1...825
  hypothetical: NO
  anti-sense: NO
atgagcctgcagacagaaattatcaatgaattaggtgtcaaaccaacaattgatccaaaagaagaaatacgtaaaagtattgactttatgaaagcatatttgaaaaaatatccgtttcttaaaacttttgtactaggtatcagcggcggccaagattctactttagcaggccgtttggcgcaactaacgatggaagaaatgcgtgaagaaacaaaagatgaaaactatcaatttatcgctgttcgtcttccttatggtgaacaagcagatgaagaagatgcaaaagctgctcttgactttatccagcccgatgttagtctgcgagtaaatatcaaaccagctgttgatgcacaagtacaagtattaagcgaagcaggtgtgggaatcagcgattttaacaaaggaaatatcaaagcacgtcaacgtatgattacgcaatatgccgtagctggagaaagagcaggagccgtattagggacagatcatgctgcagaaaacattactggattcttcacgaaatttggtgatggtggagccgacattttgccattattccgtttggacaaacgacaagggaaacaattgcttcaagcattgaatgcaccggaaaaattatacacaaaaattccgactgcagatcttgaagatgggaaaccaatgattgcagatgaagtcgcactaggtgtcacatataatgaaattgatgattatctagaaggaaaagaagttcccgctcaagcacaagaaaaaatcgaagcatggtggaacaagacacaacataaacgacatttgccaatttccgttttggatgatttctggaaataa

SEQ ID NO: 1052 - DNA (genomic), 2859 bp, Enterococcus faecium; double-stranded, circular
  misc_feature (B) LOCATION 1...2859
  hypothetical: NO
  anti-sense: NO
cctttactgcaggagaaggaacaagtattgaaagtggaacaacagtgctttgcagtgaaagacggcgtaagcttaccagaagataaacttccagtgttgaaagcaaaagatggttatacagatgcgaaatggccagaagaagcaactcaaccaattacagcagatgatacagaatttgtatcaagtgcaacaaaactggatgataaatctgacgctgacaaatataatcctgaaggtcaaaaagtgactacagaattgaataaggaaccagacgcatttgagggaattaagaacaaagaagatttaccaaaagatactaagtatacttggaaagaaaaagtagatgttagcgcagctggaaataaaaaagggactgttgtagtgacatatccagatggatcatctgatgaagttgaagtagatgttatagtgacagacaatcgttctgacgccgataaatatgagccaacagtagaaggcgaaaaagtagaagttggaggcacagtagatctaacagataatgtaaccaacctaccaacattaccagaaggaacaacagtaacagatgtcactcctggtggtacgattgataccaacacaccaggtaattacgaaggggttatcgaagtaacgtatccagatggtacgaaagatacagtgaaagttccagtagaagtgacagacaatcgttccgatgccgataaatatgaaccaacagtagaaggcgaaaaagtagaagttgggggcacagtagatctaacagataatgtaaccaacctaccaacattaccagaaggaacaacagtaacagatgtcactcctggtggtacgattgataccaacacaccaggtaattacgaaggggttatcgaagtaacgtatccagatggtacgaaagatacagtgaaagttccagtagaagtgacagataatcgttccgatgccgataaatatacaccattggtagaaggtgaaaaagtagaagttggaggcacagtagatctaacagataatgtaaccaacctaccaacattaccagaaggaacaacagtaacagatgtcactcctggtggtacgattgataccaacacaccaggtaattacgaaggggttatcgaagtaacgtatccagatggtacgaaagatacagtgaaagttccagtagaagtgacagacaatcgttccgatgccgataaatatacaccaatggtagaaggtgaaaaagtagaagttggaggcacagtagatctaacagataatgtaaccaacctaccaacattaccagaaggaacaacagtaacagatgtcactcctggtggtacgattgataccaacacaccaggtaattacgaaggggttatcgaagtaacgtatccagatggtacgaaagatacagtgaaagttccagtagaagtgacagacaatcgttccgatgccgataaatatgaaccaacagtagaaggcgaaaaagtagaagttgggggcacagtagatctaacagataatgttactaacttgccagcgttaccagaaggaacaacagtaacagatgttactcccggcggtacaattgataccaacacaccaggtaattacgaaggtgtcattgaagtaacgtatccagacggtacgaaagatacggtgaaagttccagtagaagtgacagacaatcgttctgacgccgataaatatgaaccaacagtaggaggcgaaaaagtagaaattggaggcacagtacatttaacagataatgtaactaacttgccagcgttaccagaaggaacaacagtaacagatgttactcccggcggtacaattgataccaacacaccaggcaattatgaaggtgtcattgaagtaacgtatccagacggtacgaaagatacggtgaaagttccagtagaagtgacagacaatcgttctaatgcagataaatacaatcctgaaggacaaaaagtgactacagacttaaataaagagccagatgcatctgagggaattaagaacaaagaagatttaccaaaaggaactacttatgcttggaaagagaaagtagatgttagcacagctggaaataaaaaaggtactattgtagtgacatatccagatggatcatctgatgaagttgaagtagacgttacagtgacagatactcgttccgatgcagataaatataatcctgaaggacaaaaagtgactacagacttaaataaagagccagatgcatctgagggaattaagaacaaagaagatctaccaaaaggaactacttatacttggaaagaaaaagtagatgttagtacagctggaaacaaaaaaggtactgtagtagtaacatatccagatggatctaaagaagaagtagaagttactatttctgtagtagataaaaaagcaccgaataaacctcaagttgatcctattacagagggtgaccaaattgttactggtaaaactgaaccaaatgcagaggtgacagttacattaccagacggaagtcaacaccatgggacagctgataaaaatggtaattttacagttaaagttcctaaattagaggcagggacaaaagtgatagtaactgcaactgatgaatctggtaatactagtgaacctactaatgtagttgtttcttccaacaaaaaagacagtggaaaaaacggtagtaaaggtagtaagactgacaatcaaggtagcaacagcaatcaagacaaaaatagaggcaaaagccagtcctcaaaagtttttcctaagacgggagagagtgacagtaatatctttactattagcggtggtttaatactgttaggaacgttaggattattagggtataaaaatcgaaaaaaagagaatgaatag

SEQ ID NO: 1053 - DNA (genomic), 1050 bp, Enterococcus faecium; double-stranded, circular
  misc_feature (B) LOCATION 1...1050
  hypothetical: NO
  anti-sense: NO
aacttgctgcagttgacaaagtgtttaacatttaggaggaagaacatgatttttgtaccaaatgaaaaccacgacccaagaatcaatttagcaattgaacaatatttgctgcaagaaatgcctttagatgaacctattttgctcttttatatcaatgaaccttcaatcatcatcggcagaaaccaaaatacgcttgaagaaatcaatcgagattatgtggaagaaaatggcattcatgttgtccgtcgcttaagtggaggcggagctgtctaccatgattttggaaacctgaactttagttttatcatgcctgatgatggggattcattccgtgactttgcgaaagtaacacagccaatcatccaagcacttcatgaattgggtgttgctggggcggaattgaaaggccgaaatgatctagtcattgatggcatgaaattttctggcaacgcgatgtatgctaccaacggtcggatgtttgctcatggaacaattatgttcgactctgatatcaatgaagtagtcaatgcattaaaagtaaaaaaagacaaaatcgaatcaaaaggaatcaaatcgatccgttctcgtgtaacgaatatcaaaccatttcttccagaagaaaagcaaaaaatgacaacagaagaatttcgtcaagaaatcttgttgaaaattttcggcgtagagtcagtagaagaagtaaaaacgtacgaattgactgatgaagattggaaaaaaatcaatcgaatctctgaggaatattatcgaaattgggattggaattacgggaagtctccagatttcaatttctctcgccaaaaacgtttttctatcggttcgattgaagtccatttgaatgtctcagaaggaatgatcaaagaagcaaaaatctttggcgatttcttcggactaggagatatctctgacgtggaaaaaaaattggttggacagaaatatgataaagcatctctatcaaaaatagtcagccaaattgatgtgaagaaatattttggtgcgatagaaccagaagaattgcttaccttactttattga

SEQ ID NO: 1054 - DNA (genomic), 204 bp, Enterococcus faecium; double-stranded, circular
  misc_feature (B) LOCATION 1...204
  hypothetical: NO
  anti-sense: NO
aaccagctgcaaacaattgttcagggttggttgcattttcgacgcgtttaccaggagctgcaatattcaattggaatgtacgatcgggattatgaacttattccagagcgtccgcctgtgttgatcattttcgtagaatacatttttttcataaaattaccacctttaattatattttatacaattgaattttacacaatataa

SEQ ID NO: 1055 - DNA (genomic), 204 bp, Enterococcus faecium; double-stranded, circular; identical to SEQ ID NO: 1054
  misc_feature (B) LOCATION 1...204
  hypothetical: NO
  anti-sense: NO

SEQ ID NO: 1056 - DNA (genomic), 450 bp, Enterococcus faecium; double-stranded, circular
  misc_feature (B) LOCATION 1...450
  hypothetical: NO
  anti-sense: NO
ctaattatgcagattttagaagatattaaaatttattggaaaaggataataggctatacattagttcttcttgtagtaaatttattcctttcgatgatagcgttggtctttgttaatcaaagaaaagacaatgtaactgaattagtaacgtttatttcgtttttcataagtgggatttttgctcctttctttgaagaaaccttaatgagaggaattatccaaaaccaattggaattaaaaacaaatttgtctacaagaagcatatatataattgttgcaattttgtttagtctatcccacttaaatttatattttattccttattttatgacgagtttaattttgtcttttgtctatgataattcagataaaaggctgattgttccggttactattcattgtttttacaatttaattgtaatactgttaagtgtagttttttatacttga

SEQ ID NO: 1057 - DNA (genomic), 1470 bp, Enterococcus faecium; double-stranded, circular
  misc_feature (B) LOCATION 1...1470
  hypothetical: NO
  anti-sense: NO
aaacgaatgcaaggagtgatagctatgatgtctaaaaacaatacgaatggtagaaatcaatttgcgatgcttacgattgatgatctagttcctcaagatcatctcgttcgaaagattgatgccgcgcttgattttgaatttatttatccaatcgtcgaagccacttactccgatttaggtcgcccaagtatcgatccagtgattctgatcaaattggtgtttattcagtatttattcggtatccgttccatgcgacaaaccattaaggaagtcgataccaatgtcgcttaccgctggttcttaggctactccttcgaggagaaaatcccccatttctcaacttttggaaagaattatgttcgccgatttagagaaacgacggtgtttgaggatatttttgcctatattttagaacaagcagttaaagcaggttttgtaacagaggataatttgtatctggattctacccacatcaaagctaacgccaataaacataagtttacgaaagaaatgacccatgatgaagcgaaagcctatcaggatgaattagaagatgagatcaatcgtcaacgaatagaggctggaaaacgcccttttactttggacttagaaaaggaagtgaagctgaaagaaagaaaaataagtaaagctgatccggaaagcggctactacgtcaaaggcgaacgagaaaaacaatttgcttattctgtccatacttcatgcgacgacaatggatttattcttagcacaatcatcactcctggaaatatttatgacagtcaagtcgcctttcagctcgtcaaacaatcgaagagactttttcctgaaatcaattgtgttgtcgctgatgctgggtataagacacctaagtttgttcactttttgactcatttgaaccttcgaccttgtttgccttattcaaggcccaaagggaaaaaggggctattatcaaaaaatgagtttctctatgacgagtattttgattgttatatttgtccgcaagatcaaatgctcgctttttcaacggttactcgagaagggtaccgagaatacaaatccaatccaaaagaatgtgtgaactgtcctctgctaaaccaatgtaccataagtaaaaatcatcaacgagtcatcacgagacatgtttggggagatctgatggatgaagtggaacatcttcgcctaacagatctgaataaatcaatttacaaaaaacggaaacaaacgattgaacgaatatttgcggatgcaaaagaaaagcatgggatgcgttggaccaagtatcgaggcttggaaaaagtcgcgacgcatacgatgctagtgtttgctgcaatgaatttaaagaaattagccacctggctatggaaaggcaaggagcctttatttttttgttcaaaaattcgaaacgaagtagataaaaagctgttccaagctcgagttacgagtttggaacagcttttgtctacagtctga

SEQ ID NO: 1058 - DNA (genomic), 426 bp, Enterococcus faecium; double-stranded, circular
  misc_feature (B) LOCATION 1...426
  hypothetical: NO
  anti-sense: NO
aaacgaatgcaaggagtgatagctatgatgtctaaaaacaatacgaatggtagaaatcaatttgcgatgcttacgattgatgatctagttcctcaagatcatctcgttcgaaagattgatgccgcgcttgattttgaatttatttatccaatcgtcgaagccacttactccgatttaggtcgcccaagtatcgatccagtgattctgatcaaattggtgtctattcagtatttattcggtatccgttccatgcgacaaaccattaaggaagtcgataccaatgtcgcttaccgctggtttttaggctactccttcgaagagaaaatcccccatttctcaacttttggaaaaaatnatgttcgccaaattaaagaaacgacggtgtttgaagaaatntttgcctatattttagaaacaagcaattaa

SEQ ID NO: 1059 - DNA (genomic), 378 bp, Enterococcus faecium; double-stranded, circular
  misc_feature (B) LOCATION 1...378
  hypothetical: NO
  anti-sense: NO
tggtcgatgcagcacaaggtaatcgaagcacaaacattggccaatgtttatttagcgttagacaatgatttggagatcctgccagtcatcaataaaatcgacctacccgcagcagatcccgaacgtgtccgtcaagaaatcgaagacgtaatcggaatcgatgctagtgaagctgtattagccagtgccaaatcagggattgggattgaagatattctcgagcagatcgtggaatatgttcctgcaccaagtggagacttagatgcaccgctaaaagctttgatctttgactctatttatgatagttaccgcggtgttgtttctaaatgtccggatcacggacggtatggtcaaacccggagacaaaatcaaacttga

SEQ ID NO: 1060 - DNA (genomic), 1200 bp, Enterococcus faecium; double-stranded, circular
  misc_feature (B) LOCATION 1...1200
  hypothetical: NO
  anti-sense: NO
aaaggtgtgcagctgatggatgttcttacacataaatgtcctaattgcggcggtccgttgacttttgatcccaaagaccaaaaatttcattgcgaatactgcctgaatatctatacagaagaagaagtcagccaatatgagcaaaagcaaaaagaagcgcgtatggctggcgaagaaagcaaagaagaaccttcacctaccgaagattttacttttacagcccaagaacagcttgccgatatgaatgaagccgagcgcaaagcggttgacgaggcaggcggtttttcagatacagcggacgaatctgcagataataccgcagcgatggatctttttctttgtcccaactgtggtgcagagatcgtgactgatgcgacaactgctgcgacttattgttactactgccataatcccgtcgtactatcgggacgtttaagcggagaattcttgccaaataaagtacttccttttgctgtcgagaaagaagaagcaatcaacagatttctcgcttggaccaagaaaaaatggtttgttcccaaagcttttttcaataaggatcaaatcgataagttgacaggtgtgtatttcccttattgggctacagatgctgaagtagatggtgccatgcaggcgaatggtacagttatccgcatatggcggataggtgacatcgaatacacagaaacgaagcaatttgctgtttcaagagcaggcaagctttcttttaaagaactagtaaaaaatgccttatcaaaaaatacgcaacaaaagatggtcgaaggcgtgcaacctttcccgttagataaagcaattgattttaaaagccagtatttagccgggttccaagcagaaaaaagagatatcgaatatgaggcaatcaaatcacagattcaatctgaattaaaagactattcagagaagctgttaaaagataccgcaaatggatatacaacattgaccagtgtgcgaacttctgcttcaatcacaaacgaagtaaataattacgtattactgccggtatggcttgttacttatcgaagcaatgactcaagtaaaaaagtctactactatgcaatgaatggacaaacaggaaaggttagcggtgtcctgccgatcagccagaaaaaattgggactgaccgctcttgggattttcgctgggctagcgatcctctttctgatcggaggttacttgatatga

SEQ ID NO: 1061 - DNA (genomic), 525 bp, Enterococcus faecium; double-stranded, circular
  misc_feature (B) LOCATION 1...525
  hypothetical: NO
  anti-sense: NO
aaatcctcgcagattgaagatcattaccaatactttggttggagatgtcgaggtgatacgaatatgatgggaagaatatccaaagcaatgctagctgtttattcggggattgcggctttccttattattctattttcacttttcacttatttttatgccagtaaccaaagtcattggtggggagaattgctgcgtgcgcgtttattatacgttccgcttatcttccatttgatggcaatttcattaggtgtaggattgatcgtatttctattgttatcacttattcaaaaggcaaaatacgggaaaatcgaagaaaagcttcgtgcactttcttctggcaattatgaatccaaacttttgcatcagccgatcccaagcgcgtcggatgatctgtacatcaaagatattgatatggaaattactaaaataaaagaaaaaatgatcgaagtatccagtgaattacagattatgactagccgtcctcaatatgtagatggacaaaccaaagaagagattttaaaatga

SEQ ID NO: 1062 - DNA (genomic), 1020 bp, Enterococcus faecium; double-stranded, circular
  misc_feature (B) LOCATION 1...1020
  hypothetical: NO
  anti-sense: NO
aaactgtcgcacccattggacggctcaaagttattttgttccaacccagacattcaatccgcaaatcctgttagatataaaattgcttctttactgactgaaaaaatatctttatcttttattgcgaaaagctgtcaggtatctttgaccaccgttattcgaacattgaaagagtttaaaacctatttaccaaagctatctaagaagatcccccccagagtattgatggttgacgaatttcgttcgcatgcttccatagaagataagatgagctttatttgcgcggatggcgaaacaggaaaattaatagatgttttgcctacgcgtaaattacttcgattaacaagctatttgttaggttgtaccaatccagaagaagtagaattcttggtgacagacatgaacgccgcctatttccagctcaccaaacgtgttgtgccaaatgcgaaagtcgtgattgatcggtttcatattgtcaaacacatgaatcaagcgttcaatgagttgcgtatccgtgaaatgaatgaacttcgtaaagccggacagaaaagccaggcagaaaaactgaaaaagaactggcgctttttgctaaaaaatcgtgcaaacatcaaccattatgaatacaaaacatggaaaagtttccgagcaccaaaatacccatttcttactgaagcaatgatgattgatcgattgcttgagttttctccgcccctaaaggaggcgtatcccttttttcatgaattagttgaagcctttcgagacaaagaccctgacttatttttctccttattggcagaacttcccgaaacgttagatgacagctttcgggaaaagcttcaaaaccttctgacctatgaagaaggcatcaccaacgcaatgatctatccttattccaatggaaaaatagaagcgaagaatacccacataaagacaatgaaacgagtatcctacggatttaaatcatttgagaacatgagaattagaatctttttgatcaatcaattaatcaatgtaagataa

SEQ ID NO: 1063 - DNA (genomic), 693 bp, Enterococcus faecium; double-stranded, circular
  misc_feature (B) LOCATION 1...693
  hypothetical: NO
  anti-sense: NO
gctgcccagcaattcacgtccgttatacgaagtactgatgaccggcgttcccagcctatgaaaatggcatctatagtaattaccatgctcagcgatcccaaagagtggtcgctttttgaattagttaaggaagctggcggaaaaacaggagccgccgttacccactggtacagcgagttgtacaatcaagccccctataatcgtttggttgatcgcatccagcatcaggaggagcgactgattcagcatggcatcttttatagtgaggacacttaccctgattcgcatttatttgcggatgcccattatttagtgaatcagtatcagccagactttttggtcgtacattcgatgaatattgatgatgtcggtcacaaatttaccgccgattctcatgaatatgcagcagcggttaatcaggcggacagattattggctatttactatcctgaatggctgcaaaaaggttatcaagtcgtggtgactgcggatcacgggatggatgcgcacggactgcatggcggcagcttggctgcacatcgtgaagttcctttttatttgatttcaaataaacgccaaaagctgaaggaacaaactgtaccacagctgctggcggctccattgttttgctggttattaggaattgcaccgtcagagaaaatgcaggacattcaagaattgatgaggggatga

SEQ ID NO: 1064 - DNA (genomic), 231 bp, Enterococcus faecium; double-stranded, circular
  misc_feature (B) LOCATION 1...231
  hypothetical: NO
  anti-sense: NO
ggagaccagcaaaaggaggaaaaaatggtaacgaatatggttatttttttaacagtattggtttatggggtcaactttctggtatatatgtatcttaaaatcaatcatataaaagattatgtagaaaagattgctatttattttggaacaaatatgacgctgttgttcacgagtagtatttttttgttttttggaaaaatagtagaagacggcattctggtattcgaataa

SEQ ID NO: 1065 - DNA (genomic), 894 bp, Enterococcus faecium; double-stranded, circular
  misc_feature (B) LOCATION 1...894
  hypothetical: NO
  anti-sense: NO
gaggaacagcaagtgaaggtcaaaaaagcagtcattcctgccgctgggctaggaacacgttttttgccggcaacaaaagccatggcaaaagaaatgcttccaatcgtggataaaccaacgatccagtttattgtggaagaagcattggattcgggaatcgaagacatcttgatcgtaacgggaaaagaaaaaagacccattgaagatcactttgatgcaaatatcgaattggaaaacaatttgcgggaaaaggaaaaaacagaattactcgctttagttgaagaaacgactcaagtcaatcttcacttcatccgtcaatctcatccaagaggactgggggatgccgtgcttcaagcaaaagcatttataggaaatgaaccgtttgtcgtcatgctgggggatgatttgatgaaagatgatatcccattgactcaacaattgatgatggattatgaagaaacacaagcttccgctgttgccgtcatgcgtgtaccagaaaatgaaacatctaaatacggaattattgatcctaaaacagatagcgaaaagggtcgttgcagagtaaaagggtttgtagaaaaacctgaaatgggaaaagcaccaagtaatttagccattatcggacgttatctactgactcctaaaatatttgagatattagaaactcaagaaccaggagcaggaaacgagatacagctaacggatgcacttcagactcttaaccagacagaggcggtctatgcgagagagtttaaaggaaaaagatacgacgtaggcgataagttaggatatatgaagacaaatattgaatatggacttcaacattcggaaattgggacttcattaagtgcatatattatccagttgagtaaaaagctaagaacagaaagttaa

SEQ ID NO: 1066 - DNA (genomic), 258 bp, Enterococcus faecium; double-stranded, circular
  misc_feature (B) LOCATION 1...258
  hypothetical: NO
  anti-sense: NO
ggaggacagcaaatgataaaaaaactcgttcaattcagcatggatttatatgatatcgaatcaggagcaacactatctgtggaatcggaccatctaatcataaattttggtggaaagcgccagattattttgtgggtagttgatgatgtactgtttccagaaattgttcatgatttcgaagaatcaaaagcggttgagtttgaaatagtgaaaaaagtaatggaattgattgaaaaatacgaggaggacagcgaatga

SEQ ID NO: 1067 - DNA (genomic), 579 bp, Enterococcus faecium; double-stranded, circular
  misc_feature (B) LOCATION 1...579
  hypothetical: NO
  anti-sense: NO
cctatgcagcagttttttcatcagcacggttcagaaattctctcaaaaggttttgaacatctttatatttcaggacttgctttgatcattggtatcatcattgctgtaccgcttggtgtcttactgacacgttttccaaaagctgccacgattgtgattggcttaaccagtgccttgcagacaatcccttctcttgctttattggcattgatgatcccgctatttggcgtaggtaaattacctgcgattatcgcactctttatttattcattattgccgattttacgtaatacgtacattgggatgaaaaatgtcgattggaattatcgggatgtggcaaaaggcatggggatgactgagttccaatccattttttccgttgaattgcccattgctataccaacgatcatggctggtaatggtttaggtcccgtttacgtgattgcatgggctacacttgcttcttatatcggcgctggtggtttaggcgatttgatttttagtggactgaataattacccaaccagatctcattttggcaggtacgatccctgtaacaattttagcactattggctga

SEQ ID NO: 1068 - DNA (genomic), 1668 bp, Enterococcus faecium; double-stranded, circular
  misc_feature (B) LOCATION 1...1668
  hypothetical: NO
  anti-sense: NO
atgattaagcaaaaaatagaaacatccatttataggaggaaaatcatggaacaaaaatggtggcaccattcagttgtttatcaaatctatccaagaagttttcaagattcaaatcaagatggtattggagatttgcgggggattatttccaggttggattatctggcgtatttaggtattgatgcaatttggctttctccagtatacgagtctccgaatgatgacaatgggtatgatatcagtaattatcaagcaatcatggcagaattcggtacgatggaagaaatggaagaactgattgaagaagcaaagaaaagaaatatccgtatcatcatggatctggtggtgaatcatacttctgatgaacatccgtggttcattgaggcccgtaaaaataaagaaaatccttatcgggactattatatttggcgtgatccggtcaatggaaaagagcctaatagattgcgctcaatattcagtggttctgcttggcagttggatgaaaaaacggggcaatattttctgcacttgtatagcaagcgtcaacctgatttgaattggaaaaataaacaggttcgccaagagatttatcaaatgatgaatttctggatcgataaaggtattgggggctttcgtatggacgtgatcgatatgattggcaaagaaccggataaagaaatcacaagtaatggacctaaactgcatgagtatcttcaggaaatgaatcaagcaacttttggtgacaaaaatctgatgactgttggcgaaacatggggagcaactaccgaaatcgctaaactttattccaatcctaaaagaaatgaattatccatggtcttccaattcgaacacataggattagatcagcaagaaggcaaagacaaatgggatttgaaacccttgagtatctctgaactgaaaaaagtattatccaaatggcaaacatctttaggtgatgaaggatggaatagtttattttggaataatcacgatcttccgcgaattgtttctcgttggggaaatgacgatgtgtatcgaaaagaaagtgccaagatgtttgctatcttgctccatatgatgaaaggcaccccttatatctatcaaggagaagagttaggcatgacgaattgcccaatcgatgatatcgcggaagcaaaagatattgagacaatcaatatgtataacgaaaggatttcttctggatttacaaaagaggaaatcttggaatcaatcaaggcgaaaggaagagacaatgctaggacgcctatgcaatggaacgcccgtgaacatgctgggtttactactggaattccatggcttcgagtcaatccaaattataaagaaatcaatgcagaagaagcgttagcagatcaagattctgttttttatatgtacaagaaattgatcgatttgcgtagaaaacatgacatcatcgtctggggagactatgaattagtggaaaagacgcctgagcatgtctttgcctattctcgcatatatgaagaccagcaatggctcgttatttgtaatatgtccagtgaaaagcagacgttcactattccacgtgaagctttaagggttattgtgtcaaattatcctctgaaacagttaccagacggcaaagttgatttacgaccttatgaagcatttgtgttggaagtaaaataa

SEQ ID NO: 1069 - DNA (genomic), 960 bp, Enterococcus faecium; double-stranded, circular
  misc_feature (B) LOCATION 1...960
  hypothetical: NO
  anti-sense: NO
gaggataagcacatgttgaataaaacactgcagaaactacaagaaaaacttggaaaggcagcattgcctttcctgctgttcttgttttttatcattatctgcggcgttacatttagtagtgtcaaacaaaaggccaatgatttcagagaaggccaagtagcagaagaaagtatccgtgcgaacaaaacgatcgagaacacggaagaaaccgaacaaaaaagaaaactggcagcagaagcagtcactccagaatacacttaccaaaaagatcttgcagatgaccagaacaatcggatcaagcaactatttgaattgatcgataaaacgaatgatgccatcaacaaatcttatgacgaaaagattgataaggcaaaggaagatgaaaatatcccaaagcctactacagaagagcggatcgccgcgttgaagaaaaattttgaaaatgtgaatgcagaaaatgttgcgttttatcaaaaactaccgaacaatttttattcgacgatatttgaaatgactgaaactgagatccatactgtgagggatgagagtctgaagctcattgacgaacagatgagcaaacaagttcgtgaaagtgaattggaagcttttaaacaagaagcagaagagcaaatccaatatttgaatgtcacaccagcacaacaacaaatgattcgctacttagtggatcaaggtatcgtagtgaatgacgtattgaatgagaaaaagacagaagaattgaaacaatccgcacgagaagctgtacaaccagtgatgatcttccaaggagaaatcattgttcgtgaaagtaatcaaatcgatgcttcagctatgaaaaaattggaattactaggactgactaatcgaacaacttcgatttgtccgctaattgccatggttttagctgttttgcttcaaatcggcgtactgatttataattcacttcaattccaagatgcatga

SEQ ID NO: 1070 - DNA (genomic), 336 bp, Enterococcus faecium; double-stranded, circular
  misc_feature (B) LOCATION 1...336
  hypothetical: NO
  anti-sense: NO
aagaacaagcagctttatttgattttgaaaagaaaggtgagaaagaagatgaataaagaatattttgtccaacaagatgcatttttagaagattataaaagtgcttcgaagaaattaacgatcaatattgatgagttggcagatcaagtactctctcagttgaatgaaacgcaagaggaatattacacgatgccagcaaatgacgccaaagataatgtttctcatcgttttcctttcagtagacgcatctactcagatgaaaatgacggcacattgaatacagagtacacatatgaaggtcagccatatgtgctagaaactgatgatgatctttaa

SEQ ID NO: 1071 - DNA (genomic), 183 bp, Enterococcus faecium; double-stranded, circular
  misc_feature (B) LOCATION 1...183
  hypothetical: NO
  anti-sense: NO
aacgacaagcatgctaaagcgaaagaaacagcgaaaacaattgttggtggtggtagcggctatgatcattatttattttctaccagttattacacaagtatttcatcaatattttggttaagaatacgagagtttgtgacaaaagtcatgtcacaaacttttttctttgtcattttttcgtaa

SEQ ID NO: 1072 - DNA (genomic), 1872 bp, Enterococcus faecium; double-stranded, circular
  misc_feature (B) LOCATION 1...1872
  hypothetical: NO
  anti-sense: NO
aggagcaagcatttgaaaagatatataagcagactttcgaccaaacagaaaaagattttaaaaggaacagcagcaatcatcagtatcttttttcttgttgtttttagtaatttatttttgcagtggtgtcaaaatgatctatccgtagaccttgcgttgaaatttgctttttcttggcatacggaaaaattttttttagcctgtctcgtcttgctgattattcttatttttctgattgcactagcaggatctgtccctttaggttcccttacgtatgtcgtagccatcggtgtattaggttttgcaaattatatgaaaatgagttatcggcaagaaccgatttatccagacgatttgaagatgatcactgaaatcggattgctgaaagatatgaccggcactatgctgtttacagtgatcttagctgccgcaggaaccgtgataggattgttttgctggtacatgtttcgaagcctgaaaaaaggaaggcgattccaattgatccgattaacgacactgcttgtggcaattggactgctagggtatatcagtaatttcaacaatcccgataatttgttgcgaaaagcatataataaaacggcactatggataccttacagccagaaaatgaactactataacactggttttatcggtgggtttttgtacaatctgaaggtagaaccaatggatgaacctgaaggatattcgaaagaaaagatcaaagaaatcactgaaaaataccagaagctagccgatgaaaaaaataaaactgtagaggaagagtcgccgaacatcgtgttcgtgatgagtgaaagtttctcagatcctagtcgattaaacggcgtagaagtatctggtgagccattggcagattattatgaagtagctgatcaaacatatagtggcaatatgctttctcaaaactatggcggtggaacagcaaatatcgaatttgaagcattgactggtttttctatggcgttatttaatgcgcaactcaccaccccttacacgatgcttgtaccaaaaatggatcagcttccttctatcgtttcagcgttaaacgcacaatcataccagacgacagcgatccatccatacaatacttcgatgtataaaagagaggatgtttatcagacattaggatttgaccagttcatcagcgagcgtacgatgacctatacggatacgatagagaataatccatatatttctgatgagtcagcttacaaagaagtaatgacacttctcaaggaagaaaaaacacctcagttcattcatttagtcacgatgcagacacatatgccctacgatggaaagtatgataatctagactatcctgcaaaaacttcagatggaagtgggacacttgacttagagaattatctgcaagatatttcctatagcagcacggcactgaagcagttcacggaagaattgaagaatctttctagaaggactttagttgttttttggggggatcatcttccagggatctattcagatacgatccaagcaaaaaatgacaaacaaacattgcatgaaacacaatttcttatgttcgacagtaaaggagaattagaaaagcaaacgactcacgatgcaatcaccagtccgttttattttgcagcgaatctaatggaacagacgaatcagacaacaaatggcttttatcagctgcttttatcattagaacaggaacttccggcgtttgaacgagaactgtactatcaaaacggacagtggtataaagaagcgcaattcaatcgctcgcaacaagagatttacgacgaatatcaattgatccaatatgacattgtcgcagggaaacaatatagtttagcagatggtttctttgagcacgaataa

SEQ ID NO: 1073 - DNA (genomic), 300 bp, Enterococcus faecium; double-stranded, circular
  misc_feature (B) LOCATION 1...300
  hypothetical: NO
  anti-sense: NO
tcggcaaagcaaaagacccagatactacccaattttaagtcgaaaggtgattttatggatccaatcgaacgcttgaattctctctcggaagaagttacccagacttttcattccgattttgtctttttgatcgatgcagagaaaatccaacattttcctgcaagaaactggacacatgatcaaatcatcgaagaactgaaaaaacggttcgatcattcgctaatggtcaaaccctggcacgaacatgaagtcatttattcacctgaactacctgtttttgccttgataccgaaaaaatag

SEQ ID NO: 1074 - DNA (genomic), 240 bp, Enterococcus faecium; double-stranded, circular
  misc_feature (B) LOCATION 1...240
  hypothetical: NO
  anti-sense: NO
aagctgaagcagagtactttaataaagactaataagaagggaatgagagctatgacagaggctgtaaaagaattaaagaaaatgtatcctgatgttttgaatatgactgtagatgattttcatgaagccttaaaaaatgcagaaagtgaggaagaaaggactttctaccttacactttctagttttgtgacacgagtagatcaaaaaaaagtaattaatcagaaagactttaaaatatga

SEQ ID NO: 1075 - DNA (genomic), 972 bp, Enterococcus faecium; double-stranded, circular
  misc_feature (B) LOCATION 1...972
  hypothetical: NO
  anti-sense: NO
caaaagaagcaacggcggctcacctcggtaagtttttcatacaaaatacggaaggatacaaaaaattattggcatatttggaaacaacccttccaaaaaatgaccaaaaacaatttgcaacagtcccagattatcgaaggcggggttcctctaccaaatcgtacagggcttgctttagggactttttatcaaacagatacacatgcgtatatccctcttcccggtccgcctaatgagttgaaaccaatgtttgtggaacaagtacgtcctttactagaggaacgttttccttctgaagaaaaactaatttctaaagttttgcgcttttatgggattggtgaatcgcgactggtcactgagctaaaagatctgattgagacacagatcaatccaacgatcgcaccatatgccaaaccaaatgaagtgacattacgactgacagtgaaaacaaatgatgttcaggcagggaatcaagctcttttagcattagaagaaaaaatccaagaacgagtaggggaatatttttatggatacggcgatgataattcgctagcaaaagtcgtagtggaactactgaaagaaaacaagcagactgtaacagcagcggaaagtttgacagccggcgccttccaagccgcattaggcgacattgctggtgtatctgaagtatttccaggcggattcgttacctactcgctccaaacaaaagctggttttctggagattgatccggagctattagcagaatatggaacagtcagcaaagaatgtgtggagcagatggccattcaagcacgtgagatagcaagaacagattacagtgtagctttcaccggagtggctggaccggacacgttagaaggtcaatctgcaggaacagtatggatcgctatttcatctaaagacggcgtggtttcggaaaagtatcactttgccagagagctgaagagccgttcaccacggaatggtgga

SEQ ID NO: 1076 - DNA (genomic), 679 bp, Enterococcus faecium; double-stranded, circular
  misc_feature (B) LOCATION 1...679
  hypothetical: NO
  anti-sense: NO
tgtcgagcaaacattcagcagcaaggtaaaggacaaagaaacaaaagatcgtacgtccaaacaattgccagatgttaaaacagacgattggaagctagttttggttggtccagatcacaaattagaaaaagaaattgatgagtctactcaattggcatcattaagtaacggatacttgatcgacaaacgcattgctccagaatatgaagcatttgccaaggctgctgaagcagctggatttccattagtgatggtctcagcttaccggtctgtatcatcccaacaacaagttttcgaacaaaatgtccaagatgtgatgagtcgtcaaggtgtatcagaagaggaggcgacaaagattactaaagaaacgattacggagccaggatacagcgaacaccacacaggtctggcagtcgatgtcgtcgatcaaaactggtacaacagttatccttctactgtattggatgcaagttacggagatcagcctggagctaaatggatcgcagataatgctgcgcagtatggatttatcgttcgttatccaaaaggacacgaagatataactaagatcacatatgaaccttggcacttacgttatgtcggtaaagaaaacgctgagtatatcaccaaacaccaattgacgctagaagaatatctgaatgaattaaatgaaaagtag

SEQ ID NO: 1077 - DNA (genomic), 222 bp, Enterococcus faecium; double-stranded, circular
  misc_feature (B) LOCATION 1...222
  hypothetical: NO
  anti-sense: NO
aatttggagcatgatatggaaaaacaaacaagaagtgcacgacgaaaagaaaagccaaaagcgaatcaggcagattcgaatttggtgctcgacctgtttctaaaactccgctatcttattggcgttttagtcatcgtggtcatcgttacttttaatttaaacggaagttcacttggtgtttgggataaatatgtgtcgcaaagagaggaggggaaaaaatga

SEQ ID NO: 1078 - DNA (genomic), 246 bp, Enterococcus faecium; double-stranded, circular
  misc_feature (B) LOCATION 1...246
  hypothetical: NO
  anti-sense: NO
ctgttttggcagaaagaaggaggaaaaaatggaaattttatcagcaatggatttagaattagtagatctactaccaaagtgatcaagtcaaatatagatttgggagcttacaaccatatagtaggggctgcagtatggtgtatgaatggtaatatgtatgatgtgagtgtttattcaaatcatgaaacgtgtatagaaataattgtgctgggaatagcaatcagtcatggtgaacgtgacttttag

SEQ ID NO: 1079 - DNA (genomic), 291 bp, Enterococcus faecium; double-stranded, circular
  misc_feature (B) LOCATION 1...291
  hypothetical: NO
  anti-sense: NO
ggagtgcggcatatggaaatcaaagaagaaaaaaatcgtcttgctttattcaatgatgaacaacaagagatcggagaaatgacatggtcagatgcgggcccagacatcatgatcattgaccatacatttgtagatccagcatatcgtggtcaaaagttagctgaaaagctagtgtatactggagtagaattagcaagacgagacgggaaaaagatcattcctttatgcccttatgcaaaaaaagagtttgaaaagaaaccagaatatcaagacgtcttacgtcagtcataa

SEQ ID NO: 1080 - DNA (genomic), 615 bp, Enterococcus faecium; double-stranded, circular
  misc_feature (B) LOCATION 1...615
  hypothetical: NO
  anti-sense: NO
ggagacaggcatttggcagataacgagtttgaatacaaagcagtaggtgtcagatatactagatctgagagtatcacatttcaggggaagcagaattggattgcctacaagaaaaaaggctatcaaattaaagattggggtggaggcagtgggaactggattgcctacaaaaaaaccaagattgaattagaagttgatgatggtaattgggttgatgttacaagtctggtaagggactattatcaaaggcagaagataacaaaatcactcatagataaatttgtacaggatttggcttccaataatgtgaactatgaaatactactgaaggctcagggaaatcttgaaaagaaaaaacaagatgatgagagaaataaaattgcggctgaaaaagctaaaaaggatgctctgaattacgagtccactaagaaagctttggaaaagttagtgctgaacattgaaaatgttctttcgcaagttagtgccggtacgaaggaggagctgggtcagcttattgttgaaatcaaaggtagtgaggttacagcagacaattattcgaactatcatcgactagccgtatcgcttatcgtgaaggaaagagagtcacgaagatag

SEQ ID NO: 1081 - DNA (genomic), 1077 bp, Enterococcus faecium; double-stranded, circular
  misc_feature (B) LOCATION 1...1077
  hypothetical: NO
  anti-sense: NO
ggattttttaaaaaaggagcagagaaaatgtttacgatgcaagattatatctatgaagaaaaggaagtactaagtacgatcttgaaaaagaatgatttttcgacaagagaacatatgaaaaaaacagtgaatttactgatcttagcaacgggttcatcttataacgcttgtttagcagcgaagccagcattggaatcttatggtgatcttactgtcgatattcaagaacctttttattttttcaattatggaaaactttctccttcaatcgatactgtgattgctgtgtcacaaagcgggaaaagtgcttctactgttgaagcagtaaaaatgatacaaaaacaagggttacctgttgttgctatcacaaatgacgtgcaaagtccacttgctttagaagctgcacaaattattgatttaggtgccggggtagaatcagtaggcttcgttacaaaaggctattctgcgactgttttacagttactactcttagggataggaattggaataagtaaaaataaaatcagcaaaaaaatagaacaagactacatgcaacagttgcgcaaaataatcaaccatttaccagcgattattcaaaaaacggaagaattttttgatggatatcaaagtttatttcgtttagcacagcgtttcgtcaccattggatatggtccaaactggggaacagctaaagaagcagagacgaaattgactgaaacaatccgcgttccgtcacaaggatttgagttagaagcttatatgcacggcccatacctggaggcagatgcttcgcatttgctattctttattgaaggggaaagtgtaaataaggaacgttcgcaaaagttgcaaagatatatgagtcggtacgttggagagactctcaccattaccacaaaaaaagcaagaaacgagaaaacacttggattagcaatagaatgtgatgaatatctgtctgtattagcgcttgtcgttccgtttcaactattcgcttataaaaccgcagtagctaaaggtattgacttgaacaaaaagatttttgaagactttgatacagtcttgaaaagtaaattataa

SEQ ID NO: 1082 - DNA (genomic), 909 bp, Enterococcus faecium; double-stranded, circular
  misc_feature (B) LOCATION 1...909
  hypothetical: NO
  anti-sense: NO
actgtttttaataaggaaaggatgggaaattttttgaaaaaacaactactaattatgtgcctttcagcatgtgcaattttactattctcaggttgtagcaagtccaatgaaacgattgcaacgtttaaaggtggaacacttacagttcaggatttttatgataacccaaaagttaaatcaaataatcaaacactattaaaaaaaatgattgtcttcaaagcatttgatgatgtatacggaaaagagatttcttcaaaggaagtaacaaaagaatataatgaacaaatcaaaaaactcggtccaaactacaaggaacaattaaaagcagttggccaaacagaagagacatataagaaactctttaaacagatgctggctttccaatacggtttgaaagccaatgtaaaattaacagataaagatctagacactgcttggaaagaattctatccagaagttagtacacagatcattctattttcgactaaagaagaagcagataaagcaaaaaaagaagcaaatgaaggagaaaatttctccaagcttgttcaagcttatggaaaaaataaaacattaaaggaaactgatggaaaaatgaattttgattcaaccaatccagagattcctactgaagtaaaaaaagcagcatttaaactaaaaaacggggaagtttctgatatcattcctgtaacagatccaacgacttatcagcaaagctattatctagtaaaaatggtaaaaaaacaggataaaggttctaataaagacaaatacaaatctgagctagaaaaaattgctaccgaagcaaaaactcttgatacggaattcatggataaaacaatccgtaaagtgatgaaaaaagacaatgtaactattaaagatccttatgtaaaaaatatattcaaataa

SEQ ID NO: 1083 - DNA (genomic), 753 bp, Enterococcus faecium; double-stranded, circular
  misc_feature (B) LOCATION 1...753
  hypothetical: NO
  anti-sense: NO
gaggcttttaaattgtcagttatcccaaattattataaaaatcgtgtatgtttaaatgtattagctcattcagttgaaaatgcaaaagcatgctatgaagcagcggaagggcatgtcgtactaggtgtgctatcgaaaaattatgctagcgatgaagcagcaatcgaagatatgaaaaggtaccaggacgcaaccaataatgcgttgtcagttggattaggcgctggagatccaaaccaaagtcagatggtttcgcgtttatctggggttttacaaccacaacatgtcaatcaagtatttactggcgtggggacttctcgtgctttattgggccaaaatgatacagtcatcaatggattggtttcaccaacaggtaagatcggctatgtcaatattgctacaggtccgttaagttcacaagcgccagcagctgaagtgcctattgaaactgccattcaaatgctgcaagacatgggaggtacttcaatcaagtatttcccgatgaaaggcttagcacatagggaagaatttaaagcagttgcggaagcttgcgcaaaatatgaattctatttagagccaacaggaggaattgatctttcaaactttgaagaaattctgaaaattgcaatcgatgcaggtgtaaaaaaagtgattcctcatgtttatagttcaattatagataaagaaacaggagatacgcgtataggagacgtaaagatactattaagcatggtaaaaaaaattattcactaa

SEQ ID NO: 1084 - DNA (genomic), 309 bp, Enterococcus faecium; double-stranded, circular
  misc_feature (B) LOCATION 1...309
  hypothetical: NO
  anti-sense: NO
aattattttaatataagtacttcagatttaataaaggagaaatatctaatgaaaaaaattgatttaataaatatgataggtatgttaatagggatattagtaaatatagtaattttcacagattggctcggggtgttattttctaatcttattcccatacttattataggcatttgtggaattatactttcaatattagaactttttgaaagcagaaatacaatgaatagaatatttgcttgtattatattaattgttaatctattgcctatggtctattttacttttttatattttgcactgggatga

SEQ ID NO: 1085 - DNA (genomic), 1191 bp, Enterococcus faecium; double-stranded, circular
  misc_feature (B) LOCATION 1...1191
  hypothetical: NO
  anti-sense: NO
gtatattttaaaaaaatagctttctataaaggagtgttttatttgaaaatagctatactatctccagctttctcaatgggaggagctagtatcgtggcctcaaaaattgcaaaaggattaatagatagtggccatgaagttttttttgtttcttacttagaaagtgaaaaaccacaagtagaatctaagtattatgatttatacgaaaaaaaaatttttttatttaaaaatttttctcgatttcataagatattagagtatagattgtttggaggctttgttcctagtagatatataaaaaaagaaaaagaacaactaaaaaaagttctaaagaaagaaaaacctgatgtcatcatattcaatacttttatacctagtgtactattctccgaattcctaaagtatgaatttccaacagtgaaattaattacttggatgcactctgatcctgattacagcttaaatcatattgctaaattttataaaaaagaatatagaaaaagttttgaacgcgtggattccattgtttgtctttcgcaagatacaaaagaaaaactttcattatacaataaccatattaaagttatttataacccattgacattaagcggctctagtttaataagtaaccttgataaaaaaattatttcatttactgccagatacgatataaatattaaagggtttgattatttatgtgaagtagctaaaaacttacctgttggatgggctataaggattgctggagatggtacagaagaagaacgtaaagagctgaaaagattaattgagaaaaatggtgtgttagataaaattatttgcgcaggtgcattatttggagatgaattaatcaatcattatatagaaagttctattttcatatctacttctagaagtgagggactaccattagtgttgatagaagcaatgacttatggattacctgtaataagttttgatcatggtggtgctaaggaaatattacaagatggaaattatggaattttaattaagaattttgacgtacaagatatgaataatgagatagaaaaattgtctaataatcgtttacttatggaaaaatatcaaaaattctctttagaaagagctaaggattttaatgaaaaaaaaataattggtgaatggcaaacattgttaaatgaattaggaaatgaggatgttagaaattga

SEQ ID NO: 1086 - DNA (genomic), 1416 bp, Enterococcus faecium; double-stranded, circular
  misc_feature (B) LOCATION 1...1416
  hypothetical: NO
  anti-sense: NO
aatgattttaaaagaatattcaaggaggtttcatcaatggaaaaaatcaaagttgtcattgtaggtgcatctcatggagggcatcaatcgatcttggaactattgacacgatacggtgaaaatgtagatatcacgctatttgaagcaggagactatatttccttcatgtcatgtggtatggagctgtatttagaagacaaggtaacagatgtaaatgatgtacgtaatttcagaccagaaaactttccgcaatccaatgttcatattttaaataatcacgaagtaaaaacgatcgatgccgataaaaaaacagtaacggttactagcgcatcagataacgaaacaaaagaatatccttatgacaaattgattttgagttctggtgtcaaaccaaacaatctgccagtaccaggagcagatctagaaaatgtctacttgatgcgtggatacaattgggcaaccaaaatcaaagaaaaattaaatgatccggctattaaaaaaatcgctgtcgtaggtgcgggttacattgggatcgaagcagcagaagcaagccgaaaagctgggaaagaagtcgtattgcttgatgtgatcgatagacctttaggcacttatttagatgctgagatgacagatattttagaacaacacctaaatgaaaacggtattgaagttttgacaaatgcaaaaatcgaagcttttactggtaacggaaaagttgaggcaatcaaaacaagtgaaaaagaaatcccagcagatctagtcattcaagctgccggtgtgaaggcaaatacagaatggttaaaagggatcgtcgacttagatgaacgtggctggatccaaacaaatgaatacttgcaaacgaatcttccagatgtgtatgcagtaggagatgctacacttgcttattctatcccagcacgcaaaaaaatgccgatcgctttagcgactgttgcacgtagagaagcacgttatgtagtaaaacatctttttgaagaagtaccaaacaaaccgttcggcggagtcgtaggttcctctgcattaagtgtctttgactatcattttgcagcaagcggattgaatagctttacagcagcaaaagcaggagtagatgtacgagtgtcttattatgaagatacgttacgaccaaaatatgtaccagaagaacaaggaaatccaaaagtgtccatccaattattctcggatccaatgacccatcaattgctaggaggagcagtattatctacctatgatgttacaggtcaaggaaatgtattggcactagcgatccaaaacaaactgactttagaagaactagcagaagctgacttcttcttccagccaggctttgaccgacaatggagcatgttgaatctagccgctcaacaagcgttaggagaagaaccatttgtagaataa

SEQ ID NO: 1087 - DNA (genomic), 1692 bp, Enterococcus faecium; double-stranded, circular
  misc_feature (B) LOCATION 1...1692
  hypothetical: NO
  anti-sense: NO
tggagttttaatatgaaactttccatcaaaaataacgagacaggcgtctttgctattggtggattaggtgaaatcgggaaaaatacgtatggggtacaattccaagatgaaatcattttgattgatgccgggatcaaattcccggaagacgatttacttggaattgactatgtcattcccgactacagctacatcatacaaaacttacacaaagtaaaagccttggtgattactcacgggcacgaagaccacatcggcggaataccctacttgctgaaacaagcaaatattcctatctatgctggtcctctcgcattagcgttgatcacaaacaaattagatgagcatggcttgcttcgagatgcagagctccatgagatcaatgaagatacgatcatccgttttagaaagacttctgtcagctttttcagaacgacccatagtatcccagatgcattagggatcgtggtgaaaacaccttctggaaatatcgtagcgactggagacttcaaattcgatttcactcctgttggcgaaccagcaaacttgcataaaatggctcgtatcggggaagaaggagtcttgtgccttttatctgatagtacaaatgctgagattccaacatttactaaatcagaaaaaacgattgggcattctattttgaagatcttttcaaaaatcgaaggacgtatcatttttgccagctttgcttctaacatcttccgtttgcagcaagcagcagatgccgctgtggcaactggtcgtaaaatcgctgttttcggacgaagcatggaaaatgccatcgtcaacggtcaacgtttaggatatatcaaagttccagacggcacatttgtagatgcacacgaaatcaatcgcttgcctgccaatgaaacgatgatcctatgtacaggttctcaaggagaagcgatggccgcgttgagccgcatcgcgaatggtactcaccgtcaaatccaaatccagccagacgatacagtgatcttttcaagttcacctattcctggtaatacaacaagtgtcaatcatttgatcaatttgctgtctgaagctggtgcagaagtgattcacggaaaaatcaataacatccatacttccggtcacggtggacaagaagaacaaaaattaatgcttcgtttgatgaagccaaaatattttattcctgtccacggagaattccgcatgttgaaagtacatgcttctctagcacaagatgtaggtgttcctgcagaaaactgcttcatcatggaaaatggcgatgttttagcgttaactagcgattctgcgcgtcctgctgggcattttgtggctggagatgtgtatatcgatggtagcgggatcggtgatattggtaatgtcgttttacgtgaccgtcacctgctttcagaagaaggtcttgtattagctgtcgcgacagtggatatcaagaaaaaagaaatcttggctggtccagatattctctctcgtggatttgtttacatgcgagaatcaggagaaatgatcaatgaagctcagcgaatcttattccacgctttaagagaatgtttgaatggacctgactgttcagaatataaattgaaagaagcgatgactggcgcgcttcagcctttcttattcgaacgtacagaaagacatccaatgattttgccaatggtaatgacaccagatgaagaataa

SEQ ID NO: 1088 - DNA (genomic), 1137 bp, Enterococcus faecium; double-stranded, circular
  misc_feature (B) LOCATION 1...1137
  hypothetical: NO
  anti-sense: NO
ggaggttttaaagccatgacaatcagcggacgcactttcatccaaaagtttgaaagctattgtcctcagtggctagctgaagaaggagacccagtcggactgcatatcggaacattggataagccaatccaacgagtaatgatgacattagacgttcgtccagaagtggtcgaagaagcaatcaagaaaaaaatcgatttgctgattgctaaacatcctccaatctttcgtcctgtaaaacggctggttactgatcagccacaagaaaaaatgtatgcagatttgttgaaacatgatattgccgtctatgcagcacacacgaacatggatattatttgggatggactgaatgactggttttgtgaacttctcggtattgaagtggagagttatttagtaaagactcatgagattcattataaaaaactggccgtttatgtacctgtggatcatgcacagaaaatgcgtgaagtattagctgcagctggtgctggtacacaaggtgattataccggtacaagttttacctcgattggacacggtcgatttactccggaagctggtgcacaaccagcgattgggaaagtagggaagacagaacaagttcaagaggcaaaagttgaggttattttgccggaaactatcgaaaaacaagtgattcaagccatgcggtcagctcatccttatgaggaacctgcttatgatcttttcgctatagatgaaccagtcgaaatgtttgggttaggacgagtaggtgaattgccgcaagaaatttttatagaggcatttgtagaacaagtaaaagaagcgttccaactagatggactgagaatagtccagccaaaaaatgcaaaatcctctgtgaagcgcattgcgatttgcggtggaagcggtgaaaaattttatccgcaagcaatcgcccaaagagcagatgtctatatcacgggagatatctattatcatacggctcatgatatgcaaagcgctgggttgattgcaattgatcccggtcattatattgaatcgttatgcaagcaacgatttatcgagaaatttgaatcttggaaacaagaagaaaattgggatattaactttttcgtttctgaaacaaatacaaacccatttcaatttaattaa

SEQ ID NO: 1089 - DNA (genomic), 465 bp, Enterococcus faecium; double-stranded, circular
  misc_feature (B) LOCATION 1...465
  hypothetical: NO
  anti-sense: NO
aaactctttaaattactgcttttcgttggtataatggaaagtgctgattatatgaaaagaggagacgctatggatataaagaaaatgaaagaacgccaagagcagattcgtaatttttcgatcatcgctcatatcgaccatgggaaatctacattggccgatcgtattttagaaatgacgcacactgtgacgtctcgcgaaatgcaagatcagctgttagactcgatggatttggaacgtgaacgtggaatcacgattaaattaaatgctgtagaactcaattacacagcgaaaaatggagaaacatatatctttcacttgattgacaccccagggcacgtcgacttcacctatgaagtctctcgaagccttgctgcctgtgagggtgccgttttagtggtcgatgcagcacaaggtaatcgaagcacaaacattggccaatgtttatttagcgttagacaatga

SEQ ID NO: 1090 - DNA (genomic), 870 bp, Enterococcus faecium; double-stranded, circular
  misc_feature (B) LOCATION 1...870
  hypothetical: NO
  anti-sense: NO
ggaatatttaaacacagaaaaatgagaaaaggatataatgctatgaacagaaaaagattgacacagcgcttcccgttcctgcttccaatgagacaagcgcagagaaaaatatgcttttatgcgggaatgagatttgacggctgttgctatgcacagacgataggagaaaaaacgcttccctatttgctctttgaaacggattgtgcgttatacaaccacaataccggatttgacatgatataccaagaaaacaaggtgttcaacttaaagctggcggcaaagaccttaaacggcctattgataaaaccgggggaaaccttttctttctggcggctggtacgccatgcggacaaagataccccctataaagacggccttacggtggccaatggtaagctcaccaccatgtcgggcggcggtatgtgccagatgagcaatttactattttgggtgttcctgcatacgccattgacaattatccagcgcagcggtcacgtagtaaaggagtttccagagccaaacagtgacgagatcaaaggggtggatgcaaccatctcagagggctggattgatttaaaagtgcgaaacgataccgactgcacctaccaaatatgggtgaccctagatgatgagaaaatcatcggtcaggtgttcgccgacaaacagcctcaagcattatacaaaattgcaaacggcagtattcagtatgtccgtgaaagtggcgggatttatgaatatgccaaggttgaacggatgcaagttgccttaggtaccggggaaataatagattgcaagctgctttatacaaacaaatgcaaaatctgctatcccctcccggaaagtgtggatattcaggaggcgaaccaatga

SEQ ID NO: 1091 - DNA (genomic), 204 bp, Enterococcus faecium; double-stranded, circular
  misc_feature (B) LOCATION 1...204
  hypothetical: NO
  anti-sense: NO
atggcatttaatggcgtttcacgaggaacaatgactaactttcgttgctccttcattgttacatcagcagcacgtgcaatcaggttgtcgcctaaaccaacagagatacctgcgactgttttcatacttgccggtacgatgatcattccatcggtcaaaaatgatccgctggcgacagcagcacctaaatctttgtttgaataa

SEQ ID NO: 1092 - DNA (genomic), 207 bp, Enterococcus faecium; double-stranded, circular
  misc_feature (B) LOCATION 1...207
  hypothetical: NO
  anti-sense: NO
tttgaatttaatttaagttctctgttggaattgttttttccaattacggataatagcatggggctaaaacctaatattcctagagaaatagaacccagtaccaacacagttttttttaacataggttatacctccactttttttaacgctaccacttgtatacacattttaaatactagccttcagtttatcaaatgtttaaattga

SEQ ID NO: 1093 - DNA (genomic), 1509 bp, Enterococcus faecium; double-stranded, circular
  misc_feature (B) LOCATION 1...1509
  hypothetical: NO
  anti-sense: NO
ccagaatttaatcaagaacaagcagtcaaagtgcgaagttcaccgtttattgtgcataaagggtggagtgggcactttttttgtgcgcaaaatgaaaaaggaagtgaaaaaatggctgaaattactttagaatttgatacgattgcggcaatttctaccccacctggagaaggtgcaatcagtatcgttcgtttaagtggcgatcaagctgtgcaactagcagataaagtttatcaatctggaaacaaacgattatcagaagtaccaagtcatacgatccattatggacatatcgttgatcccaagagcaatcagcttgtcgatgaagtcatggtctccgtgatgagagcaccaaagacatttacgcgggaagatgtagtagaaatcaattgtcacggtgggatcgttgtagtcaatcaaattttgcagctattgttaagagaaggtgcaagattagctgagccaggcgaattcacaaaacgagcattcttgaatggtcgtgttgacctttcacaggcagaatctgtgatggatttgattcgggcaaaaacagacaaagcaatgggactagctcttaatcagttagacggcaatctgtctgctttgatccgctcattgagacaagagattttagagacattagcacaagtagaagtaaatattgattatccagaatatgatgatgtcgaagaattgactacgaagttattgcttgaaaaagcgcagatgatccaacaaagaatccaagcgctacttgctacatccaagcaagggaaggttctgcgggaagggttaagtacggcaatcatcggccggccaaatgtcggcaaatcaagtttgttaaaccatttgttaagagaagaaaaagcaatcgttacggatattgcaggaacgactcgagatgtaatcgaagagtatgtcaatgttcggggggtaccgctcaagctaatcgatacagctggaattcgggaaacagaagatgtggtggaacggatcggggtcgaaagaagccgaaaagcattagcagaagcagacttgatcttacttgttctaaaccaaagcgaaccactgacagcagaagatgaacaattattggaagcgacaagtggattgaaacggatcattcttctaaataaaacagatttgccagcacagctggaacaagaaaaattgaagaaattgatcgaaaatgaaccagttttttcaatttccgtagctaaaaacgacggactagatcgtttggaatcagctatttctgatttattcttcagcggagaaacaggagaaagagacgctacttatgtttctaatacccgccatatcgcgttgttagaaaaagcttccctctcacttgaagaagtcattgcaggtattgattcaggaatgcctgtggatctcgttcaaatagatatgacgcgttgctgggactatctaggagaagttgtcggcgacagtgtacaagatgagctaatcactcaattattcagtcaattttgtttaggaaaataa

SEQ ID NO: 1094 - DNA (genomic), 249 bp, Enterococcus faecium; double-stranded, circular
  misc_feature (B) LOCATION 1...249
  hypothetical: NO
  anti-sense: NO
gaggaatttaaaatgggatttatttgggcattaatcgtcggcggtatcattggagcaattgcaggagcaatcacgaataaaggatcatcaatggggatcatcgcaaacatcattgctggtttagtaggttcagcaattgaccaagctttactaggaacttgggggaccaacaattgcaggaatggctatcattccatcattgatcggtgcaatcattttagtattagtcgtttcattctttgcacgtaa

SEQ ID NO: 1095 - DNA (genomic), 1173 bp, Enterococcus faecium; double-stranded, circular
  misc_feature (B) LOCATION 1...1173
  hypothetical: NO
  anti-sense: NO
gaaggatttaatatggcaaaaggaaaacatcaaaaaaaacagcagatctctctttcttttctcgcagttttgttgctggctgtcagcttcttttcaacaggcatcattacaggatggcaattaacaaaacaacctcaaccacaaatttataaaacggaacccgcacaacttgcttccaatttaacatctaatgagcagatgcttgccagcaaaattgatcaattactgcaaaaatcagattatatcggttcgatttatgtacgcaaaaataatcgagtgatattagaaaaaggatatgggtacgcaaatctacgcataaaagaatcgaattctccttctctttactatcaaatcggttcgatccaaaaagcgatgactgctttacttatcctaaaacaaattcaatctggcaagataacttttgacacaaagctatctgaattttatcctcagattcctggaagtcagcaaatctcaatcaaaaatatgctttacatgcgctctggtcttcatcgaaccgcttctccaaaaaaacctatgtcagatagtgagatcattcagtttgcccttcatcatttgaaatttactggttatgatacgtatcattatgaaccattaaattatacattgcttacaggggtattgatcaaactaatgaatcagccttatgaaactcttttaaaaaaagaaatcattcggccactccatctagaacatacagatttttatgaaaatgtaaaaaattcccctcagcatgctgtatcttaccaaatgtctgcaactgacgattattcaaaagcattggtcgagcctgaaacagacatccgaaatgaattaggcacaggaaatataagtatgtctgtttatgacttgaacaaattctttaccagtgttctgtctggcgatattataccaaaagaactacttttctcattgtggcaaaataatggtgataaacatccttacagcggcggtgtttacagtggaaatgattatatccttgctcagggaaatatcaatcgattccatgcagtagcggcgatgaaaaaagacacaaaagatgcaatcgtcatggaaagtaatatccaatctgataaaaacatcaaattgccggccactgatttaagaaatcagatttacgaactgatggaaggtgttaatttaaaaagctaa

SEQ ID NO: 1096 - DNA (genomic), 213 bp, Enterococcus faecium; double-stranded, circular
  misc_feature (B) LOCATION 1...213
  hypothetical: NO
  anti-sense: NO
acaccgtttaaggaagaggttgtgagcctgccgtttaactctgagtcacaaggagcaatttcaaaaaacagcttctcatgtttgttgactattgtgacttgtgaccgaggagttggcaggagaacaccgtttattcgaaaaaaggaactgcgacaagacttttgtcacagttccttcttttttttgctatgctatactagatgtaaaaaatag

SEQ ID NO: 1097 - DNA (genomic), 189 bp, Enterococcus faecium; double-stranded, circular
  misc_feature (B) LOCATION 1...189
  hypothetical: NO
  anti-sense: NO
acaccgtttaagaaagaggtcgtgagcctgccgtttcactctgagtcacaaagagcaatttcaaaaaatagcttctcatgtttgttgaatattgtgtcttgtgaccgaggagttgtcaggagaacaccgtttaccagaggttgtgacttgtttttagtcacgacctctttttttatttattccatataa

SEQ ID NO: 1098 - DNA (genomic), 2193 bp, Enterococcus faecium; double-stranded, circular
  misc_feature (B) LOCATION 1...2193
  hypothetical: NO
  anti-sense: NO
atgagtcttaaaaataaaattcggcggtttatggaaaagaaaaatctaaatccgatgaacaatcgcaaaaaagtaggtatcattttatttgctacgagtattggattattctttttatttgccgtccgtttctcgtatatcgttattggaggtcatgttgctggtacctcattagctgaaaaaacaaaacagttgtaccaaggaagtgaagtagtaaaagcaaaaagaggaacgatttatgatcgtaacggtgtggcgctcgcagaagatgcctcctcttattcaattaaagcgatactctcaaaaacatatacctctggggataaaaaactgtatgttgaagaaaagaattttgataaaatagcagaaatcctgcataagaatctttctatagacaaaaaagatgcactgaatattttagaggacggcgcaaaaaaagagctgtatcaagttgaatttggtagctatgggaaaaatatctcccaagaaaccaagcaaaacatcgaagcggacatgaaaaaagaaggtgtcgctggtctttattttgtcgaccatcaggctcggatgtatccaaatggcgtcttttcttctcattttattggatacgcagttccagacaaagatgagaatggcttagttggtaaactaggtttggagtctgcttacaatgatatcttgagcggtaaagatggtaagattatttatcaaaaagataattttcaaaatcctctgccaggtacagtggcagaagaagaaaaagctgtcgacggacaagatatctacacgactttagacagcagactacaaagttatttagaaacactgatggatcaagtaaatgaagaatatcagccagaagaattgacagcagtcctgatgaaagcaaaaaccggagaaatcttggcaatgggacaacgacctactttcaatcctgaaacaatggaaggattgactggaaaagatgctatctggcgtaatttcttggtacaagatagttatgaaccaggatcaaccatgaaagttttcactactgcagctgctatcgaagaaggagaattcaacgagaatgaaaccttccaatctggaaaaatccaagtagaagatgctacgatcaatgaccatgactttggtgaaaaaggtgtgctgaccatgcgtcaagctctttcatggtcaagtaacgtcgggatggtcatactggaacagcgattaggcggacgatggtataactatttacaaaaactgggatttggacaaagtactcattctggattagatgatgaagtaaacggtgctttacctacattaaatattgtcgaccgagcaatgagtgcttatggacaagcggtaggtgtgacgaatttccaaatgatgaaagctttcacttctattgcgaataacggtacaatgattcaacctcgatatatcagcaaagtggtggatccccaaactggagaagagcgaacaactcaaacagaagttctagggcaacctttttcaaaagaaacaacagaaaaagtccgtgaatatatgagagatgttgtcgaaagcgaaaactacggtagtgcttatggtgtatatagtgtacctggatacaatgtatcggcaaaaaccggaacagcccaaatcgcttctgatacagggggatatcaaacaggagatacagcctacctgtattcgattgtggagatggttccttctgaagatccagactatgtcttgtatctaacaatgaaacaccctaagacatatgatcgaatggcattggctaaaatcgcaaatccattgatgaaacgggcaatggattttaaagaaactgaagaagattcagatacagaaacaaaaacagaaaaagtatccgtagccgattatcgtaatcttgaagcggacgttgcagcagctgatgctcaaaaaagtggactgcaacctgtagtgatcggtaatggtaaaaaagtacaaaaacaatctactgccaacggtgatcagttgatctctggagaaaaactgatcctatatactggtggtgataagctgatgcctgacgtaacaggatggtcaaaagcagatatcatgaagctggggaaaatcctcggtattgaagttagttttgatggagatggttattgtgtcaaacaagaacttgctccatatgaaaaaatcactgaagacaaacttagttttactttagaagaataa

SEQ ID NO: 1099 - DNA (genomic), 813 bp, Enterococcus faecium; double-stranded, circular
  misc_feature (B) LOCATION 1...813
  hypothetical: NO
  anti-sense: NO
attatccttaaattagaggtgaagacaatgttgaaaaaagaaagattgcttactatcgtagaaatggtcaataaaaaaggaatccttaccgttaatgaaatcatcaatcaattagatgtttctgatatgaccgttcgcagagatttagatgaattagaaaaatcgggcaagctgctgcgtgtccatggaggggctcaaagtctttcctacactttagatcaagaactttctcacactgaaaaagccactctgcagattcaagaaaaaaaagaaattgctgccacagcagcctccttgattcacgagggagaaacgattttcttaggaccaggtacaacaatcgaactattggcgacgcatttactgaacaagaaaattcggatcattacaaataattatccagtttttgatattcttgctcaagcagatggaccagaaattctactgattggcggtgatttccggaaaaataccggcgcatttgtcggaccgatcaccaacgacaatttaagaagactaaagtttacaaaagcatttatcagttcaaatggcgttcacaacgaagcgatctctacttacagtaccgaagaaggagaagcacagcagatcgctctaaataattcccgtaagaaatatctactcgttgataataaaaaattcaatcgagatgatttttatgtgttttataatttgcatgatttcgatctgctcattacggatcgccagatctcgcgggaggttcaagagcactatgcacaatatgtcgatctgcaaattgctgattcaaccgaaaataccactataggagcgtaa

SEQ ID NO: 1100 - DNA (genomic), 531 bp, Enterococcus faecium; double-stranded, circular
  misc_feature (B) LOCATION 1...531
  hypothetical: NO
  anti-sense: NO
agactttgtttcaatttggcagctaattttgctgggattccgctggcattctcttttattattttgttggggaatgtangtgtgctgaaaatgattttgccatttctagcggacttcaatttgtattcttggtggggattgaccatcacgtatacctatttccaaattccgttaggggtcttgtttttgtatcccagcatgaaggaagtgaaaaaggaatggctggagtccgcacaattgctgggcgcttcatcagcgtatgcttggttcaaggtggctttgccttttttgcgaccatcgattgccagcacctttgtcatcttatttgctaatggcatggggacctatgaaacagcgtatgccctgaccagcagtaatgtaaatcttttaacgattcgaattgcggctttagtgtcgggagatgtgttcgccaagcctaatttaggcagtgcgttggcagtcgctttaagtgtcctgctggtaacggcaatgttgattattcaaaagaaaggcaaggtggtgcagacgtga

SEQ ID NO: 1101 - DNA (genomic), 417 bp, Enterococcus faecium; double-stranded, circular
  misc_feature (B) LOCATION 1...417
  hypothetical: NO
  anti-sense: NO
cccccccttaaaataaatcgcaaattttttgggggtgatgaaacggagggggctgtcaggaaaagagattttttcgaactttatcatgaaaggagggctaaaatgtttaaaaacgaattgtctcaaaatcgctacagagaaaaattacgccgctctttaataagccaattggaaagtcagaaaacaaatattgagccattcttagataatgttgatcgttatatcagtttatgggaaacggcgatatcactggaagaagatatatccgagaacggcattagactggagaatggtaaaaagaatgaatcagtagcgttgcttgtttctgtcaacaaacaaatgggattgatgttggataaacttgccattactcctgaattggtaggtgaagcaaatgaatcaattcctgagttataa

SEQ ID NO: 1102 - DNA (genomic), 480 bp, Enterococcus faecium; double-stranded, circular
  misc_feature (B) LOCATION 1...480
  hypothetical: NO
  anti-sense: NO
aacttacttaaatcctattataatatttttgttaatgattttaataaaatgattggagagaaaatgatggatcaaaaagcgtttatcgaatctattgattctacaatcgatagattaaaaaaagaaattcgattttataatagagtaattggtatcggaaatattataaaaatagtcttatcagctagtatcccaatattaattgatcaggcttccgaacacaggtctttactattgattgtttcaattgcttcagcaataattacaattatacaaagtgggatgtctgcatttaattatcaagataaagtacagacttcgacagagttattaatgaaaattgaaaaagaaaagttgttatatataacgaaaacatccccatataataaaacagatgaagaaaatttccatttaatcgttacaacccttcaaactgaattaattgatattatctctgattttaatcaagttaataactaa

SEQ ID NO: 1103 - DNA (genomic), 234 bp, Enterococcus faecium; double-stranded, circular
  misc_feature (B) LOCATION 1...234
  hypothetical: NO
  anti-sense: NO
aggcaacttaattgggataaaacccgatattctttgttccgattataccatattaaaaaatcggagggaaccattatgaaacgaaacttaattataggaagcattttaatcggcggaattttcggcttattaccattaattgcaaaaatagctatctttgcaggattagcgttatatctcttcactgcttatgacgagtacgactatcaattaagaactggagggcataagtag

SEQ ID NO: 1104 - DNA (genomic), 516 bp, Enterococcus faecium; double-stranded, circular
  misc_feature (B) LOCATION 1...516
  hypothetical: NO
  anti-sense: NO
gatgaacttaatataatagaaagggtgggagaaatggcaaagtataggatcgaagaaaaaccagattttacggtgacgggtattggtgtggaattgaagagtagcaatacggattttgtcggtttggctgcagagaaacaagcatttgagcaaaaagttatcggtaatggaacaatagatgcattgaaacaagctgctgaaaatcattatttctttacagtcaacgaaccctataacgggaaaatgatgtactatgtcggtgttcaaacgagtcaggatgttccaaacactacgcgaatcatcccattcccaaaaggaacgtatcttgttgtaagcgctttagcagaatcgcctgaagaattaagaaatgatttgacgaatacggcctttgggcatgttttaagagaagtagaagattacgcctatgttgggggtccaaatgctgtagtcgaaatgggagttaccaacgggaaatatatgggagaaatctggataccggtagtcaataaaccatga

SEQ ID NO: 1105 - DNA (genomic), 1641 bp, Enterococcus faecium; double-stranded, circular
  misc_feature (B) LOCATION 1...1641
  hypothetical: NO
  anti-sense: NO
aagaagcttaaaaatacattaactaaaaaattgtattttctaagcttctttctgtataaaaaacaaagcaaatttttatctagaacttatagaaaaccaattaaatctttacttcaggtgtcctataatcattttgaaagcgtttttacaaaagcgggagggatgcttcaaatgaaaaatagaagattgcttcaatttagtttatttttaggtgtactgtatgggattttcttatcagtttctattgatgcttgtacgacggttttagtaggaaaaaatgcttcagtagatggatcaacgatgattgctagaaatgaagatctgaacacggcttggtcaaaatactttgttgtcagaaaagaaaatacgaatccttcacattttgtatcaaaagggaatggatttacccttgatcttccgaaagaacagctgaagtacacagcgaccccagaatgggatacgtcagaaggattatttgaagaagatggtatcaatagcaagaacgttgcaatgagcgctactgaatcagctacgacaaaggaagagatattgaaaaaagatccatataccgcgcatggtatcgcagaagaatctatgttgaccgtgacccttccttatattgattcagcaagagcaggggtagaacgattaggaaaaatcgttgctaagcaaggagctgcggagacaaatggtgtgattttctctgataaaaatgaaatctggtatatggagatacttagtggtcatcagtgggcagctgtcaaagttccagatgactgttatgcagttattcctaatatgttgtcaattgattcatttgatttgaaggacaaagattcttatctttgttcagcagatttagaatcttttttagaaaagaatcaactgataaatacgaaacgggatatttctttaagagacatatttgcagataagtcaaaggatgaagaatacaatcttcctaggatatgggatgcacagagaaaactgacaccttcaaagaaacaaaaaataacagatcgttcatttgagatgtttgtcaaaccagataaacctatttcaattgcagaaacagcttatatcatgacattacactttaatggtactgaatatgataccatcgaagggacaaagccagataagtatcgtccaatctctgtgccgaatacgatggaatctcatattctacagataagaaacaatgtaccagaagaaatcagtggtatccattggttagcgttggggattcctgatacaagcaattatataccattttatagcaatataagcgagacacccgaagcttatcaaaaaggaacagatatgccagatgatatttccgcttactggacatatcggttgacgaacatcttgacgaagccatactatagtgattttaagaaaaatattactttaccaactcgccaaaaagttcgagaccatctatcgaaagagttagcaagtacagaccaacaagcaagagaattaatagtaaatcatcccgaaaaattaacggattatttgaatcaaaaaacacaaagttttgctgattatgctatagatgcttatcagaaaatgaaccaggagctgattgtaaagatgtcagaaaagacagctacacatcatgacaaagatctataa

SEQ ID NO: 1106 - DNA (genomic), 402 bp, Enterococcus faecium; double-stranded, circular
  misc_feature (B) LOCATION 1...402
  hypothetical: NO
  anti-sense: NO
gatgttattaatgggcaacttatcaggaaacgttttcttatgtttttgtccaatttttttgtgaggtgtttattcttgaaaaaaataaagaaggagagttatggcttcctgacaatctttgtcgcttgtataatgatggttttacagcgtatattgatttcagcagtcactattcctacatatgcaacaaaccctggtcgattctacatctatacatttttacaaacttccgttgttattggtgcaaatttgatcccactttacatgggttaccaatatcaaaaaatcgcccgtttaaaagttttacattatttaagtcgttttgcctttatattcctaatagccacactagtttgcaatatcttttttttacgtacaagctggcagcttgaatattcgtga

SEQ ID NO: 1107 - DNA (genomic), 864 bp, Enterococcus faecium; double-stranded, circular
  misc_feature (B) LOCATION 1...864
  hypothetical: NO
  anti-sense: NO
gaatgtattaaaaatagattaggaggaattttgatgtttagacaccagaaagaattgcagtttgaagcaaaaccagatcgtccgaatccattaatcgcgaaatatctgcaggagctgatcggcggccaatatggcgagatgagtgtagctatgcagtacctgttccaaggctggagctgccgaggagaagaaaaatataaagatatgctgatggacattgcaacagaagaaatcggccacgtggaaatgttggcgacaatggttgctcgtttattagagggtgcgcctgttgaagatcaagaagcagcgatgcaaaaagatccaacaatcggtgccattatctctggaatgaatccacagcacgcgatcgtagctggcttaggacctcgtcctgctgacagcgtgggcaatccatggagcggtgcctatatcattgcgagtggcaacttgttagcagactttagagctaatttaaatgccgaatcacaaggaagacttcaagtagcacgtatttacgaaatgatcgatgatcgtggcgtaaaagatatgctgtctgttctccttgcaagagatagctatcatcaaaatctatgggaatgtgcagtgaaagaattagaagaaaaagaaggttcaatcttagtcccaagtactttcccgcgtgacaaagaacgaaaagacattgcttatgacttctataacttctcagagggagaccaaagtagtgaaggttcttgggctagtggcaaagcactggatggcgaaggcgaatatcaatggttgaaagaacctaagatcgaaggcgctgcaccaaaattagaaccagtaacaccaaaaatgtatgggacacctccattcaagaaataa

SEQ ID NO: 1108 - DNA (genomic), 975 bp, Enterococcus faecium; double-stranded, circular
  misc_feature (B) LOCATION 1...975
  hypothetical: NO
  anti-sense: NO
attctcattaacaattttttgaaggagcgaatgtatatgaaagttaaaaaagcagttattccagcagcaggattaggaacaagatttttaccagcaacaaaagctatggcaaaggaaatgttgccaattgttgataaaccaacaatccagttcatcgttgaagaagcgttgaaatcaggtatcgaagacatcttgatcgttacaggaaaagctaaacgaccaatcgaagatcactttgattcaaatattgaattagaaacaaacctaagtgaaaaaggaaagaccgaattattgaaattagtagaagaaacgacagatgtcaacttgcatttcatccgtcaatctcatccaaagggtttaggacatgccgttcttcaagcaagagcctttattggaaatgaaccatttgtcgttatgctaggcgatgatataatggaagacgaagtaccattgacacagcaattaatcgatgattacgaacgtactcatgcttctacgatcgccgttatgcaagttcctcatgatgaaacttcaaaatacggaattatcaatccaggagaagtattggaagatgggttatacaatgtcaaaaactttgttgaaaaaccagatccaagcaaagcaccaagtgatttagctattattggacgttacttattgactccagaaatttttgatgtattgtccgagcaacaaccaggagccggaaatgaaatccaactaactgacgcaatcgatacattgaataaaacacaacgcgtatttgcccgtaaattcacaggtaaacgttacgatgtcggtgacaaatttggttttatgaaaacaagtattgaatatggtctaacacatccagaagtaggtgcacctttacgtgagtacatcctgtctttaggtaaaacattagaagcagaaggaagcaagatcgatcataatccaaaaggaataacagaaatcaaagaagaaaagaaaaaataa

SEQ ID NO: 1109 - DNA (genomic), 876 bp, Enterococcus faecium; double-stranded, circular
  misc_feature (B) LOCATION 1...876
  hypothetical: NO
  anti-sense: NO
actatcattaaaagggtggaggaacttatgagcgtaattagtcgtattgaaagtatgatggaagattattcttcagcagaaaaaaagttggccaactacattatcggtaatattgagaaggtccctacaatgacagctaatgaattagcagaagcttccgggttgagtgcgccgacagttgtacgtttttccaaaaaaatcggttttcaaagtctgacggacttcaaaatcacgatttcaacagaactacagactggaatcgatgaaggttttagtgatatagaagcaaatgagtccttttactctatcaaaaacaaacttggtaacaatgcacaagtagcgataaaagaaacagtagatattctagaagaagaaacgatccaaaaagtcgtagagtgtttggaatcggcagagactgtttttttatatggggttggcgcctcttctttagtagtagaagatattctgcaaaaatggtctcgtgtcggtaagccaatcatttttgaaaaagatatccacgtcttgctcccgcaacttgtcagcaatgagaaaaagaaagtgctttggcttgtttcaaactcaggtagaagtgcagatgtagtcgcattagccgagctggcgaaaagcatgaatatcgaaatcattgcgttgacgcaatttggaaataacccgcttagcaagatagccgatgtactcgtacaaacatctagaccaaaagaaatcacgaatcgaagtgcggcaactaattcacttttggcccaatttgctacgatcgatatcattttttatttctatatggctaaaaacgaaaagcttagcgaaaaagtgaaaaaaacacgagaagcaatccaagaatattttatggattcgaaataa

SEQ ID NO: 1110 - DNA (genomic), 1161 bp, Enterococcus faecium; double-stranded, circular
  misc_feature (B) LOCATION 1...1161
  hypothetical: NO
  anti-sense: NO
ctcttaattaaagtaggtgcccatatgcttgtttcttttagtatggttataagattttttctgacaattttattatcactgatattaacacctgtattcaaaatcatttcagtacaaacaggtatggtcgacaaaccaaatgaaagaagaataaataaagttccaatgccttcagcgggcggactgcctatctttatttcatttgttatatcgactttattcttattccgtaaaattatccctcaatcgtatattgtaccgatcttgattgcttctttagtaatcatagtcacaggagtgctcgatgataaatatgagctgacacctaaacaaaaaagtatagggatcttgattgcttctcttattatttattttgtagcagatatacgtattgattccttcacgcttccttttattggatatatccaactaggctggcttagttttcccgtaacgattttttggatcttcggtatcacgaatgcggtcaatctgattgacggtttggatgggctggcggcagggatttcattgatcggtttaattacgataggaatcattggatattttttcctccatgcttctacagtgtatattccagttgttattttctgtcttgtagcaagtattatcggtttttttccttacaatttttatccggcaaagatttatttaggcgatacaggagctctattcctagggtttatgatggccgtcctttcactacaagggctgaagaacgtgacttttgtttcatcgatttctttgctgatcgtcatgggagtgccggtaacagacacgttttttgctatcattaggagaaaagcaaaccgtgtttctttttctacagcagataaaaaacatcttcatcaccgactaatcagtttaggctttactcataaaggtgctgtcctgacgatttatgcgatggctttgatgttttctttcacagctatggtcatgaattatactggaagaatcggaacgatcatattgattattgccatgttgtttgctgcaattttattatttgaattgattggtctgatcaatgagaaacatcagtttattttaaaaacattgcgatttttagggaataaagagtaccgtacgcaagtaaaacagaaatatttgaagaaatggaaccgtcatataagatga

SEQ ID NO: 1111 - DNA (genomic), 321 bp, Enterococcus faecium; double-stranded, circular
  misc_feature (B) LOCATION 1...321
  hypothetical: NO
  anti-sense: NO
gcaatgattaaagaatatcgtacgatcggtgaagtcgtcggtccattgatggcggttgaaaaagttgctggtgtcaaatatgaagaattaatcgaagtccgtatgcaaaatggcgagattcgtcgtggacaagtattggaagtccaagaagataaagcaatggtccaaatattcgaaggaacaagtggtatcaatttacgtgacttttctgtacgatttatagcccatcccttaaggaataggagtatcggaagacatgatcgtcgaataggtcgatggtttgggacgaccgaaagatacggaaccagagatcgtgcgtga

SEQ ID NO: 1112 - DNA (genomic), 534 bp, Enterococcus faecium; double-stranded, circular
  misc_feature (B) LOCATION 1...534
  hypothetical: NO
  anti-sense: NO
atggagattaattggagaaaaaatttagtgattgcgtggattggctgttttttcactggtgcaagtattagtttagttatgccattcataccagtttatgttgagcaactaggaacaccaaaagatcaaatcgaattgttttcgggactagcaatctctgtgactgcttttgcatctgccgtggttgcaccaatctggggaaatctagctgatcgaaaaggccgaaaactcatgatgatccgtgcagcagcagggatgacattaacaatgggatctttggcttttgtaccaaacgcgtattggcttttgatcatgcggttttggaatgggattttgtctggatatattccaaatgccacagcgatgattgcttcacaggcacctagagaaaagagacggatgggcgttaggaacattgtctaccggagcgattgctggaaatctgatcggaccttcaatgggcggtgcactggctcagtggtttggtatggaaaatgtattcttgatcacaggggctttgttgatgatcacaac

SEQ ID NO: 1113 - DNA (genomic), 360 bp, Enterococcus faecium; double-stranded, circular
  misc_feature (B) LOCATION 1...360
  hypothetical: NO
  anti-sense: NO
ttttttgttaatgaacaagataggaagaaacatttaatggacagttttcagagattgtcactagtaaatcaatttgagttattggctaaatttgaggaccaaaacagatcttattatgaaagaaaaatcgaaatattgagagaaggttacgagtatcattatgatgatgaaatttggagtgatctttctgagccatttccgaaagaagattctcgatttgtattagatgtattgaacatgtatcgagatatcaattttagtaaatcaaagctaaacttagatgaaaaccaaattactaattcatactatactcatttcggttctgttgcaaagttttccaaaaaatctattttagtgtaa

SEQ ID NO: 1114 - DNA (genomic), 828 bp, Enterococcus faecium; double-stranded, circular
  misc_feature (B) LOCATION 1...828
  hypothetical: NO
  anti-sense: NO
agtgatgttaaaagagaagaagaatttantgtgcgggtattgtttattggtgatgtactacgttcaatgggacgagagatgattactgaatatcttcctacattgaagaagaattcccgtccgaaattaacgaatgtaaatggtgagaatgccgcttctggacgtggaatcggccaaaaaatctataaaaaatttttgcaagacggcgtagatgtcgtgacgatggggaatcatacgtgggacaaccgcggaatctttgagtttgtaaatgaagctaaaaagatggttcgtccggcaaattttccggaagggacgcctggacaagggatggtctttgtcaaagtgaaccaagtcgaactggcagtgatcaacatgcaggctcgttcttttatggtggacttggatgatccttttcgtaaaatgaatgagctggtagaagaagccagaaaacgtacgccgatcatttttgtagattttcatggagaaacaacaagtgaaaaacaagcaatgggctggtttttagatgggaaagtttcagcagtggtcggtacacatacacacgttcagacaaatgatgcgcgaattttgccaagaggaacagcgtatctgacagacgttgggatgacaggtccctatgatggtattttgggtatgcgcagagaacctgtaatcgaaaagtttctgactgcattaccaaaacgttttgaagttgtggaacaaggccgatcgattttaagcggctgtatcttggaattggatgatacgacaggtcatgcaaaagaaatccagctgattcagatcaacgatgatcgaccgttcatggagtag

SEQ ID NO: 1115 - DNA (genomic), 1002 bp, Enterococcus faecium; double-stranded, circular
  misc_feature (B) LOCATION 1...1002
  hypothetical: NO
  anti-sense: NO
atgacagttaaagtaggtattaatggttttggacgtattggacgtctagcattccgtcgtatccaagatgtagatggaatcgaagtagtagcaatcaacgacttgacagatgctaaaatgttggcacacttgttaaaatacgacacaactcaaggacgtttcaacggaacagttgaagttcatgaaggttcattcaacgtaaacggaaaagaagttaaagtattagctaaccgcaacccagaagaattaccatggggcgaactaggcgtagatatcgttctagaatgtactggtttcttcacttctaaatcagcagctgaaaaacatttaacagctggtgctaaacgcgttgttatctctgctcctggcggaaacgatgttccaacaatcgtttataacacaaaccacgaaacattaactggtaaagaaacagttatctcaggtgcttcatgtactactaactgtttagctcctatggctaaaacattgaacgacaaatttggtgttgttgaaggattaatgacaactatccacgcttacacaggtgaccaaatgactctagacggacctcatcctaaaggtgacttccgccgtgcacgcgctgctgctgcaaacatcgttcctaactcaacaggtgctgctaaagctatcggtttagtaattcctgaattgaacggtaaattatacggagctgctcaacgtgttcctgtaccaacaggttcattaacagaattagtaacagttcttgaaaaagaagtaactgttgacgaaatcaatgcagcaatgaaagaagcttcaaacgaatcttacggatacaacacagacgaaatcgtttcttcagatatcgttggtatgacttacggttcattatttgatgctacacaaactaaagtaatgacagttggcgacaaacaattagttaaaactgttgcttggtacgacaacgaaatgtcatacactgcacaattagtacgtactttagaatacttcgctaacttataa

SEQ ID NO: 1116 - DNA (genomic), 216 bp, Enterococcus faecium; double-stranded, circular
  misc_feature (B) LOCATION 1...216
  hypothetical: NO
  anti-sense: NO
ctcagagttaaacggcagacttacaacctcttgataaacggtgttcaaaaacttgcatctgcggtaataagttcagccaattcaaaaacaagaaaagctgtttttgcttggctattcttattacttgttgcagggcagctttttcacaacctctccactaaacggtgttctcctgccaactcctcggtcacaagtcacaatattcaacaaacatga

SEQ ID NO: 1117 - DNA (genomic), 468 bp, Enterococcus faecium; double-stranded, circular
  misc_feature (B) LOCATION 1...468
  hypothetical: NO
  anti-sense: NO
gaggtgtctaatatgaaaaagaaacagcgaaaagcactgatgcgggacatcattacagaacaacctattgggacacaggaagagctgcttgcgcggctgcatgaagcaggcgccgatgtgactcaagcaacgatttctcgagacattcgagaaatgaagttagtaaaaagtcaaaatgaaaacaaaatagtacgctatacattatttaaccagccatctgtttctttaaatgaagaacgtttgcgtacagcaattagacgcgaggttttgcgtatccagtctgttcagttcatggttatcgtattgactgaacgaaatggtgccgatgtggtaacgaattggctagatgaagtggcttaccctgaagttgtcggaacgatggccggtgtagatacattcattattatttgccgctcagaagaagaagcacagcgatttgcagaaaagctggaaaaaatgagggaataa

SEQ ID NO: 1118 - DNA (genomic), 531 bp, Enterococcus faecium; double-stranded, circular
  misc_feature (B) LOCATION 1...531
  hypothetical: NO
  anti-sense: NO
aatatgttccttttaaagcaatttattccagtacaggcaaagcgagcacgtgatacagcagaaggtatcaacaaagagcttgctcgtccggtagagattttttatacagataagctaagagaactagggctgggtactttagaaggtcagtcgatcgatgaaatgtaccagaaatatccggataatctgccgaatttgcgtaatcatttagatctgtatgatccttctccttttcacggagaaacgattgaatcggcaatcacacgtatcgaaactgttgtagcagatgcggttgcccgacataaagatggcccacttttattcgtaggacatggagcttctttaactgcagccattcaatggatgacaggaaaagagctaagtgagttgcgtgaaatgggtggattgttcaatagtagtttgacgattttagagactgaagagccttgcagattattgccatatgaactgaaagtatggaaccaaacagattttttaggaactgaaacagcaccagaacctttactatag

SEQ ID NO: 1119 - DNA (genomic), 375 bp, Enterococcus faecium; double-stranded, circular
  misc_feature (B) LOCATION 1...375
  hypothetical: NO
  anti-sense: NO
tggacttgttttatttgtcaaacccatcgtaatcgagatatcaattccagtctcaatatcctgatcaaaggtctaagaatccaaccattttcttgttactttgtcagattgattaccttttttagtctccgaataataaggttttcggatcaactaacatgctctgagaaagactactatctttgcaaatttccaaatgaaggtgtgggccagtactattcccagtacttcctacatagccaattatttgtccttgcaaaacattatctccagtttttactaggtattgttgctggtgagcatataacgcggttgatccatcttcgtgttgtatcaccacgtaatttccccaagagtagtgaaactctgctttaa

SEQ ID NO: 1120 - DNA (genomic), 261 bp, Enterococcus faecium; double-stranded, circular
  misc_feature (B) LOCATION 1...261
  hypothetical: NO
  anti-sense: NO
gtttcgttcctcataatgaattttcgaggaggaactgaaatgattacaattgccagtgcaatgcaacaagatgaaatcaaagaattgttagaaggatacaatgaagaaggaatgacttttacatttaaagaaaaacaaggaatcaagctgttctttgaaacaagtgcagaagatccggaagttgcggctaaaaaagcaaaggaactaatcaaagcacagccttggggaacagtcctttattttcaatcaacagctgtttag

SEQ ID NO: 1121 - DNA (genomic), 270 bp, Enterococcus faecium; double-stranded, circular
  misc_feature (B) LOCATION 1...270
  hypothetical: NO
  anti-sense: NO
gtaaaacctaagagagcagtaagcaaaaattatactgactcttgcaggaggagcctttctcttcctttatggttaaaagaattatttgagtattttgcctatctaccacctattagattcactacatggtctggaaacaaaggaatgcaaaaaaatggtgagaaatgtggaatgacaaaggaagtagtgataagaaaagttagatttttaaataatcaatattatgattcagtcaagtatggcattttatgggaagaactagctgattag

SEQ ID NO: 1122 - DNA (genomic), 513 bp, Enterococcus faecium; double-stranded, circular
  misc_feature (B) LOCATION 1...513
  hypothetical: NO
  anti-sense: NO
atcgcttgttttttcgtatatttttttagggcgaataatatgaatcatttttggggtagaaggcttctgacgagagatattaaagcaatagactgtgaggaggtaaatttaccaaattatgagaagatcgcagcagtggaacgtttgggcaactggattctttgtcatcgctgtggaatgaggacgtccgtcattgatggacagcttgcagattacggttatttttgtacacattgtctatatttagggcgatgcgacactcaacaagatttatatttgtttgatcagcctgaagcaaaacctcgagaagtcgtctttttttggacaggacagcttactgaaaaacaaacggaaatcgcaaagagaatactttgccattcagaaaaaaagacatcatcttatttgggctgtaacaggtgcagggaaaacagagatgctttatcctattttagtggaaactttaaaagctggaggaagagtagcgatttgtacaccgcgagtcgatgtttgtaa

SEQ ID NO: 1123 - DNA (genomic), 1137 bp, Enterococcus faecium; double-stranded, circular
  misc_feature (B) LOCATION 1...1137
  hypothetical: NO
  anti-sense: NO
ctaaagttcctgaaggctttgaaacagtcggaacaagcaaagattgtccgattgcttctatccaagacacaacacgtaatttttatggtatccaattccatgcagaagtacgtcattccgaatacggaatcgaattgctgcgccactttgcctttgatgtttgtcactgttgaacgtaactggacaatggataactttatcgatatgcaagtagaaaaaatccgtgaacaagttggtgacaaaaaagtcttgcttggtctttcaggtggcgttgattctagtgtcgttggggttcttttacaaaaagcgatcggtgaccaattgacatctatctttgttgaccacggtctgctacgcaaaggcgaagcggaacaagtaatggaaagtctaggcggaaaattcggcttgaacatcatcaaagtcaatgcaagagatcgcttcttagacaagttgaaaggtgtatctgacccagaacaaaaacgtaaaatcattgggaatgaattcgtatatgtttttgatgacgaagcaacaaaacttgctggtgaagaaggcgtctctttcctagcacaaggaacgttgtatactgacgttatcgaatctggtacagaaacagcacagacgatcaaatctcaccataatgtaggtggactgccagaagatatgcaatttgaattgatcgaaccattaaacacattattcaaagacgaagtccgtgaattagggactcagttaggcatgcctgattcaatcgtttggcgtcagccattccctggtcctggtcttggtattcgtgttcttggcgaaatcactgaagacaagctagaaatcgtacgcgaatctgatgctatcttgcgtgaagaaatcgcagctgctggacttgaccgtgatatctggcaatatttcactgttcttccagggatccgctctgtcggtgttatgggtgacggacgtacttacgactacacagtcggtatccgtgctgtaacttcaatcgacggaatgaccgctgactttgcccgtatcccatgggaagtcttgcaaaaaatctctgtacgtatcgtaaacgaagtagcccacgtcaaccgtatcgtgtatgacatcacttctaaaccaccagcaacagtggagtgggaataa

SEQ ID NO: 1124 - DNA (genomic), 813 bp, Enterococcus faecium; double-stranded, circular
  misc_feature (B) LOCATION 1...813
  hypothetical: NO
  anti-sense: NO
cttcttactaaggaaggcgaaaatatggcatttattcaagcaaatatttattcgaatgtgttagaaatggaagtcaatctaaatgtgatactaccgcaaacaacaaaaaaggtgattggcaccagttcagagcaagagacaacggatatacctgttttatatttacttcatggaatgggtggcaatcatagtgtatgggaaagacgtacgtcgattgaacgttatgtagcaaactacggattagctgtcatcatgccatctactgatcttggctggtacacagatacagtttatgacatgaagtattggacattcattgcagaagagctacctgagatttgtcatgaattattcccgcaattaacaagaaaaagagaaaaaacatatgccgctggattatcgatgggcggatatggcgcgttaaaactaggccttgcaaaatcagaaaatttcgcagcagtaatctctctttcaggcgctgtttctgtaggaaatcgaatggatgatcttttgatggttcgtaaagcatctttttgggaagggatctttggaccattggatcaaatcgaaggttcaaaaaatgatccgcaatacttattgaaagaactagtaaaaagcggaaaaccagttccaaaattttatatggcttgtggggaatctgattttctttatcaggcaaatcaggaaatggtatctgctatgcaggaacaaggcttggcggtcacctttgaacaaggacctggcgatcataactggatcttctgggaccaatggattcaacgtgcattggcgtggctaatggaaaaaaaataa

SEQ ID NO: 1125 - DNA (genomic), 1119 bp, Enterococcus faecium; double-stranded, circular
  misc_feature (B) LOCATION 1...1119
  hypothetical: NO
  anti-sense: NO
aacattactaaaaagggggcaaataagatggcacaacatgtttttatcgtggggcttggactgattggtgcttctatggcactttgtattcgtcagaccaatccagaactgatagtagttggttgggatagtcagtcaaaaacccgtgagcaagcagtagaacagcagatcgttgattacgttgcaagtgattttgaaacaggtgcagaacaagcagacgttatcttattagccgttcccgtccgtacaaccttagcttatcttgatgtccttgaaagaatcaacttgtctgatcacgtcatcattacggatgtcagcagtacgaagcagcaagtcgtgacatccgctgagcagaaaaatcttcggtttgtcggtggacatccaatggctggttctcataaatcaggtatacaggcagcagatgctaaactatttgaaaatgcctattacatctttacacctttggaaaagacgaaaaaagatgttgaaaaactgcaagaactattttgcggaaccaaagcaaaatatgtaactcttacagcaagagaacatgaccgtataacaggaatgctaagtcattttccacatattctggcagctggcttagtcaatcaggcagaacaattcaatcaagagtatccgcgagccaaacaactggcagcaggaggctttcgagatatcactaggatcgcttcctcagatcctgtcatgtggacagatattttgttgagcaataagcagatattattggaacgattggcagattggcaacaagaaatgacacaaatagcagaatggatcatgactgagaaccaatcggaaatcttttcttttttcaatcgggcaaaagaaagtcgagaccagttgcctgtccataagcaaggcgcgattcctgccttttttgatttatttatcgatgtgccagatgaacctggcgttattgcagaagtaactggactgatcggaaaagcgggagtttctttgattaatttgaagatccaagagaccagggaagatattttaggaatactgcaaatcagttttaaaaaccaacaggatttgttacaagcaaaaagaatcattatgtctaataccagttatcattgctggatcaaatag

SEQ ID NO: 1126 - DNA (genomic), 864 bp, Enterococcus faecium; double-stranded, circular
  misc_feature (B) LOCATION 1...864
  hypothetical: NO
  anti-sense: NO
tcaattactaaaagtttccccaattcattaagaaaggagaagatagagatgaaaaaaaccagttttctattcgctttgatcgcaggtcttcttctttttgcaggctgttcgaacaaaaaaacttcagcagataattgggcgactatcaacgaagagaaaaaaatcgttataggtttagacgatacatttgttcctatgggatttagagataaagacgggaagctcacaggatttgatattgatttagccaaagcagtctttgaacaatatgggattacggtagactttcagcccattgactggtcaatgaaggaatttgaactgaacaatggaacgatcgatttgatatggaacggctattccaaaacgccggcaagagaaaagaaagtgcaatttacaaaaccttatatggaaaacgatcaagtgctgatcacacctaaagaatcaggaatcacaaactttggacaaatgaataataagagattaggtgcgcaaaatgggtcatctggttatgatgtatttacgaaacaaccagaagtattaaaagagatagtcaaaaaccaagatgctgttttgtatgatagttttaatgaagcattgatcgatctgaaaagcagacgggtcgatggtctgctgatggataaagtatacgcagactattatttgaaacaaagaaacgaactagaagacttcaacataacaaaaggttcttatgagagtgaggattttgcagttggtgcacgcaagtcagatagtacattagtgaaaaaaatcaatgaagccctagatcaactagagaaaacaggtgaattccaaaaaatatccgataaatggtttggcgaagatgttacgccgagaaattaa

SEQ ID NO: 1127 - DNA (genomic), 984 bp, Enterococcus faecium; double-stranded, circular
  misc_feature (B) LOCATION 1...984
  hypothetical: NO
  anti-sense: NO
atgactactaatttttggaaagagctgccaaagcctttttttgttttagcaccaatggaagatgtaacagatgttgtatttcgccatgtcgtaaagcatgcagcagcaccggatgtcttctttactgagtttacaaactcagacagtttctgtcatccagatggaaaagacagtgtacgaggaagattaacatttacagaagatgaacagccgatggttgcccatatttggggagacaagccagaattttttagagaaatgagcattgctatggcagaaatgggcttccaaggaatcgatatcaacatgggctgcccagtccctaatgtagcagaacgtggaaaaggcagtggcttgatccttcgtccagaagtagcggcacaattgattgaagcagctaaagctggcggtttgcctgtcagcgtcaagacgcgtatcggctatacggaaatgtctgagatggaagaatggatcagtcacctacttcatcaagatatagccaatctttctgtccatttgcgtacgcgtaaagagatgagtaaagtagatgcacattgggaagtcattcctaaaatcattgctttacgtgaccaaatcgctccacaaacactaatcacgatcaatggagatatccccgatcgccagacaggagaagaattggccgagaaatatggcgttgatggcatcatgattggccgagggattttcaagaatccttatgcatttgaaaaagacccgagggaacatacagaaaaagaactgatcggactacttcgtctgcaactagatctgcaagatcattattcagaaatcatcccgcgttccatcacaggactacatcgtttctttaaaatctatatcaaaggatttccaggagcaaatgacttgcgagttcagttgatgaatacgaaatctactgatgaagtacgagagatcttagagacctttgaaaaagaacatccaacgcttttcagtgaacaatga

SEQ ID NO: 1128 - DNA (genomic), 228 bp, Enterococcus faecium; double-stranded, circular
  misc_feature (B) LOCATION 1...228
  hypothetical: NO
  anti-sense: NO
tccatcactaatatctggtccgcatttttgattgtggacaggcgatgggcaatcacaaaactggtttttccttccatcattgctaagaaggcttgttggatttttttctctgtcaatgtatcgactgagctggtagcttcatctaagatcaacatagggggattactgatcatcgttcgagcaatcgtcaacagttggcgttgtccatctgatatctttaacccttga

SEQ ID NO: 1129 - DNA (genomic), 231 bp, Enterococcus faecium; double-stranded, circular
  misc_feature (B) LOCATION 1...231
  hypothetical: NO
  anti-sense: NO
atattaactaaaaacagcaagaaagaagaggatcaaatgtattatgtagaagtaaaaacaaaaggcgtcaaaaacaaacaatatgtgaaaggtatcagtaacgaatatcctttacttggttcatggaaagaagctgctcctttttccaaaccatgtgccataaaaataaagaacgagctagaaaaagaactgacttgtggtaaagctgttgtagatatcatcgaaaagtaa

SEQ ID NO: 1130 - DNA (genomic), 375 bp, Enterococcus faecium; double-stranded, circular
  misc_feature (B) LOCATION 1...375
  hypothetical: NO
  anti-sense: NO
agagaaactaattttatcgaggtgaaaatcatggcatttgaaacaacagcaacggtactgggcgcaccaattagctatcgtttgcatcctgatgcaaaaagatatacattgcgcgataatggatttacagaaacaaacggaggcaattatcaattgatccgaccattagatgccacgccgcaaagcaaagaaggattcaaattaaaaatcactgtatcaaaagatattcaaacattgaaaatgtcgatcactacagcaaatggattgaaagcagtcaatattttcaaagatccaaaacagaaaatgagccaagataaattttattttctgatggatgggatgattagccgtgggttattcgaaaaagtcgaatga

SEQ ID NO: 1131 - DNA (genomic), 1239 bp, Enterococcus faecium; double-stranded, circular
  misc_feature (B) LOCATION 1...1239
  hypothetical: NO
  anti-sense: NO
aaaaagactaaaattatgctaaaggctggtggggaaatgcttgataaagtgatgtttgaagagataatacatccagaaaaatggataaatgaatgttataaagaattaatggaaaaagaatggaataatgagatcgagcgttgtcgcagacacacggagaggttaatcaaacgtatcagtaacagtcagtatcaattcccaagcgagtgtcctataaaaggacgttatccattaagagacaatattggttggacagaaggattttggacaggaattaattggttgttatttgagaagacgggtgatcctttatttcaacaaacagctgaaaaagcagatatagattttatccacaggattgactgtcaaattatcactaatcatcacgatcttggttttttgtattctttatcaaccgtagcagattataaaataacgggaaatcgaaaaatgaaggaagcttcaattgatgctgcagaaacattacttcagcgtttttgggagaaggcaggagttatacaagcttggggagatcctagtgatccttcacaacaaggtagaatgatcatggattgttgcatgaatcttccattattgtattgggcgagtgaagaaactggaaatcaaaaatataaaaaagctgctcaggctcatattcaaaatgcagcagattatttagtaagagaagatggttcaacttatcatacattttatatggatgtcaaagatggaaaaccaagatatggaagtacgcatcaaggttatagtgataattcctgttgggctagaggccaagcatgggggatttacggttttgcattaagttatcgttatttgaaagaacaaaaatattttgatttaagcaaaatattagccaattattttatgaatcggttgccagaagataccatttgttattgggatttgatctttgatgattctagcagagaagaaaaagatacatctagtatggtgatcatggtttgtggattattagaattaatagaatcaggtctattagacaaaacagaaaagaacttataccagtctgctgtttggaaaattatgcgacaattgaaagaaagatatgctacaacggaagaagaagatggctttttaacacagtctgtttataataagcccaaaaataatggggtaaatacaccttgtatttggggtgattactattatttagaagctttagtgagaatgactagtaattggtcttcttattggtga

SEQ ID NO: 1132 - DNA (genomic), 210 bp, Enterococcus faecium; double-stranded, circular
  misc_feature (B) LOCATION 1...210
  hypothetical: NO
  anti-sense: NO
agaccagctaaaaataaaatagtgttatatcctacactaagccaaatcatcgtgatgatcattgatattcgtatccaaaaaggatttgttaaccactgtacaccgttaattcctagcgcattcaaaaatccattgaataacccagtcggattgaaaaaagtcatgaatacggaagctacagccaccgttgatgtaatggttggaatataa

SEQ ID NO: 1133 - DNA (genomic), 522 bp, Enterococcus faecium; double-stranded, circular
  misc_feature (B) LOCATION 1...522
  hypothetical: NO
  anti-sense: NO
tggtattgtttgcccacaaaaaacccggaaactcgaagtgtatgtcaaacatcagaacttaaattggaggaaaataacgtgcgtacaacatatatgggcaaaccaggcgaagtagaacgtaaatggtatgtagtacacgcaactgatgttccattgggacgtctttcaacagttgttgcatctgtactacgtggtaaaaataaaccaactttcacacctcatttggatactggcgatttcgtcatcgtcatcaatgcagacaaagtgaaattaacaggtaaaaaagcgactgacaaaatttattaccgtcacagcaactacccaggaggattgaaatcaatcactgctggcgaattgcgtgctaaaaattctcgtcgtttgatcgaaacttctgtaaaaggtatgcttcctaaaaacactttaggccgcaaacaatttacaaaattgaacgtatacggtggagcagaacatccacatgcagcacaacaaccagaagttttagacatcacaaacttaatctaa

SEQ ID NO: 1134 - DNA (genomic), 1128 bp, Enterococcus faecium; double-stranded, circular
  misc_feature (B) LOCATION 1...1128
  hypothetical: NO
  anti-sense: NO
cgattggctaaaccacacatgacatttgtcacaatgaaggagtctgctatgcataaatctcggctactcaacgaaactagctttctactggttatctcattgcttttgctggtaagtcaaggattcgttgctatgcaagttatctatttattgatcgccgttttattcactggtgtcagttatttactgcctacaaagccaaattggattttccaagttattctatttcttttatgtgcctttttacctgatcttgtcctgtttctgccagcgacgatgcgagtgatcgcccctgaagaaagccaccttgattacttgtttttgttaggttttttgttgatttcgacggttggtaatcatccccccatcaaggtcgcctttgtcgtaattttgctgtttttttccttttacttacgaaaaaaagatcaacgaacgaccgatcttgagaaaaagtacattgtctccaaagatactcattgggaaaaacaacaagagttatcggaacaaaataaagcattggccctgtcacaagaaacacaattagccttgcaaattgtggaagaacggaaccgaattgcccgagacatccatgacaatgtcggtcatctgctgtcaagtgcgattttacaaattggtgcgcttgaaatgatcaatcaagaaccaaaactaaaagaaccattagaaaatttaagtgccaccgttcacactgggatggatcggattcgtcaaagtgtccatgacctccatgagacatcgatctcttttcaacactccttagagtttctgatcgctgattttccttcttctgttacgattgaaggaaacttgtttgaaggattgaatgaaacgcagcaaaactgcttcttaatggtcatcaaagaagccttaaccaacagtatcaaacatagtcatgccaaaaccgttgttttacattttcgaacgttgccggccttttatcgcttgcaaatcacgaatgatggcaccagcccacaaaaaaattctgctcccggtattggtttgaaaacgatgcgtcaacgtgttcaagaacaaaagggacaagtccatattttccaagaaaaccagcaatttcagttaacgatcattttaccaagggagggacaccaatga

SEQ ID NO: 1135 - DNA (genomic), 3174 bp, Enterococcus faecium; double-stranded, circular
  misc_feature (B) LOCATION 1...3174
  hypothetical: NO
  anti-sense: NO
aaaatggctaaaaagagaacagaagcagaagtaactttcatagctaacgatgacggattgaaatctacgttaaaagaaatcagtgctgaattaactaaaaatagagcagaattaaaactagaacaagctcaattacaacagactggttctgaatcagacaagttaggaagtaaattatcttctttagaaaagcagtatgaattacaaagtcaaaaagttgaagtaactagccaacgtttagccaatgcgaaaaaatattatggagaaaattccaccgaagttcagaaacttgaaagagaactgattaatcaacaaacagcgcaacaacgtttgtcaaacgaaattgataaaacgagtaatgcactagctcaagcaaaaggcgaaatacagacgtacgagtctacaatgcaacagttggatagcgaacaaaaaaatgttcaagctagtgcttctctgattgaatccgaatacaaaaaatggcaagcaactgctggtcaatcagcttctgaagccgagaaattagcgaaagcccaagaatatgtttctcaacaatctgaaaatgcggagaaaacgatagatatcctaagacgacagttagaagctacacagtctgaatttggcgctacatccacagaagcaatgcagatggaagcgaagcttaatgatgctgaacgtgaatttgaagagttaggacaagctgctaaaaatgtagatacaactaacttggacgatatcggaagcaaaatagatatgaataatttaatggaagcttctgacgttttaagcgacattggcgataagcttacagaattagggaaacaagcagtggactctgctaacagtgtaggtagttcccagagtaagatacaagctaattttggtttgtctaaacaagaggctgaagaattaacgaatgtagccagagacatttattataaaggttttggagaatcgttagatcagtccacagatgcattgattttggtaaagcgtaatttaggagatttaaataatcaagatttacaaaatatcacggaacaagctatggtcctagaaaacaccatgggcgctgatatggatgaaacgttacgtggtgtaaatggcttaatggtcaatttcggcttgagtgctcaagatgcaatggatttaatggtttcgggtactcaaaacggtttagataaaacgcacgaattaggcgacaatatggcagaatatagccaattatggagtcaaatgggatattcagctgatgaaacgttcggaatgcttcaaaatggtttagatgcgggtgcttataaccttgataaagtcaatgacttagttaaggaaatgggaatatcgttaacagatggtcgatttgagcaaaacatggatatgtttagtgaaagtactagaaaagcttttgaagagtggaaaaatggcggaggaacacaaaaagacgttattaattccatgattcaagattttagcaatatggatggtcaatacgaccaattaaataaagcttcgacaatttggtctgcgcttggcgaagataatgcgatgaaagttgtccaatctttaactgatgttaaccatacatttgatgatgttagtggatctgcacaaaaaatgaatgaagattctactactccgttgcaagagttgaacgggaaaatagctgaattaaaggattcattagctcctataggcaacacaatcatagatgcactcgaaccagtaattgattttctaggaaagatggctgatgcgtttaataattttccacaaccagtacaggatttcattgttgctataggtggtcttacagcagcatttggcatactgttaccggcaatactagccgtgtcatatttatttggtccgatgatgcttataattggaggaattatagctgttatagcaggcgttattgtggcaattaagaactggggtgcaattactgactggtttagtggtttatggaaaaaatttactgattggttgggtgatacttgggaaagtataaaagacggagcctcatcagtttgggatggggttaaagaaacctggtctggatttgtagattgggttcaagatatttggcaaggagtttctgattggtttggagagctatggagcggattagttgaaggagcttccaacatctggcaaggagtccaagaaacttggcaaacattcgttgattgggtttcaaatatttggaacggagtcaaagaagtatggtcgattatttgggcagacattgtaggaattgttcaaataccatggacattaataacgtcattgattcaagctggtattaatattatcgtgggtatttttgatgtagctggacagttattgggcgcagcttggcaagctgtttggacacctatttctgatttccttaaaaatacttgggatactatgacacaatggataagtatcgcttggaatgggattgtaactacattccatactatatttgatccagtagtggcatggtggaatggtatatggacagctattagtactacggcttcaaatatttggaattcaattagtgcaacagcttctagtatttggaacagtatcaagaatacaatcactagcttggtacaagcagctgctacagtaattcaaaatatttggtcaactgtatctagttggttaggtggaatttggaattcaatcagctctacagcatcaaatatctggaatagtgtgactagtagtataagcaatgctataaacgcagctaaaagtgccattcaaagtgtttggaatagtatatcttcgtggattaccggaatttggaacggtatcaaaaatactgctttgaatctttggaatggaattacaagcactattagctctaaagtaaacgatggaaaaaatgcaatttcaagcggttggtccaatctaacaggtattgtttccgacatattcaataatgttaaaagtacaattgctaacatatgggaaggcatcaaaaagactgttagcgctccaattgattggattagagacaaaatcagtggcatttttgataatttgaatatttctataccacatattccgttaccggaatttatcatggaaggcagctttaacccgctaaaaagtcaaatcccccatttgcgtgtaaaatggcatgctaaaggagtatctttactaaaccaactttactag

SEQ ID NO: 1136 - DNA (genomic), 702 bp, Enterococcus faecium; double-stranded, circular
  misc_feature (B) LOCATION 1...702
  hypothetical: NO
  anti-sense: NO
accgtggctaattatgaactcaatatcgcccacctttatggaaatttgatgaacacatatggtgataacggaaaccttttgatgttgaaatatatagcagaaaaaatgggggtttcttgccatacggagatcgttagtatacatgaaccttttgatgctgataaatatgacttggttttctttggcggtggtcaagactttgagcaattaatcatttcaaaagacatccagaaaaagaaagattctttgatcaactatatcgaaaatgatggcgtcatgttagccatttgtggtggctaccaattgctaggtcactactacatgggagctaatggagaaaagatccaaggaatcagtgcactggatcactacacgttaagtcaggaaaataaccggtttatcggtgatatcgttatccataacgaagaattcaatgaaacttattatggatttgaaaaccacaatggtcggactttcttaggtgaaggtgaacgacctttggggaaagtggtacaaggtcaaggaaataatggtgaagaccaatctgaaggtgtcatttaccgaaatgtcttcggttcttatttccatggacctatccttgcaagaaatgagaacctggcagctcgtttgatccgcctagctttagaacaacgttacggtaaagaattggatctgccctatcttgaaggacaaacagcctag

SEQ ID NO: 1137 - DNA (genomic), 591 bp, Enterococcus faecium; double-stranded, circular
  misc_feature (B) LOCATION 1...591
  hypothetical: NO
  anti-sense: NO
agatgggctaacaaaatgaataaaaacaaaatggcaactcgcgtacttacagtgatggctttgtgtattgggatcaattatattggaggaacgattgctttatggcttcgtttgccaatctatctcgattctatcggaacgatttttgctggtgcattgcttgggcctgtacctggaatgctgacaggattgtccagcggtattttaagtggagtgactacagatattttttctctgtattattcgccaatccaaattctcacaggcttgcttgctggattgattttgccaagatatctcggcaaagataaaaacagcttgaaactgttattactcgctttgattttgtcggtacctggaacgatcgtttcttcgatcattaccgttcagttatttggcgggatcacctcctcaggatccagtatgatcgttcagctattacatgggttaggtttaagtcagacaacaagtgtgatcttggtacaggcaggtacagactaccttgatcgtttgttgtctatcgtcgttgtttcattagtcatcactatgttgccacaacgcttgatatattcaaaaagaaaaataggctga

SEQ ID NO: 1138 - DNA (genomic), 348 bp, Enterococcus faecium; double-stranded, circular
  misc_feature (B) LOCATION 1...348
  hypothetical: NO
  anti-sense: NO
ggtatttataaaaatgtaaatgaggtgcagaaaatgaatttgctatttcaatcaataaaatcgataacagtcccagaattaaaggaaaagcttttggaaaatccagcgttacttgatgttagaacacctgcagaataccggggcgggcatataaaaggagctaaaaatgttccattacaaagtataaacagatatgatggagacaaagaaaagaccgtctatgtgatttgtcaatcagggatgaggagtaaacaagcagctaaagaattaaagaaatctggttatgatgtagtgaatgtacgtggtggcatgaatcaatggtttgatcgaacagtaggagggaaataa

SEQ ID NO: 1139 - DNA (genomic), 765 bp, Enterococcus faecium; double-stranded, circular
  misc_feature (B) LOCATION 1...765
  hypothetical: NO
  anti-sense: NO
tcagtttataaaataggagtgatagatatgtcaatccaaatcagccacttgaatgtagtcattgaaaacctgaaaatattagaagacatccatttcactatccctaaagatacctttacatcgattgtcgcgccaagcggagccggtaagtcaacattgctgaaaactttaacaggagtccagcctatgacttctggaacgatcaaagtagacgatcaaaaagtaactggtctccatacagcatttagttatatgccgcaagaagatatgttacttccttggctgagcgtctatcaaaacgttacgttatatcaaaaaatcaatcatctaacaatcaatgaagaacaagtaagggattatctggatatctttgggttaaacggctatgaacattttttgccggaacaattatctggcgggatgaagcagcgaacggccttgttacgaacaatcatgaatccttcttcttacttgcttcttgatgaaccatttggagcgttagatgctatgaccagagggcagatgcaagactggatgttgaagctgcctaaaaaagcaaagcggactactttacttgtgacgcatgatatcgaagaagcaatttatttatcagacaggattcttgtgctttccgcccgtccggcacatgtgattgctgagattcaagtgcctgaaaaacgacggtcacgtgaatggctactgcagcaatcagagttgaagcaaacgatttatcagttattggcaggtgaattagatgttaagtga

SEQ ID NO: 1140 - DNA (genomic), 381 bp, Enterococcus faecium; double-stranded, circular
  misc_feature (B) LOCATION 1...381
  hypothetical: NO
  anti-sense: NO
atgacttataaaattggacaaataattgaaggaaaagtgacagggatacagccttatggcgcattcgtttctcttgataacgagacgcaaggacttattcatgtttcagaagtacaatccggttatacgaaaaatatccattcattgttaaaagtcggacagccagtaacagttcagatcatcgacattgatgaatattccaaaaaaatcagtttatctttaagaacgttagaaaaaacaaatccagctgttccatatcgcagaaaaaggtatttcacgaataaaaatcgtaagatcggatttaccactattgcggagcagttacctatttggatagaagaagcattatctgaactagaacggaaagaaaataagaaataa

SEQ ID NO: 1141 - DNA (genomic), 765 bp, Enterococcus faecium; double-stranded, circular
  misc_feature (B) LOCATION 1...765
  hypothetical: NO
  anti-sense: NO
atggactataaaggatatttaattgatttagacggaacgatttatcgtgggacacaacccataccggccggtaaacgatttgtggaagaattgcaaaaaagaaaattacctttcttgtttgttaccaataacacgactaagtcaccagaaacagtagctaatcgtctagcagatgagtttgacattcatgtagctccagagacagtctacacagctactttggcaacaatcgattttatgaaagcagatggaaaagggaaaaaagtctatgttatcggagaagcaggattgattgacttgattttagctgccggatttacatgggaagaagaggctcctgactatgtagtggtaggcttagataattatctgacctatgaaaaagtagttaaagcaacacttgctattcaaaaaggtgctactttcattggaacgaacccagataagaatatacctactgaacgcggccttcttcctggagcagggtcagtcatctcttttgtagagacagcaacccaaacgccgccgatctacatcggaaaaccagaagccatcattatggataaagccgttgaagtattagggctgcaaaaagaagaagtaatcatggttggagataactatgaaacagatatccaagctgggatacgcaataatatagatactttgctcgttttatcaggttttacaaaagaagaagatgtacctgggttgcctatcccagctacctatgtgaaacaatcactggatgaatggagcttctaa

SEQ ID NO: 1142 - DNA (genomic), 984 bp, Enterococcus faecium; double-stranded, circular
  misc_feature (B) LOCATION 1...984
  hypothetical: NO
  anti-sense: NO
accatatataaacatacgattgaaaggatagaaacgatgaaagtatcaattgttgtcccatgttttaatgaagaaaaaactgttcctcttttttttgatgaggttgaaaaattcaaaggtgcccatgagttcgaatatttgtttattgacgacggatcaaaagacggtacgttagcagcaatcaagaagctagcctcagcttatccttatgtccgctttgtctcattttccagaaattttgggaaagaagcggctctgtacgctggattgcaagcttctacaggagatttagtgaccgtgatggatgttgatctgcaagatccgcccgaactgcttcctgagatgatcaaccggatcactacttctgatatcgattgtgtcggcacccggcgttcgactcgtgaaggcgagcctgcgatacgcagtttctttgcgaaaaaattctaccagttgatcaataaaatcagcgatacagaaatggtcgatggcgctcgtgatttccgcttgatgactcgtcaaatggtggatgccgtcctagaattaacagaatacaaccgattttcaaaaggattatttagctgggtcggatttaaaacagaatatatttcttatgaaaaccgcgaacgtgtggctggcgaaacatcttggtccttctggaaattattcaactactcgattgatggtatcgtgaacttctcggatgcaccgttaacgattgcttcatttatcggcgctttgtcttgtgtcggttctggtattgcaattttgttcattattttgcgggcattgttgtttggtgatcctacatcaggatggccttccatggtctcgatcttcctgttcattggtggaatccaattgttatgtcttggaatcatcgggaaatatattgggaaaatcttcttagaaacgaaacagcgtcctgtttatatcataagagaaacagaaaaagtgaagccaaatgaattgaagcctcaccaataa

SEQ ID NO: 1143 - DNA (genomic), 1458 bp, Enterococcus faecium; double-stranded, circular
  misc_feature (B) LOCATION 1...1458
  hypothetical: NO
  anti-sense: NO
tacacatataatggaggaagtataatgggattcagaaaagattttttatggggcggtgctacagcagccaatcaatgtgagggcggttatgatgaaggtggacgcggactagcaaacgtagatgttgtgccaatcggaaaagaccgttttcctgttatcaccggaaagaaaaaaatgtttgaatttgatgaggatcatttttatccagcaaaaattgcaatcgatatgtatcatcgttataaagaagatattgctttgtttgcagaaatggggttcaagacttatcgaatgtccatcgcctggagtcgtatttttccaatgggggatgagaaagagccgaatgaagctggcttgaaattttatgaggatgcctttaaagaatgccaaaagcacggaattgagccacttgtgacgattacgcattttgattgtccaatgcatttgatcaaagaatatggtgcgtggcgttccagagaactcgttggtttttatgaaaatctgtgtcgagtcatcttcaatcgctataaaggacttgtcaaatattggctgacattcaatgagatcaatatgatccttcatgcaccattcatgggcgcagggctgtattttgaaaaaggagaaaatgaagaacaaatcaaatatcaagcggcacatcatgagttggttgcaagtgccatcgcaacgaagattgctcatgaagtagatccggagaacaaagtaggctgtatgctggcagcaggagcatattatccatacacttgcaatcctgaagatgtttgggcttctagaaaatcagatcgagaaaattatttcttcattgatgtccagtcacgaggagaatatcccgcttatgcattgaaagaaatggagcgaaatggcattcagatcgaaatggaaccaggggatgccgcattgctgaaagaacatactgttgattttatctctttttcttattatgcttcccgagtttcgactaccgacaacgaactcttggaacagactgcaggaaatatctttgcttctgtcaaaaatccatatctgcaagcaagtgaatgggggtggcaaattgatccattaggcttgagaataacgatgaatgatatttatgatcgttatcaaaaaccattgtttattgtagaaaacggcttaggtgcagtcgatacgccagatgaaaatggttatgtggaagatgattaccgaatcgattacctggcagcgcatatccaggcgatgaaggatgcagtagaactagacggagtcgatctattaggctatacgacttggggatgtattgatttagtatcagctggtaccggtgagatgaagaaaaggtacggattcatttatgtcgatcgtgataaccaaggaaatggcacattagcccgttcaaagaaaaaatcattcaactggtataaaaaagtaattgattcaaatggagaaatactttcgaacgattga

SEQ ID NO: 1144 - DNA (genomic), 2043 bp, Enterococcus faecium; double-stranded, circular
  misc_feature (B) LOCATION 1...2043
  hypothetical: NO
  anti-sense: NO
atgctgtataaactagccgttaaaagtttttttcggcagtcacgaggctatcttgtttattttttcagtttgactttatccgtaatgatctattattccttcagcgcaatgacctacgatcaatctttagtcagaagagcaagtcaagatacttcgatagatggtggattgagttttggtggatttatcattactgttgttttgctttttttcgtattcagtgccaaccgatttttcttgaatagaaggcaaaaggaaataggcatctatcagctttttggtatgaataaactgcagatatcaggtatatatgtgttagaaatcatgataattggattgttcgcctgtatttctgggatattactcggtattattttttccaaactcttttcaatgattttggttcgaatgatggatatggatcttactagtccattttttatctccattccatcagtagtagatactttatttgcttttttcatcatccttttagcagtatctgtatattcaatatggaaaatatggcgctatccaatgattcgaagttttggagaaaaagaacaagcagatagttcaacaatgcgcttcaggacaaggcaccgattactcgcagtcatcgggttactacttttaacgagcggatattttggagctagtcattttagggaaatcacttcatggatgatcagttatcattatcttgatacattagttttcttttttccttttttaatttttttcgtttgtgtggtcggtacttatttgtttttctgttatacatttcggttatttttgatcatattgagtaaatggaagatttattactatggtatcaattttttgataatgggtaacacgcaagttcatttgctcaaaagttggcgtacaaattctctgattacagtcattctcggaatttctttaatgacaattggcggcacggctagtatctctactattttatcctaccaggagaaagtttcctccccgatggactatcagtttgatgttgagacagagaaaaaaatcaagccgattctagcagaggaagggcagaagataactaaagaaatcaccttgcattataaagtcattgggagtatctatagtcaaaatctcgaagaacctatgtttcaaactgctaatctgatcacggaaacacaatatcaagccttcagaaaagttaatccagatttgccgaacatttctttgaaatcacctggtcatactgttttgcttgatcaaatgcaaactctttttcggaatatttcattatatggatctagtattggactgccagataatcaagaattgaagattcaacaaatgcttccaagtgtattaggtgacgaaacaatggtatatctaagtcctgtactgattgtagatgataccgtttttgaaaaagcaaaaggtgtggattatcaagtagtcaatgtagatgtatcaggtggaaataatgaaaaaatagatgaacgactgagcaatgacctgtcgataaagtggctcaatgctgtttattattcttatgatatcgtaaatggaagtctacaaggagaaattagcacaaagaaacttccggatgaccaaatgaaggaagcacaatttagccaagaaagctctcgtttgaatttctcttccagctattcgaaattgcgtgcagttaatcggcgaatcggtatcaatatttttgtcacactatttgtcgggatgatcgtgattattgctactggtagtattttgacagtccggcaattagcagaagcagaggaagaaaaagaaaattatcacctattgactaagctggggattccacaaagaaggatcagacggatgatcttcgagcaaaacgcacttaccttctttccacccatgatattagggatcactcacgcagtatttgcaatcaatgtcttcactcagtatataaaaactgccgattactggttggcttatcttgtgagtggcttattgatccttatctatcttttgctttatgtcattacgagtcagttatattgtcggattatcgaggaatga

SEQ ID NO: 1145 - DNA (genomic), 876 bp, Enterococcus faecium; double-stranded, circular
  misc_feature (B) LOCATION 1...876
  hypothetical: NO
  anti-sense: NO
cagatgtataatcaaaaaagtttcaagggaaatccggtatatggggatttatatcttgtaccgacgccaattggaaatttagaagatatgagctacagaagtgttcgtatgctgcaagaatccgatcttatcgcaagtgaggatacgcgtaatacacaaaagttattgaatcattttgaaatccatacaccccaaaaaagtttacatgaacataattataaagaacgtgtccctcgattgattgctttgttaaaagaaggaaaaacgattgctcaagtcagtgacgcaggaatgccttccatcagcgatcctggacatgagctagttttagcctgcataaaagaagggatttctgtgatctctatcccaggacctacagctgggatgacggctttgattgcttcagggctagtgcctcaaccatttttattttatggcttccttccacgtaagaaaaaagaacagaaagaaacattgaaaaagctaaaagaacagacagctacgctgattttttatgagtcaccttatcggatcactgctacattgacaaatttcttagaaatttttggaaatcgccaagtcgttttgtgtcgagaattgacaaaagtccatgaagaataccttagaggaagtacggaagagctactcgcttatatcgaagaacatccagtaaagggtgaatgttgtctgcttgtagaagggaatttgtttgaaacgccagtgacggaagttgatgaagagttgggaacgttaaaggaacaagtagaagcaaagatcgcttcaggcgaaaaaccaaatgctgctatcaaagcagtagcgctgaaaaatgggctgaaaaaacaagaagtctaccgtcagtaccatgaattagactga

SEQ ID NO: 1146 - DNA (genomic), 474 bp, Enterococcus faecium; double-stranded, circular
  misc_feature (B) LOCATION 1...474
  hypothetical: NO
  anti-sense: NO
aaggagtataaggatgtgaaagggttaaaattgaagcttttgcagttagtaactgtcagtttgctatttggaccatatttccagtcagtctatcatatgacgaccctggatgtagctgctgagtcaacagaaacaaaggaggatgaggtattcttagatgaggactatgcaaaaattgaagggaagtatattgaaaaagaagaaacccttgaatggcatctggcttttgaaaaaaaggaaagtgccaatgaaggtagaatacgtttagcaatcgatgcggcagccgccgggattggtaccgtaaaaaacgttcgtggaacaggtctatcctcctatgatgaagatggagaagacctaaaagtcgagacgatcgatggtcaagaatggtatgtcggaaaagtttattcaaaagaagcagaaaccggcacattgatttttgaaacagaaaagatccccgatgtgaacgaagggtaa

SEQ ID NO: 1147 - DNA (genomic), 183 bp, Enterococcus faecium; double-stranded, circular
  misc_feature (B) LOCATION 1...183
  hypothetical: NO
  anti-sense: NO
cagattcataacgttcggcaaagcttgttaaggaaatcaattcatgcgggtgattcaataaatactgtgtcatgtcaactagacgttcactgcgacgtactttcacctattccaactccttttaagaaattttatcgttttacattatataagtttttcttcaaaaattcgagcattttatga

SEQ ID NO: 1148 - DNA (genomic), 267 bp, Enterococcus faecium; double-stranded, circular
  misc_feature (B) LOCATION 1...267
  hypothetical: NO
  anti-sense: NO
tgcagccataaattatacgcgctcatccccaagaccatcaaaaaacacatcattgttgtaaaaattattccttcttttttatttgtaggcaatctgtaccactcctttaaatttgtcacgaaaatcatcgtagcacatttaaaaatttctcgtaagtactttttttattttctgcccttttatttcataaacttcatcagccgtacgctcgacaaagtaagaatcatgagaagtaaacaaaatcgttcccggatatatttgcattag

SEQ ID NO: 1149 - DNA (genomic), 477 bp, Enterococcus faecium; double-stranded, circular
  misc_feature (B) LOCATION 1...477
  hypothetical: NO
  anti-sense: NO
tgtcaacataataattcacgagtaatcgacagccgtcaagcagatgatggacgtgcgatccgtcgccgtcgcgaatgtgagaattgttcgttccgattcactacatttgaacgaattgaagctgctccgttattagtaatcaagaaaaacggggaacgcgaagagttcaatcgcgataaaattttaagaggactcatccgttcagcagaaaaaagacctgtagctatggaacaaatggaacaaatcgtcaaccatgtcgaaaaccgcgtacgcagtctcggagaaaacgaagtatcgacgaatctaattggtgaatatgtgatggaagatttagttgatttagacgaaatcgcttatattcgttttgcaagtgtttatcgccagttcaaagatatgtctgttttcttaaaagagttgcaagatatcgtggataaagcaaaagaaaataataaagagaataataaagaaaacaattaa

SEQ ID NO: 1150 - DNA (genomic), 252 bp, Enterococcus faecium; double-stranded, circular
  misc_feature (B) LOCATION 1...252
  hypothetical: NO
  anti-sense: NO
gcgatgcataaggaaaattgcagtgatgttaccaagagcattacccaaaatgttgatgatcgcacctgtcagtggtccaaagctcaaaccgcaatgactccaactactgaagtaggaatacctggaacagcacacatcaccgctgtcaatacgatcaagagtatcgatgcaaaagtcccatgcgaacgaatatgtgcgagtagctctgccttactcgctctcggatttaaaaataattggatgtctgtctga

SEQ ID NO: 1151 - DNA (genomic), 828 bp, Enterococcus faecium; double-stranded, circular
  misc_feature (B) LOCATION 1...828
  hypothetical: NO
  anti-sense: NO
aataagcataagggagagaaaatgatggaatttagtatggatatgtttcgtttagatggaaaagtagcattagtcaccggtgctgtctatggtattggatttgagattgcacgctctttagctacagcaggagcaaaaatcgtatttaataacttgaatcaagaatcagttgatgaaggtatagcgcattataaagaagcaggcatcgatgcaaaaggttatgtctgcgatgtgaccgatgaagaagcggttcaagcgatggttcaacagatcaaagaagatgtaggttcagttgatattctagtcaacaatgcagggatcatcaaacggacaccgattatcgaaatggatgcggcagacttccgccaagtaatcgacgtggatttaaatgccccattcatcgtttcaaaagcagttattccggatatgatcgaaaaaggcggcggtaaaatcatcaatatctgctccatgatgagtgaattaggacgcgaaacggtcagtgcttatgctgcggcaaaaggcggattaaaaatgctgacgaaaaacatcgcttctgaatacggtcaatacaatatccaatgtaatggaattggaccaggttatattgctacaccgcaaactgctccattacgcgaaacacaagaaaacggtgaacgtcatccattcgatcaatttatcgttggacgtacgccagcagcacgctggggcgagccaatcgatttggctggaccatctgtcttcttggcttctagcgcatctgatttcgttaacggccatgtcttgtatgtggacggaggcatacttgcctatatcggaaaacaaccttaa

SEQ ID NO: 1152 - DNA (genomic), 252 bp, Enterococcus faecium; double-stranded, circular
  misc_feature (B) LOCATION 1...252
  hypothetical: NO
  anti-sense: NO
attcttaataaagaccgtctaagcatttttcttgtattgtgtcgagtagttcgtataatgaaaagaaaaaagcaggtgatccccatgtatgtcgttaaagtaatgcacggttacatcgataaaactggctgtcgcactcgggaaaaaaacttagacaatctgctcattttcaaagacaaaaaagaatccgaagcttttgctaaaagaatcggcggtcgtgtcaaaccgatacaagaggtacgaccagattga

SEQ ID NO: 1153 - DNA (genomic), 1149 bp, Enterococcus faecium; double-stranded, circular
  misc_feature (B) LOCATION 1...1149
  hypothetical: NO
  anti-sense: NO
atagttaataaaactaaaaaagaaagtgtggaacgtattatggtagaaatggctctgaaaaacgtatataaaaaatatgacaatgcagaaaattattctgtaactgattttaatctatcaatcaaagaccgtgaatttatcgtttttgttggtccttccggttgtggaaagtcaactactttgcgaatgatcgcgggactggaagatatctctgaaggagaactaaatatcggcggaaaagtcatgaatgacgtggcacctaaagaccgtgatattgccatggttttccaaaactacgcattgtatcctcatatgactgtttttgataatatggcttttggcttgaaattacgtaaatatgataaagcagacatcaaaaaacgtgtggacaatgcagcagagatcttaggtctgacagaatacttgaaacgaaaaccagctgctttatctggtggacaacgccaacgtgtggcattgggacgggcaatcgttcgggatgcaaaagtcttcttaatggatgagccattatcaaatttagatgctaaattacgtgtagccatgcgtgctgagattgccaaacttcaccagcgtcttgaaacaacgaccatctatgttactcacgatcagacagaagcaatgactatggctgaccgaatcgttatcatgaaagacggatttatccaacaaatcggtacaccgaaagaagtttatgatacacccgtcaatatgttcgttgccggctttattggatctcctgccatgaacttctttaatgtgacattgaaaaatggtgttatcacagatggacatgggcttaagcttcgtattcctgaaggaaaaaacaaagtattagttgaaaaaggttatgaaggaaaagaagttatcttcggtattcgtccagaagacatccacagtgaacaagtagcccttgaagcttcacctgaagccgtagtgaaatcagaagttgtcgtttccgaattacttggagctgaaacgatgctttacacaaaaactggttctactgagttcatctcaaaagtagatgcaagagatttccataaaccaggcgaaatagtcgaccttgccttcaacatcagcaaaggccacttctttgataaagaaacagaacaagtcatcaaacttccataa

SEQ ID NO: 1154 - DNA (genomic), 444 bp, Enterococcus faecium; double-stranded, circular
  misc_feature (B) LOCATION 1...444
  hypothetical: NO
  anti-sense: NO
aaagttaataagtcttggttttctatgagtgactgcgtcactttgaactatcacaaacttatgcagggaagatatgcgaaatttgatcagttgaatcgcggtctattgatcgctgcgcttgtctttagtttgctaagtcgttggttgccctatagaatcggacaattgttgttcatcgtctttttcggatggatgatatttcgtttcctatcaaaaaaaatctaccccagactaaatgagaatcaacgttatttgaaatatcttgatagagtcaaagaaaaatatcatcagataaaaaacaaaaagcaagtcaaaatggatcgaaaaagttatactttttttgagtgcccgaattgtcatcaaaagcagcgtgcacctaaaggaaaaggacgaatacgtgtgacatgcaaaacatgtggtataaaattcgaaacgaatgtttaa

SEQ ID NO: 1155 - DNA (genomic), 1848 bp, Enterococcus faecium; double-stranded, circular
  misc_feature (B) LOCATION 1...1848
  hypothetical: NO
  anti-sense: NO
ttttctaataaattattcatgtggaaatgtcatttttactgtataattcatttgattatccattttttattcatcaaaattactgaaaaaagaaaggaagaaataaatttgaagaaaacaaattcttcaggaaaaccgaaacgcgacttcactaaattatcgacaccccatacgtatgtcattatttttggtgtagtcatctttgcatggatactgacttttgtcgttccagcaggaaagttcagcacgcaagatattgaatacaaagatgcaaatggcgaaacaagtactcgtactgttttacgtcaagattccttccgttatgcttacgagctggataagtcgtatgtgtttgatcaattagaagaactgcaagatcatccagcagaacgtgaaaaactggatgttccggaaaaaggattggaaaaagtcattgctgacggagaaaaaaatcttacgcaggaaaaactagatgaaatctccttgacagatgatgtgctttacgatcagtacggcgaaaatatctatgatacttctaaaaaattgcataaaacagccaaaatatggggaacagatgattttggcggctttggtttcttaaattttgtttttgaaggactagtatctggagataagtatggatctgctgtagggatcgctgcattgatccttgttgttggaggtgcttttggtattattatgcgtaccggagcgatcgacgcaggtatctatgcgtttatcagtaaaactaagggactggagcgtttagctttaccgctattattctttgctttttcattcggtggcgctacattcgggatggcagaagaggtaattccattctcaatggtgatggttccatttgtcattgcgttaggatatgactcgatcgtagcagtaaccgtgacttatgtcgcatctcaagtcggaaatgcgacctcttggatgagcccgtttagcgtagcggtggctcaagggattgctggaatccccgtgttgtctggtgcgacattccgattgattatgtgggtagttgttactgcattagccgctggttatatgatgatatatgcagaaaaaatccgtaaaaaaccagaaagttcgttgacttacaaatcagatgattatttccgttctcatatcaaaaagacatctgatgaaaataaaaaattcatgcttgggcataaattgatcttattagagatgttagttgtccttgtctggatcgtttggggcgtgactcaaaaaggctattacattccagaaatcgcttctcaattctttgtgatgggattagttgctggaatcattgctgttcttttcaaattagatggaatgaaagtcaatgacatcgcttcttctttccaatctggtgcagctgatttagctggtacagcaatcgtagtaggtatggccaaagggattcttcttgtcttgggaggatctgatgcatctgttccttcagctttgaatacgattttgcatgggatcgggacggcgttgaccggtgttccagctgtcattggtgcttgggcgatgtacatcttccaaagtttgttcaacttggttgttacatcaaattcaggacaagcagctttgactatgccaatcatggctccactggcagatttagtaggtgtatccagacaagtagcagttcttgcttatcagcttggttcaggttttatggacgcttttacacccgtatcagccagcttgattggtgtgctaggtgttgcacggatcgaatgggcaaaatgggcaagattccaaatcaagatgcaaggattcctgtttgttttaggaactattttcatcatgattgccattgcaataggtctgcagtag

SEQ ID NO: 1156 - DNA (genomic), 2922 bp, Enterococcus faecium; double-stranded, circular
  misc_feature (B) LOCATION 1...2922
  hypothetical: NO
  anti-sense: NO
gtttataataaaaaaagatgtaggagtggttcgatgaaaaaagttttagttgctaacaggggtgaaatcgctgtacgtgtatttcgtgcttgtacagaattaggaattaaaactgttggaatctatgcagaaaaaaatgaatattccgtacaccgtttcaaagcggatgaagcatatttagtaggacaaggaaaaaaaccgattgatgcgtatctagatattgaagggatcatttctatcgcgaaagaatgcggagctgacgctattcatccgggttacggtcttttgtcggaaaacttgaattttgcgcaacggtgcgaagaaaaaggcatcatttttgttggacccaaactgcatcatttagatatttttggagataaaatcaaagcaaaagctgcagctatcgaagcggggattgcttcgattccaggcacagatggaccaatcgcttctatagacgatgccttggagtttgcgaaacaatacggttatccgattatgatcaaggcagctctatgcggcggcggacgcggcatgcgtgtagctcacgatgaaaagagtgcaagagagggctacgaacgtgcgaaaagcgaagcaaaagcagcctttggtagtgatgaagtgtatgttgaaaaatacatcgctaatcctaagcatatcgaagtacagattctcggggatacgcatggaaacgtcatccatctttttgaaagagattgttctgttcagcgccgtcaccaaaaagtagtagaagtagcgccttgtgtctctatgaatgaacagcaacgtcaaaaaatctgccaggcagctgtcccattgatgaaatatgtcgggtatgtcaacgcacgtacagtagaatttcttgtcgaaggagatgatctttactttatcgaagtcaaccctcgcgtccaagtggaacatacgatcacagaaatgattacagatattgatatcgtaacaacgcaactgttgattgctcaaggtttggatctgcataaagaaatcggattgcctcagcaagaaggaattaaattaaatggttcagccattcaatgccgaatcactacagaagacccgttgaataactttttaccagacacagggaaaatcgatacgtatcgttcacctggtggttttggcgtacgtctggatgtcggaaatgcttacgcgggctatgtagtgacaccgtattttgattcattgctagtaaaagtatgtacgcatggtgctacctttgaaacagccattcagaaaatggaacgttgcttgaaagaatttagaatccgtggagtgaaaacaaacattccatttatgctcaatgtcatcacacatcctgaattccaatcaggaaatgcaaaaacaaccttcattgatagtacagcaacattatttgaatttcctcgactacgagaccgcggaaacaaaacgatgaaatatatcggtgaaattactgtgaatggttttccaggtatcgaaagtggcgaaaaaccattttatgaagaaccacgtatgcctaaagatctaatcacaagaactgattacgtaacggctaagaatgtattagatgcgaagggtgccgatgctttggtcgaatggatcaaaggacaggaaaatttgttgttgacggatacgacatttagagacgcccatcaaagtctgctagcaactcgtgttcggacaaaggatttcaagcagattgcacgtttgactggagaaggtcttcctgaactcttttcaagtgagatgtgggggggagcaacatttgatgtggcttaccgctttttgaatgaagatccttggcaacggttgagaaaaattcgttctttaatgcctaatacgttgctgcaaatgcttttcagaggttcaaatgccgttgggtattctaattatcctgacaatgtattggtggaatttgtcaaagaagcagcagcgcaaggaatcgatgtatttcgaatctttgatagtttgaactggactccacaaatggaaaaaagtatccaagctgtacgggatactggtaaaatcgcagaggcagctatttgctatactggcgatatcaacgatccaagtcgggcaaaatacaatgttcagtattataaagacatggcaaaggaactagaacaactgggtgcgcatatcattgcaatcaaagatatggctgggctgcttaaaccgcaggcagcttatcgtttgattagtgaattgaaagaaacgacagatctgccaatccatctgcatactcatgataccagcgggaatggaatcatcacttattctgctgcttcaaaagcaggagtagacatcgttgacgtggcaatgagtgcaatgagtgggaatactagtcagcctagcatgagcagcttgtattatgcactggtcaatggtccacggctgccagaaatcacgattgaaaatgcacagaaattaaaccattattgggaagatgtgcgcatgtattacaaaccgtttgaaaacggcttgaatgctcctgaaacagaagtatatatgcatgaaatgccaggaggacagtattcgaatctacagcaacaggcaaaagctgtcggattaggtcatcgctgggatgaaatcaaacaaatgtatcatactgtcaacttgatgtttggcgatatcgttaaagtaactccatcatctaaagtagttggagatatggcactatttatggtccaaaatgatcttacagaagaagatatttatgaaaaaggcgaaacactaagtttccctgaatctgttgtgactttcttccaaggagaactagggcaacccgttggcggatttcctaaaaaattgcaaaagattattcttaaaggcagacctgcattgaatgaacgtccaggtcttttggctgaatcagtcgacttcaacgaagtaaaaaaagaattggcagaaaaaattggcgtatga

SEQ ID NO: 1157 - DNA (genomic), 267 bp, Enterococcus faecium; double-stranded, circular
  misc_feature (B) LOCATION 1...267
  hypothetical: NO
  anti-sense: NO
ataaataataaatcagattctgattcagtagagtggaataaaattgaagttctgcacgaaatccagcatatagacgtatctggcggtgttgcatctgctgtgcaaagtaagttgcacggatcgtcaaatgagtcgtatcgtatgggaaaatacgggagaaaaaataaatttgcgttaataattgaacaacatattcttcgtttttttctttgcaatcagcggatgaaaacgaacagtaggacatattttttcgtatctgctcactga

SEQ ID NO: 1158 - DNA (genomic), 183 bp, Enterococcus faecium; double-stranded, circular
  misc_feature (B) LOCATION 1...183
  hypothetical: NO
  anti-sense: NO
acaagtaataattttaataattttatttttcattgttacttcctccttagatataaaatcctaggaaagcgctttctgtatatatttagaataatcagaaaattaaatattgtcaagagggtttattttataaaacgtgttattttaaaggttagtagacataatgtcgagtatgccaagtag

SEQ ID NO: 1159 - DNA (genomic), 207 bp, Enterococcus faecium; double-stranded, circular
  misc_feature (B) LOCATION 1...207
  hypothetical: NO
  anti-sense: NO
ttcatcaataagatgatgtccggattaactgccaaaacacgtgcgatacatacacgctgctgctgcgcaccggataaagataaagcacttttatgcaatttgtctttcacatcatcccaaacagacgctgccttcaggcgttcttcaactactcgatcaaagacttttttatctttttccccctttaatttcaatccatatgtctga

SEQ ID NO: 1160 - DNA (genomic), 189 bp, Enterococcus faecium; double-stranded, circular
  misc_feature (B) LOCATION 1...189
  hypothetical: NO
  anti-sense: NO
acaatcaataacataaaggtgagtttcttctacattttaaaaaatcgaatggcactgaagagttcagttgtcagcatcaatctcctactcaaaaaggcaaaaagacgtaagtcagatgttgttgacatctcacttacgcatccattgattgaaaatttcttagtaaaatttactagcctaaaaatttga

SEQ ID NO: 1161 - DNA (genomic), 189 bp, Enterococcus faecium; double-stranded, circular
  misc_feature (B) LOCATION 1...189
  hypothetical: NO
  anti-sense: NO
acaatcaataacataaaggtgagtttcttctacattttaaaaaatcgaatggcactgaagagttcagttgtcagcatcaatctcctactcaaaaaggcaaaaaaacgtaagtcagatgttgttgacatctcacttacgcatccattgattgaaaatttcttagtaaaatctactagcctaaaaatttga

SEQ ID NO: 1162 - DNA (genomic), 1296 bp, Enterococcus faecium; double-stranded, circular
  misc_feature (B) LOCATION 1...1296
  hypothetical: NO
  anti-sense: NO
ataaacaataattgtttggcattagctgaatcagaggaggaattttttatgggtcttatcaaagcagcaacaagtatggttggcggcggtctggcagatcaatggctagaagtcatcgaaccagacaatatgagtgatacaacggtcatgacaaaaggtgtcaaagtccgcaaagatgacaaacgtggctccaatcgtaaaggaacagaagatgttttaacagacggaacagtcgtccatgtctatccaaacatgatgatgcttttggtcgatggtggaaaaatcatcgattataccgctgaggaaggttattacaccattaaaaatgacgcagctccttccatgttcaacggaacactgaaagaagcaattgctgaaacttttgaccgatttaaatttggcggcgtcacaccgcagaaacaacaagttttttatatcaatctccaagaaataaagggaatcaaattcggtacaagcgcgccgttgaactactttgacaatttctataacgcagaattattcttacgggcacatggcacttattctattcatgtcgttgacccgattttattttatacaaacgcaatccctaaaaacaaaacacaagtggaaatcaatgatatcaatgagcagtatttagctgaattcctaacagcgctgcaatcagcaatcaatcagatgtctgcagatggtcaacggatttcttatgtaccatctaagagtttggaattaagcaaatacatggatactgcattggatgattcttggcgtgaattacgtgggatggagattgtttctgtggctgtagccagcatttcttacaccgatgattctgtgaaactgatcaatatgcgtaacgaaggggcgatgctaggtgatcctagcgtacgtgaaggatacgtgcaaggttccattgcacgtggtatggaagcagccggaaaaaatgaagcaggagcaatgaccggctttatgggtgtaggtatgggaatgaatgcaaatggttcttatctttctcaagcagctcaaaataaccaagaacaaatcaaacaacaagcagaaaaacaaaatcaacaaactgcacaaggaaatgcggatacttggacatgtccagtttgcgggacagaaaattccggaaaattctgttccaactgcggagctgccaaacctgtagaaaacgttcagcctaagctacaaatgcgatgcagtgaatgcaatgagatcgtggatctttccaacggcatccctaaattctgtccaaactgtggtaaaccgtttaaaggaatccccgttgattaa

SEQ ID NO: 1163 - DNA (genomic), 705 bp, Enterococcus faecium; double-stranded, circular
  misc_feature (B) LOCATION 1...705
  hypothetical: NO
  anti-sense: NO
cagacaaataatgatttttcattaattacacctagtaaaggagccgttttcatggaaaaaacgaaatttaatcgaacgtatgaaatattaaatgaagtgtttaatgcagtcacccatggaattgggactggattgagtatcgcgggactagtggttcttttagtaaaaggtgcccacttgcattcctccctccatattgtctcttatgctatctatggatcgatgatgattcttttatttttaacgtctactttgtttcattcattgatttttacaaaagcaaaaaaggtgttccaagtattcgatcatagttcgatttttcttttgattgcaggaagttatactcctttttgtttgctgagtatccgaggatggctaggttggactttatttgtattaatctggttgtttgcgattcttggcattatatataaagcgttgacgttgcataaacgggagagagtatcaaaagtatctacgatcatctatatttttatggggtggctctgtgtcgtggctgctgttcctctttatcactctcttggaatgactggtgttattttgatggtagcaggcgggctttcttacacgataggcgcattcttttatagcttgaattctatccgctatatgcatgttgtttggcatttgtttgttatgttaggtgcaggttttatgtacttctctgttttattctttacttaa

SEQ ID NO: 1164 - DNA (genomic), 195 bp, Enterococcus faecium; double-stranded, circular
  misc_feature (B) LOCATION 1...195
  hypothetical: NO
  anti-sense: NO
cttaaaaataacttttgtcacagtctcactcctaaaattactttatttacgtatgaagtgggcaggaggtcgaatccagaactgggctatggtacttcaacgaggacttctcctctagaattgaaaagcatgcgatttaccttccgtaacgacggtagatttattcaactatgtgtccaatcaaaatttgtctga

SEQ ID NO: 1165 - DNA (genomic), 426 bp, Enterococcus faecium; double-stranded, circular
  misc_feature (B) LOCATION 1...426
  hypothetical: NO
  anti-sense: NO
tttcgaaataagggagagcgaaaaatgagtagacaattggtattgattagtcacgggaaattttgtgaggaattgaaaaaaagtacagaaatgatcatgggtcctcaagaggatatctacacattacctttattaccagaagatggcactgaaacatacaaacaaaagtttctcactgtcacagattcgttaaatgattttgtggtactatgcgatcttttaggcggtacacctgcaaatatcattgctaaactaataatggaaggacaacagattactctttatgctgggatgaatcttccgatggtcattgaatttatcaactcacaaatgattggttcagagcccgagtttgttcgtgcaggatgtgaaagcattgtctctgtcaacgaattaattaatggaatagcagaagaggaagagtaa

SEQ ID NO: 1166 - DNA (genomic), 249 bp, Enterococcus faecium; double-stranded, circular
  misc_feature (B) LOCATION 1...249
  hypothetical: NO
  anti-sense: NO
gaaggaaataaaatggcacaacaaagaaaaagcggacgtaaacgtcgtaaagtagactacattgctgctaaccatattgaatatatcgattataaagatatcgaattactaaaaagatttatttcagaacgcggtaaaatcttgccacgtcgtgtaactggtacaggcgctaaaaaccaacgtaaaattactgttgcaatcaaacgcgctcgtatcatgggcttgctacctttcgttagcgaagactaa

SEQ ID NO: 1167 - DNA (genomic), 861 bp, Enterococcus faecium; double-stranded, circular
  misc_feature (B) LOCATION 1...861
  hypothetical: NO
  anti-sense: NO
gagggaaataagatgaaaatcgttattgtcggaggtgtagcaggtggaatgtctgctgctacacggcttcgccgattaatggaagatgcagaaatcgttgtttttgaaaaaggaccgtatgtttcttttgcaaattgcggcttgccttattatctttcgggagaaatcagtgaacgggaaaatcttcttgtccaaacgccagaatcattatccgctcgtttttgtttagatgtgcgtccaaatcatgaagtgacagccatctttcccgaaaacaaaacggtagaagtcgtacatgagggtcaaaaacacattgaacagtacgatgcattggttttatctcctggtgcaaaaccagttgttccatcgattccagggataacagaagccgacaatgttttttctattagaaatgtaccagatatcgataaagtgatgcatgcattagaaaaacagccaaagcgtgccgtgatcgttggtgcaggattcatcggattggaaatggcagaaaacctaaaaagaagaggtttagaagtcatggtgatcgaacaagcaccacatattcttccaacactggatgaagaaatggcagcttttatagaaaaagaattgtctcatcaaggagtagaagtgattacttctcatgctgtcgctggatttgaagaccacgggaaacgattgcgactggatgatgggcgtaccatccctgctgatttagttattttatccattggtgttcgtcctgataaccagctagcagtgaccgctggaatccaattaggcatacccgggggtatcctatataacaacgttatcaaacgaatattcctgatatntatgcggtgggggatgctatcgttgtaa

SEQ ID NO: 1168 - DNA (genomic), 1584 bp, Enterococcus faecium; double-stranded, circular
  misc_feature (B) LOCATION 1...1584
  hypothetical: NO
  anti-sense: NO
gttatgaataatccaaaattaaagcaacaagtggacaatcgcagaacttttgcgatcatttcccatccggatgctgggaaaacaacgattacagaacaattactattgtttggtggggctatccgtcaagccgggaccgtaaaaggcaaaaaaacaggtaattttgccaaatcagactggatggaaatcgagaaacaacgtgggatttctgttactagttctgttatgcagtttgattatcaagggaaacgagtaaatatcttggatacaccaggacatgaagatttttctgaagatacttatcgtactttgatggccgtggatagtgcggtcatggtaatcgatagtgcaaaagggatcgaagcacagacaaagaaattattccaagttgtaaaaaaacgtggcatcccgatatttacttttatcaacaaactagatcgtgatggtcgtgaaccattggaattgttagaagaattagaagagctattagatatcgaatcttatccgatgaattggccaatcggtatgggtaaagggctagaaggtctttatgatatctaccataatcgtgtagagttttatcgtccggaaaattatcaggatgaacgattagtagaattggatgaagatggactgcttcccgaaaatcatcctctaactgaaaattccttatatgaacaagtcttagaagaagtagaactaatcaaagaggctggagatgcatttaatcaagaaaaaattgctcgtggcgatcagacaccagtattttttggttctgcattgactaacttcggtgtacagacttttttagagactttcgttgaattggcaccagctccttatggacacaaaacacaagatgatcagatggtaagtccttatgaggaagaattttcaggtttcgtattcaagatccaagcaaatatgaatccagcccatcgtgaccgaatcgcttttgtccgaatctgttctggaacattcgaacgaggaatggatgtctggttggaacgtacaaataaaaaactgaaattaagcaatgtcacacaatttatggcagattcgagagaaaacgtcgaaaaagcagtagcaggcgatatcatcggtgtatatgatacaggcaattatcagattggggatacattgttcgaaggaaaactaaaaggtgcttatggagtactcccttcatttactccagagctgtttatgaaagtgactgcaaaaaatgtcatgaaacaaaaatccttccacaaaggaatctatcaattagttcaagaaggagcgattcagctttataaaacatatctaacggaagaatatatcattggagctgttggtcagctacaattcgaagtattccaatatcgtatgttaaatgagtataacgccgaagtaatcatgtctccaatgggacacaaaatcgctcgctggatcgatccagaagatttggatgagaagatgagttcaagtcgcaatatcttggctcgtgaccgtttcgaccaaccgttgttcttattcgagaaccaatttgcagaacgctggtttgcggataaatatcccaatgtaaaattaaaaagtttgatgtaa

SEQ ID NO: 1169 - DNA (genomic), 978 bp, Enterococcus faecium; double-stranded, circular
  misc_feature (B) LOCATION 1...978
  hypothetical: NO
  anti-sense: NO
aatatgaataaagaattaaacatcacacaagaatgggacaaagtatttccaaaaagcaatcaagtcaatcatcgaaaggtgagcttcccgaatcgttttggtatcacattagtcgctgatttatatgaaccaaaagaagtaagtgaaaagaaattgccggcaatcgctgtgagcgggccatttggtgcagtgaaggaacaatcgtctggtctatatgcgcagacgatggctgaaagaggctttttaacgattgcgtttgatccatcgtttacaggagaaagcggaggagtacctcgatatgttgcttcgcctgatatcaatacggaagatttccaagcggcagtagactttttatctgtacaaaaaaatgtaaaccctgagagaatcggaatcattggtatttgtggatggggaggtatggcattgaatgcagcagctatcgatacgcgggtcaaagcaacagttgtttccacaatgtatgacatgactcgagtaacagcaaatggctacttcgatgttatggatgaaaatgcccgatatgaaatgcgtgaagaattaaatgcacaacgcatcattgatttcaaacaaggggactacgcacgtgctggaggtgtggttgatccgttgcctgaagatgctcctcaatttgtcaaagactatcatgcgtattataaaacagaccgcggatatcatgtccgttctttaaactccaatgatggttggaataggacatcagggttgtcacttatgaatgcaaaactattgcattatattccagaaatccgtcatgcagtcttagtcattcacggggaaaaagctcattcacgttactttggggaggacgctttcaaagaactaaaaggtgacaacaaggaactcatgatcattccaggagcatcccatacagatctatacgaccagacagacatcattccatttgaaaaaatggcaacattctttgaagagaaccttgtgtaa

SEQ ID NO: 1170 - DNA (genomic), 264 bp, Enterococcus faecium; double-stranded, circular
  misc_feature (B) LOCATION 1...264
  hypothetical: NO
  anti-sense: NO
aatatgaataacgaaactatcattttaggaaaaaaatatatttgccaacctattggcttgaaacaaaaagtggttggagaagtaatcagtaaattagaaaattgtgttgtgatctgcgtagacgaatatcatgacgtcgatcgcaatgaaatattagaaaaatgcggaaaagtagtggcaaaatacactcacgtttatgagttggaaacgacagaatatctatataattacagcaataaatatgaacatactttagtttcataa

SEQ ID NO: 1171 - DNA (genomic), 1362 bp, Enterococcus faecium; double-stranded, circular
  misc_feature (B) LOCATION 1...1362
  hypothetical: NO
  anti-sense: NO
aacatgaataagtccttgcgtctcgttatcaagagaaacgaatgcgccataaggctgtatccctgtcacttttccttcaattatttgtccaattttataagtcatctacttccctctcttcgcatttatcattatactgtaaatagctcaaaaaaagaagcgacgaaaatgactggaggtcttaagatgatcgaatttgataaacagatttcaagaaaagatacagaaagtgtaaaatgggacgcaattgctgagacatatcaaatggatgacttacttcctttgtgggtagcagatatggacttcttgtctcccggtggggtagctaaagcgtttagtgaatacatcaaacatggaatctttggttatgccactctgtctgataaactatatcaggctatcattcattgggaacgccaacaccatgctgtggagttgacgaaagaaaatatcgtttttacaagtggtgtgttaaccagtttagctgcagcagtacaaacttttacaaaaccaggcgattctattttgattcatgacccagtttatcctccattttcctctattatagaaacaaatcaacgtcacatcgttcgaagctctttgctagaaaaaaataatcatttcatcatggacttgtctgacatggagaaaaaaatcgaagaaaacaatgtaaaagcaatgattttatgcaatcctcacaatcctggagggcgtgtttggagcaaagaagaattgaaacagttaagcgaattgtgtttaaaacatcaagtgattctgtttagtgacgagatccatcaagatttaactttattcgatcatacatttacttccatgctaacgattgatcctaatttagatgatctactagttgcttttacttccgcaaccaagactttcaatctagctgcaatcaaaaattcaatggtatttatcaaaaatccagagatgaaagctgattttgaaaaacatttagtgatgaaccaacagcacgaaatcaacacttttggactgattggaacccaagcggcttatgagacgggtggagaatggttaagccaactgattccttatctagaaaaaaatgttcaaacagttaatcagttttttgaacagtatcttccgaaagtgagaataatgaaccctgaaggaacttacttaatgtggttagattttaccgcctatatttcagacgaccaagaattggagaacactcttgttcggaaaggaaaagtcgtattaaatcctggcatcacgtttggtccttccggtcatgggcatatgcgcttgaatattgcttgtccagaagaaactttactggaaggacttaatcgaatcaagtatgctttagagacaatcgattaa

SEQ ID NO: 1172 - DNA (genomic), 678 bp, Enterococcus faecium; double-stranded, circular
  misc_feature (B) LOCATION 1...678
  hypothetical: NO
  anti-sense: NO
ataatgaataatagaatacctatttttgaatatcggaaaaaagcacgagtttctttggtaaatcaatggggaatcaatacttggcttgttttcttatctataatattgacgagcgtcatccagaacttttttgacggtttcagtccttttccggaagaaagcatgcagcagcacttattgagttttctagtcgataatttacttttattcgcattcaactatgcattgttttacattgcgctagtagttgtacggggtggcagaccaaaaagtaaccttttattttcagttttccaaagaaagtattttggttcgatacttggcatcaatttgatcaattcagtcatcaactggctactcaacagtttaatctttctgcccatgtttttaatcagcggagtgagtacttatatgcagctgcttttcagttcaaatgcggtacctacgggtgtcatgccagaagattttcttgatatcagctttgttttatcgatgatagggatgatttttgtttcagcactcatcatgagtattgttggcggtttattccaatttgctgcatggacaaagttcgactatcctgatttgtcggttattcaatgtttgaaatatggctggtttttattaaaagatagaattggtacgtatattttgttgcagctgtcttttatcggctga

SEQ ID NO: 1173 - DNA (genomic), 354 bp, Enterococcus faecium; double-stranded, circular
  misc_feature (B) LOCATION 1...354
  hypothetical: NO
  anti-sense: NO
atggcgaataatcgtagactcgaagaaacattcaacgatggttggttaaagattttgacgcaaactaccaaaagaaatgaactaggaaaaaagattggtgtagaagatacagaaatcacttctttaaaatttagaaatctttccatgagagatagtgatataacagctatggatgcgatgggatcgaaattaactaagaaagtaaagactccatttcatccaatcgccaagaaatttaataaagatcaatattttatcgtaatcgatagtatgcgttacaacgttatctatgccgattacgataatttttatatctatttttatcttgaaagtgtgggtgaatatggtgattga

SEQ ID NO: 1174 - DNA (genomic), 717 bp, Enterococcus faecium; double-stranded, circular
  misc_feature (B) LOCATION 1...717
  hypothetical: NO
  anti-sense: NO
gaggagaataaaatgacagaaactacactttatatcgtacgacacggaaaaacgatgttcaatacaattgaacgagtacaaggctggtgtgatacacccctcacaaagcaaggacaagaaggcattcattatttaggtcgcgggttaaaaaatgtcgacttttcatttgcttattctagtgacagtggtcgtgcaatcgaaactgcccgtattattctaggagaacattctaagggaaaagaaattccttattttattgaaaaaaggattagagaatggtgtttcgggtctcttgaaggtggatatgacatggaaatgtggggtgtgatccctcgtgtattgaattttaaaacatatgatgaaatgtttaccacagaagtttcttttgaacaaattgctaatgctgtatacaacttagataccgctgggtgggcggaaacttatgaaacattgcgagaccgtgtatggacaggatttgaagatatcgcccatcactgcgaaaaaaatggtggtggaaatgttttagtcgtatctcatggtttgacgatcgcctttttgcttaatctgatcgatcctaaacagcctgttcgtgctgggcttttaaatggcagcgtaacaaaggtcacttatgcaaacggtcgattttctatccacggcatcaatgatacgtcttatatcgataacgggaaaacacatagtcgcgactcgtttctataa

SEQ ID NO: 1175 - DNA (genomic), 366 bp, Enterococcus faecium; double-stranded, circular
  misc_feature (B) LOCATION 1...366
  hypothetical: NO
  anti-sense: NO
aagaggaataaaacttttctttggcaaaacaaactccttgctatgagacgcgtttcatacactatactcaaagtatcaaaaggagggcttgcaatgaatacttatgtagagataacagatggcacaacgaacaattatttttatgcgtttgtcgagttcaagggatccgtattaacgttgtacagttttcaagggttgaataggaatatagtaaaagaaataccaatgaatgaaatcgaaaatttgacaaaagatatatattggggcgggcagcggatcagtttttcgcatgaaggaaaaatgtatcagttttttgaatgcggtccagctgtggtagactatttacaagaaaatctttttgtatag

SEQ ID NO: 1176 - DNA (genomic), 618 bp, Enterococcus faecium; double-stranded, circular
  misc_feature (B) LOCATION 1...618
  hypothetical: NO
  anti-sense: NO
aagggtgataatatgaaactaaccgttcaagaaatccaagaatggctcacgcaatttgcagaggcaatcaatcagaacaaacaatatctcagtgatctagataccccgattggcgatggagaccatggaaataacatgggaagaggggtttcagcttatgaagaagcttttcaagccgatcatcctgaaacaatcagcgatacattcaaagtattctctatggcgatgatatcgaaagtcggtggggcttctggtccgttatacggatctgcattcatgaacatgatgaaagcgacaaaagaggtcgattctattgattctcaagaaaaattaggcgaagtgatcgagcagggaacagcgggtattcaaagccgaggaaaggcagaagctgacgataaaacgatgttagatgtttggctgccagtcacagaggcattgaaggcagggaatttaacaaaagaaatcattgaccaggcaaaagaacacaccaaagtcttggtagctaaaaaaggacgagcttcctatctaggagagcgtgcaatcggacatatcgacccaggagctgcttctagtgccattttattttcaacgcttttagatgtgatcaatcaaccttaa

SEQ ID NO: 1177 - DNA (genomic), 2292 bp, Enterococcus faecium; double-stranded, circular
  misc_feature (B) LOCATION 1...2292
  hypothetical: NO
  anti-sense: NO
atgatcgataatttaataactatttacgataaaaatgacgcgaataatttagctgaacatttatatgatacgcaaggtttaggcgctttgtcagactggttaacagctactgttagcaataaactaaacggagccgagatatttcagggtacttattcaataaacggaactaatgcagatttgattgtagacggacgtattattcagtgttatgtagatgaaaatcgagcaaaacagcgtctacggatttattatgcaaaaacttctgtaataggcaatacgatagaagtaaaagctgaacctattttcaatgatataagaaaatcggtgttgaataaatatgacagcggaacagaaaagatcactgctactcaggcatggcaaaacgcaaaagttttagcgaaaccagctatcccttcgcagttttctttctcgtcattagtagatacgcttgctaatgtgaagatagaaaaggcgaattttttagaattctttggtggaaaagagggatctattctagatcgatttcatggtgagtttctaaaagataataacacattacgtcatgaaaaaagtctaggtacggatcataaaatcaaagcgatttatactaaaaacttaactggtcttgacttagagattgatgctcaaagtgttttagttggagtttatccattcattagcagctcttcagaaggagaagacgagatcactctaccagaagaagttattttcacggattacgtggatgattatcctgctggatatgtttcttttgttgattttaaagacaaagcgactgatgtagccacattaagggaagctgctaaagactggttgaaaacaaacatagataaacaaaaaccacaagtgagtggttcgattgaattagtaccattgaggcatcaaagaggctatgaaaaatttgttgatctagaaaaagtttcgatgggtgacggagtagatgtgtatcatccacagttaaaagtgaatatgtcagcgagaattgtggaatatacgtttaatgttctaaccaattcatacgataaattagttgtaggaaacgtcaaaacaaacttcttagaaaacacagagaataatgtcagcaatttgattaatgatgccattgatcaattgaaaaacggtggcgaaatcagtgatttactcaatgatattgtagatcatcaaactgatatgattactggtcaaaatggtggttatgttttattagatcctaaagaagcgcctagtcgtattttgattatggacacaccagataagaataccgcaaggaatgttttacaaatcaacaatgctggtattggtttttctaaaactggcattaatggaacatatgaaacggcatggacgttagatggcggattcaatgcctcgtttattacggctggtgaaatagtaggaattactattagaggtactacattaattagtgatggtgctgattatagaacaagtattgctaatggcaaaatgacttggtactcaaaaaaagttaacaaagatattatggagctagaagcacgtgattatgtaagtgctgatgccggtattgtatcatacaccatgaaaactggtggtggtttcatgattagaaatccacagggtaacttggtttttagtacgtgggataatggtaataacagaccgtttctatcttttggtgcgcccaatttcaggtatagcaatgctagttatgtaacttctggcgacggtagttctttaagcattaatggtagtgcgggtaactcatgggaatttaaggtagctggtaggactatgaaatttactagtgatggtatgctaacgttaccaggttgtttttttggttcatgggaagatgggaaacttgctaggtttgaacaatcaacggtacaagtatataaagattttactgttagaggtactaaaaactcaactgtaccaacagaacattatggacaacgactattgaacgcttatgaaactccagaatattatttcgctgattatggggaagccgttacaggtgacaatggtaaagttcgtgttgatattgaccccatgtttgctgaaacagtaaatctaagtcggtatatgacacatgtgacacctacagaactagttttgtgtgctgttactcatgaagatattgaccatttcatcattgaaactagtaagccaaacgtattagttagatggaatttagtggcacaccgtctagggtatgaagatattagattaaaagaggatacagcatatgatagcacagtgcttgaccaaaaacgtttttaa

SEQ ID NO: 1178 - DNA (genomic), 345 bp, Enterococcus faecium; double-stranded, circular
  misc_feature (B) LOCATION 1...345
  hypothetical: NO
  anti-sense: NO
gttctagataaaaatttgctttgttttttatacagaaagaagcttagaaaatacaattttttagttaatgtatttttaagcttcttttatcttattagtcatttatttcttttgaatactcgaaggaaccgaggcaatttatttattatctccggctctttttcatttttacgttcaaacaaatattctaccaatgtagtcaaatgcctaaaaatcgaatctgccgagaaaaataaaatactcaacaacaaaagcgatacagctgagataccggtgattgaaaacagtttatgcaaaaaaacgaccgaaaaaaagataccgctagcacagaaaagaatgatctga

SEQ ID NO: 1179 - DNA (genomic), 315 bp, Enterococcus faecium; double-stranded, circular
  misc_feature (B) LOCATION 1...315
  hypothetical: NO
  anti-sense: NO
ttttcagataaaaaggaatatttctatgagataacgaaaatggcctgtataataaagaagaggcctagaagaacatcatacaataagatagctttcaaaatactcattgaaagaaggaaatactataacgtaagaaaggagatgaataaaatgaaaaacctgattgctggcggctttttgtttgtgggtggtggcatacttatgaatacagataactttgggaatgtcatcccttttcttggtgcagcttgtgctttgattggtgtaggaatgctgatttatttcgtatttagcgatgatgggaagtatggttga

SEQ ID NO: 1180 - DNA (genomic), 195 bp, Enterococcus faecium; double-stranded, circular
  misc_feature (B) LOCATION 1...195
  hypothetical: NO
  anti-sense: NO
gacgcagataacaatcttgcaaataaagatgtagatgtactgttattaggacctcaagttcgctttatgaaagctgattttgaaaaacgtctggaaccaaaaggcattcctttagacgtcatcaatatggctgattatggtatgatgaatggcgaaaaagtgttagatcaagcaatcacgctcataggtgaataa

SEQ ID NO: 1181 - DNA (genomic), 426 bp, Enterococcus faecium; double-stranded, circular
  misc_feature (B) LOCATION 1...426
  hypothetical: NO
  anti-sense: NO
aaaaaagataaagagggcgaaaaaatgaagaagaacgagctgtttcgtgattgggaatttcgttatcgctatatttaccgtaagcgccgtacaaaaaagagtaaacagcgttttctttcagcattagtatcagatatttacagtatgagaacagatgtgacagtcattgcttacgatacgctagcctaccgatcaaaaaatatttatgttggagatatcgaaaaagcagagaaagttatctgtacttattacgatacacccgttcatgcattaggaagttatttcatgtttgattggaaagaccaaaggaaaaaaacaatctactctatattattgtccttcattttgttgttcagtttaggttggtggggaatgatgatatataacaaaaatcctcatcacgtattcgatctgctatccgtataa

SEQ ID NO: 1182 - DNA (genomic), 450 bp, Enterococcus faecium; double-stranded, circular
  misc_feature (B) LOCATION 1...450
  hypothetical: NO
  anti-sense: NO
cctatggataacagccgaaaaattgaggcagattatgtccagcttgatgagcttctaaaaaacagcgatattgttacgctccatgtgccgctttgtgcggatacccgccatctgatcggccagaggcaaatcggagagatgaagcaaggcgcatttttaatcaacactgggcgcggggcgcttgtcgataccgggtcgctggtggaggcactgggaagcggaaagctgggcggtgcggcactggatgtgttggagggcgaggatcagtttgtttataccgactgctcgcagaaagtgcttgaccatccctttttgtcgcagctcctaaggatgccaaatgtgatcatcacaccccatacggcgtactacaccgagcgtgtgctgcgagataccacagaaaaaacaatcaggaattgtcttaactttgaaaggagtttacagcatgaataa

SEQ ID NO: 1183 - DNA (genomic), 789 bp, Enterococcus faecium; double-stranded, circular
  misc_feature (B) LOCATION 1...789
  hypothetical: NO
  anti-sense: NO
atcgtggataagacagcacatgatgtcgttcagttagcaagagctaaagaacgatggacaagcttggatttttttgaagagatcttcgattctttcgaggaatgccatggtgatcgtttatttgcagatgacgaagcgattgttggtggaatcgctcgattagatggcaaaccggtaacagtgatcggtattcaaaaaggacgggatctgcaggaaaatatccgcagaaattttggttctccccatcctgaaggctatcgaaaagctttacgactgatgaaacaagcggaaaagttcaatagaccggtgattaccttgatcaatacagcaggtgcatattgcggtgtaggagcagaagagcgcggcgaaggagaggctattgccagaaatctgctcgaaatgtctgatttaaaggtaccgatcatcgccatcatcattggtgaaggtggaagtggcggtgcccttgctctaggtttagcggatgaagtctggatgctggaagaaacgatttatgctgtgctttctccagaaggatttgcgtcgattttgtggaaagacggtagtcgcgccgcagaagcagctgagttgatgaaaattactgcgccagaactacgcgagttaggaatcgttgatcgagttattcctgaaacgttcaacggcgagcagttgccacgatataaagtcgcacacattatgaaaaaagcgttgattgaaagattgacggaacttgttcgattagatcagcataaattactggaaaaacgatacaagaggttccgccaatattag

SEQ ID NO: 1184 - DNA (genomic), 204 bp, Enterococcus faecium; double-stranded, circular
  misc_feature (B) LOCATION 1...204
  hypothetical: NO
  anti-sense: NO
tttttttgtaataaaggaacaaaaaaagataatagcatcattattcctcctaaaggaatcattattaaccatccaattataggaatccaaaagccgaaacttagaagcattagtcctataaaaaaaagcatacaaccatttgatctaggggacgttacagaaactctgttactgccacaatttttacatgtaataatatgttga

SEQ ID NO: 1185 - DNA (genomic), 735 bp, Enterococcus faecium; double-stranded, circular
  misc_feature (B) LOCATION 1...735
  hypothetical: NO
  anti-sense: NO
cattattgtaataggaggaacaataaaatgagtgtgcatattgaagcgaaagaaggcgagatcgccgataagattttacttccgggagatcctttgcgagctaaatatattgcggagacttttttggaagatccagtttgttacaatcaggtacgcggtatgttaggctttaccggcaaatataaaggagaacgtatttctgttcaaggaacaggaatgggaatgccatcagccaccatctatgcccatgaattgatccagtcgtatggtgtaaagaaattgattcgagtaggtacatgcggtgcattgtcaaaagacgtccatgttcgtgatttagtactagcacaaggtgcagcgaccagttcttcgatgatcgaaaaaaatttccaagcctttcattttcctccaatcagtgatttcaatctattactgaaagcatatgagatagctaaagaaaagggctatacggttcatgtaggaaatgttctttcggaagattctttctacaaagatgatttgacagagacgttccaattagctgaacttggcgttttaggagtggaaatggaagcagcggctctttattacttaggcgcgaaataccatgtgcagacattaagtttgatgaccgttagcgaccatttgatcaccggtgaagaaacaacagctgcagaacgtcaatctacgttcaatgaaatgatcgaagtaggattggaaacagcgatagcagaataa

SEQ ID NO: 1186 - DNA (genomic), 1179 bp, Enterococcus faecium; double-stranded, circular
  misc_feature (B) LOCATION 1...1179
  hypothetical: NO
  anti-sense: NO
gaggactgtaagatgcgttatatgactgcgggagaatcccatggaccagaattaacagccattattgaaggactaccagcaggattacctctgtcagaagaagaaatcaatcacgaactcgctcgcagacaagctggttacggcagaggaggaaggatgaagatcgaaaaagatcgtgttcggatcacgtctggcatccgtcacggcaaaacaattggttcacctgtcactttagtggtagaaaataaagattggaaaaattggacaactgtcatgtctgtagcagaagtgcctgaaaaagaccaatcactgcggcgagttgcacgtccgcgtccaggacacgcggatttggtaggcggtatgaaataccatcatcgagatcttcggaatgtgcttgaacggtcctctgcaagagagacgaccatgcgtgtagcaatcggcgcaattgccaagaaaattctggaagaacttgacatcatcgtagcaggacacgtgatttgtcttggtggaatccaagcagaaatacctggaaatatctcgattcaagaaatcaaagaaatttctgaagcgtcagaagtacgagttgttgatccagcagttgagcaaagaataaaagatttgatcgatcagacaaagaaaaatggagatacgatcggaggaattgtagaagtgctcgttggaggcgttccagctggattaggaagctacgtacaatgggacacgaagctagatgccaaaatcgcacaagctgtggttagtatcaatgcctttaaaggcgtagaatttggggtcggattcacttctggttcattaccaggctcagaagtgatggatgagatcctatgggaagaagaaagaggctatttccgacgtaccaataatctaggcggcttcgaaggcggaatgaccaatggcgaaccacttgtcattcgcggggtcatgaaacccattcctacattgtacaagccacttcaaagtgttgatatcgatacaaaagaaccttacaaagcaagtgtagaacgttcggatagtacagcagttcctgcagctagcgtcgttgcggaaaatgttgtagccactgtggtagcgacagagctattgtcaaaattcccaagtgattcgcttgttgagttgaaagctgcagtgaaggagtaccgtgactacttgaaacattactaa

SEQ ID NO: 1187 - DNA (genomic), 921 bp, Enterococcus faecium; double-stranded, circular
  misc_feature (B) LOCATION 1...921
  hypothetical: NO
  anti-sense: NO
aaaatatgtaatgaggaaggaccctgtcgaatgaaaagtatgactggttttggcaaagccatccgcgaaacaaaagcgtatcagttagatattgaaataaaaagtgtcaaccagcgttttctagatgttcaaatacgaagtcctaaaatcctgaactttgttgaaaacgattttcgtcagcttattaaacagcagttaagccgcggtcgaatcgaagtatttgtgaatctagcttatattggcaaaaacgaaaaacagatcgtcatcaactgggaattgattgattcacttatcactcaattgacagacggaattcaacaacgatacggtagtcaaaatcaagtgtcaattagtcggatggcggaacgcttcgcgctggacgaaaacttcgtaacggtagaagaaaaaccggaagagagcatggaagaattggcacagttagctctagatacattgaaaagcgcacttgattctattgaggcgagtcgagaaaaagaaggtcaagctttagctttagtgttgaaaaagaatactgaagaattcaaagaagtactaaaaaaactcgatagttttgtagaaatctatgaaaaggaatttcaaataaggtatcaaaaaaagctggaggaatttcttggagcgaaagtcgatgagcaacggttgttgacggagctagccatcttgttggaacgcggagatattcacgaggaactggatcgtctggcgatccatgtacaaaaactagatgaacttatcgaagcacaatgtcctgtaggtcgggaattagatttcctgatccaagaaatgaatcgggaaatcaacacgatcggttccaaatcaaatgcaatcgaaattaaaaatcaagtcgtccagtctaagacgatcttagaaaaaatcagagaacaagtacaaaatattgaatga

SEQ ID NO: 1188 - DNA (genomic), 690 bp, Enterococcus faecium; double-stranded, circular
  misc_feature (B) LOCATION 1...690
  hypothetical: NO
  anti-sense: NO
attaaatgtaaaatgagagcaattagttttaaaaaagattataggctgttaatcttagcatatataatccattggaaagggggagatccaatgaatctaaagaatacaaactcaaacaaatctacactatatgtaatttcagatgattatataaataagctgaaaaaggtggactatcgtgtccaaaacaactatcgagaacaacgattatattttaaatcaaacttgaaaatttctaacaaaaatgaagaaataaattattatgtaccattggcttcagcaaaagaaaatcaacgttctttgactaataaatcagtgtttaagatttatggtgatcgagaagaaaaggactttttaggagtacttcatataaataatatgattcctgtgccaaaagattgtgcaaaagtatggacacctaatagcccaaatgttgatgagaagtataagatgttagtaatcaaacaggcaaaatatttgaaattacatgagtctgaaataaatgaatcatgcgaattactttataattctaagttaggtaaacttgatcctagttactttaagaaaaatcgtaaagaagtaattacttatcaaaaaataatgacgaatgtagaatcattggaagctgttagtatagcagaatcccaaagaaatattcatgtacaaactcaaagtatagatgtagagtaa

SEQ ID NO: 1189 - DNA (genomic), 474 bp, Enterococcus faecium; double-stranded, circular
  misc_feature (B) LOCATION 1...474
  hypothetical: NO
  anti-sense: NO
tgggagtgtaattctatggcaatgattaaatttgatcacgtggataaatattatggcaagttccacgcattaaaaaatatcaatctcgaattcgagaaaggagaagttgtcgttgtcattggtccttctggttcaggaaagagcacgatgcttcgctgtatcaatggattagagacgatctcttcaggtaagctgctgattaatgatactgacttgcatgataaaaagacaaaactgacagaagtccgaaaaaacatcggcatggttttccaacatttcaatttgtacccaaataaaactgttctggaaaacatcaaattagcaccaatcaaagtgttgaagcaagaccaggcaactgcagtcaaaaacgcggagaaatttttgaaaactgtcaatatgttagataagaaagatcttatccttccatgttatccgggggacaacagcaacgggtggcaatcgccagaggtttag

SEQ ID NO: 1190 - DNA (genomic), 990 bp, Enterococcus faecium; double-stranded, circular
  misc_feature (B) LOCATION 1...990
  hypothetical: NO
  anti-sense: NO
aggattagtaaaggaggaagatcagtgactaaattaatcgagttcaaacatgtgcaaaaaaagtatgatggaaagtatgtcatcgatgacctaaatctggcaatcaaaaaaggagaaatctttgttttggttggtccttccggtagtggaaaaacaactactttgaaaatgatcaatggattatctaaaccatcagcaggagacatctacttcaaaggaaaatcgttaaatgaatataatctgcagaaaatgcggtggaatatgggatatgtgctgcagcaaatcgctttgttcccgaccatgacagtcaagcaaaatattgaagtcatccctgaaatgttaggttgggaaaagcagaaaagagcagaccgtgtagatgaacttcttcaaaaagttggcttatctcctgatatttatcgagatcgtatgcctagagagttgtctggaggagaacagcaacggatcgggatcatccgagctattgctgcaagcccagatgtgattttgatggacgagccatttagcgcattagatccgatttcaagaaactcattacaagaattggttttgtccttacacgaagaattgggcacgaccatcgttttcgttacgcacaatatggaagaagcaatcaagctaggtgatcgtattgcatttatgaaggatggagaaattatccaatgtgacacaccagagcagttattgatgaatcctaaaaacgactacgttcggcatttctttgatgaaccgaaacagacgaaagagtggcgagtagaagatttagtcgtcaatggatatttcttaaatgaaataccagaaaatgctcgtcaacaagtttgctttgatacgcctatgaaagaagtatattcgcttctttcggtgtatccaagcattgtgatagtagaaaagcaaagaagtattgggtcgctgacaagtaaagaaatctttgcttttttaagtcgagaggaggaaggaaatgaaaacatatga

SEQ ID NO: 1191 - DNA (genomic), 1029 bp, Enterococcus faecium; double-stranded, circular
  misc_feature (B) LOCATION 1...1029
  hypothetical: NO
  anti-sense: NO
tggtctagtaaagggggtttttgtttggatttgaaaaaggcaaaaaaagtaagtatcgttgatttttgcaaacaaaatgggataggtttaaagcaagattcaagggaatactatagattagaagatcatgattcttgtgtaatcagtgatcgtaaaaacctttttaaatggaactcaaaggatttagggggagatatttttgattttatcaaagcctactacgattgttcatttaaagaagcaaaacagaaacttgaagatagtgattatgaagttcattcgttcaatacaaaagtgaaaaaagctccgtaccaatatcagaaagaaaatgaagtgccggtatctgttgcaaagtcttatttagtaaatgagagaagaatcgatacagctttagtggaagattttttatctaaaggactaattaaacaagataaaaaaggaaatgttttgttcttatggaaaaaagatcaagaaatcgttgggtgtacggaacaaggaactagaaaattttttcatgaaggcaaacaaaaggatgttacatggaaaaaaatacaagaaaactctaaagagtattcaggatttaacgtaacttttggtcaaccagataaaatgtatttttttgaaagtgaaatagatttgatgtcgtacattacacaaaagccagaaaaagccgaaaatgctacgtttgttagcatgaatggattaaaggtaggtaatgtattgcatggggttacagagcattataataagtttaaatcattgccttcagaaacagtcctttgtgttgataatgataaagccggacgtacttttattgaaactgaatttaaagaaaaaggaattggaagagaagggataggaatcagtgaagtaaaagtcgatgtacctttgcgagagggatttgattggaatgataatttaacaagaggaaaagaagcttttaaacgcttcaagttagaagatgtatcaaaaatcgtgaacttcacacataaattatctcttaatactcctgtatatgaaatggaataa

SEQ ID NO: 1192 - DNA (genomic), 726 bp, Enterococcus faecium; double-stranded, circular
  misc_feature (B) LOCATION 1...726
  hypothetical: NO
  anti-sense: NO
aataatagtaacaatatgactctggaggatttatttatgaaaattttgattgctgacgatgataaagaaatcgttgaattattaagtatctatgttcacaatgaggggtatgaagcagtaaaggcttatgatgggaaagaagcattatctaaaatcagaacaatccctgatattgaattacttattttagatatcatgatgcctgagatggatgggatgcaagtagtgaaagagctacgaaaagaatcccaaataccaatcattatgctgacagcaaaaactactgatatggataagatcaaaggactggtcgctggtgcagatgattatgtgaccaagccatttaatccgttagaagtaatggctagagtaaagtctttattacggcgtacaaaaatgcagattgccccagatcagcctgatgtattagaagtaaatgcattaatcatcaataaagactctcatgaagttaaaacaatcgatgggaaagaaatccagttaacagctttggaattcggtatcctctacttgcttgctagtcatcctaatcgagtatttagcgcggatgaaatttttgagcgtgtttggaaacaagaaagtattgtctctgctaaaactgtcatggttcacgttagtcatttaagagataagattgaagaagcaactggtggtgaaaaagtcattcaaaccgtttggggagtgggctataaaattgacgcaagatag

SEQ ID NO: 1193 - DNA (genomic), 393 bp, Enterococcus faecium; double-stranded, circular
  misc_feature (B) LOCATION 1...393
  hypothetical: NO
  anti-sense: NO
caatccagtaatgatttaaaaaaatctagatgtagcgtatactttgtttatagaatgtactgggaagaaatatatttttgggaggaaatcgtgatgtctaaaagtgaagaaatagaaaacatggtactaaaattatatgatctcgttttaaatccagagatcaaagaaaaggaacgtatacttttgatagacgcaaagacaggcttagaaaaaggtcagtattatcctaaagtcataaataatttggaacgtagtttacgtccgttagcaatcaggggagaattgtctaaaccagtatcaccgttttatatggagatatcaacaataggaaaatttgaaaaagaattaggtcgaggaatggcttcggcaccgattacttttgggcatttataa

SEQ ID NO: 1194 - DNA (genomic), 1335 bp, Enterococcus faecium; double-stranded, circular
  misc_feature (B) LOCATION 1...1335
  hypothetical: NO
  anti-sense: NO
tcgtacagtaataggctagctgagaataatcctgaaatattagtagaaaggagagtgaagataattcaagcaatcgtacaaaaatttgtcaacaaaatgagtgtcggtttcttgcttttgttgctgacgctagtcttttttgtttggacagcaggggtaggttttccagcaactttgtttatatataacaatagttcattacttatcgcttttagtgtggctattttgctcattttaaatgtttataaagcaaaaggcgtcgattttctttatctaggtgttgcgcttgcccttttcattttcttttcttactttcgggaattaagaaatgagtctttatttggagacttactgtttcctttgattattttattttgtttagtaattaaatggatcgagtggacaaaatgggatcgcggtatttatctgattgtctttacggtcttcctcggaatcacgttatatcgtgtatttacagagatccaagtaccagaaggacaaagcatctgggctccaggcaattcgctttctgatatttggatcaatacgaatacaatcggaagttctttgatgactcttgctttattgatcagtggatttgccagttcttttgaacgatggtatgttcgaatcatcggtgggatagcagtcgttgcagcctttttaggtatttgggtctgccaatctagaggtgcattagtcgcgttgattgtttttgcgatattggatcttttacctaaatcgttgatgcgtgtcattcgtgcgccatttattgcctacacggttacgattcttttagctttgccgatttcttatctggcggctgtctctgaaaaagtcaatttgtttaccggtcgagaagatatttggcataaattctatcagacgctaggagaaaaatctgaacaagttttactaggaatgaaaacatttatcttccagcgaggaaaccaatttttaggaaaccacaatagttataattctattttgaatatctatggattgataggatttgggattgctgctttgctgcttatcctttttattggtcgcttaacgttgaaagcagatttatccaacgggcagatgacttttatctgggccttttttgcggtgatgatgcagtcatttatggaggatacattgacttcatacccatgggttccgattatttatatcctgttggctatggccgttcatcgatatgatgaaccagaagttacggaggaattctatgttatggaagaggcatatgacgatatgacttatgatgatacatcttatgaggaacaaccagatagcgctcattcttccaggatccaacgctatcattga

SEQ ID NO: 1195 - DNA (genomic), 843 bp, Enterococcus faecium; double-stranded, circular
  misc_feature (B) LOCATION 1...843
  hypothetical: NO
  anti-sense: NO
aatcaaagtaaaggtcaaataaagtgtcactgttgcgaccatcttattcctccattgttttgtttcaaaatgtacacatatttttttaataggagcctgcatatgaaaaagtattttatcatagaagataaccagtttcacagcgaatggatcatcagagaattggtcaatcatcatatcgagaatatcgtgcagctcacttctatctctcaaatcaatcagttgatccagttgggcactattgataatcacgatgttttctttatcgatatcgacttgaagcaatcactcacaggtattgatgtcgccgaacaaatacgtaaaaaaaatgcacatagtaatattgtttttttcaccgcttatacgaattttgcagtagagatcatcaatcggaaaatccttccgattggatatatcagaaaagacaggaatttatctgaacaaattcgtcaagtgctagaacagatcaattggaaagaacagcagatcgtaaatgtcgataaaatctttattgatcaaaaaggtggaagtctcgtcctgtatcctcgggaaattttatatattgaaagtatcaaaggtttgaaaaaccaagttatggtcaaaacaactacagaagataaattagtgaatacttctttaaaacaattgaagacagagttagaaaagtatgcttactttttacttttaaaatcttactgtatcaacttatcgcaattgcagaaaattgattctgctcattatgtgttagaatttttcaacggtgactccttactcgttggtcgaaagatctttgaaaagacaaaggaacgtttccatgacttccaaaaaactgcttcgagttga

SEQ ID NO: 1196 - DNA (genomic), 501 bp, Enterococcus faecium; double-stranded, circular
  misc_feature (B) LOCATION 1...501
  hypothetical: NO
  anti-sense: NO
tggcgaagtaatatcctatggaaaagtattgaccgtagacgaagtaaaagcattattgagcaaataataaaacaaagaaaggttggtaattcatttatgaaaaaacctaaagtagcctttgtctgtgttcataattcttgtcgcagtcaaattgcggaggcattgggcaagtatctttcttcaaatgtttttgatagttattccgcaggcacagaaacaaagccacaaatcaatcaagatgcagttcgtctaatgaaagaaatgtatcagatagatatggagaaaacacaatattctaaattgttatctgaaataccacaggtagatattgtgattacaatggggtgcaatgtgaattgtcctacaataccatgcaaatatagagaggattgggggttgaatgaccctacagggaaaaatgatgacgaatttttaaagacaatccattcaatccatgcaaaaatacttgaattgacagaaaaaataaaaataatgcgttga

SEQ ID NO: 1197 - DNA (genomic), 1155 bp, Enterococcus faecium; double-stranded, circular
  misc_feature (B) LOCATION 1...1155
  hypothetical: NO
  anti-sense: NO
aaaatgagtaatcgaatgattttaaatgaaacatcgtattttggaaaaggagcgattgagtcgatcgtccctgaatttcagcagcgaggattcggcaaagcagctgtcattactgacaaaggattgatcgagcacggtatagcaacaaaagtaacagaacttctagataaagcagcaatcgcttatgctttatacgacgggatcgtacctaatccaacgatccaaaatgtaaaagatggagtggcttttgttaaagaggcagaggcagactgtttgatcgcaatcggtggaggttcgccaatcgatacggcaaaagccattgggattattttgacgaatccagagttttcagacgtcattagtttagaaggtgttgctgatacgaaaaatccatgtttacctatattagctataccaacgacttctggaacagcagcagaagtaacgatcaactacgtcatcacagatgaagtaaatcaccgaaaatttgtttgtgttgatcctcatgatatcccaatcgtcgcgttcatcgacagcgatatgatgatgggaatgccgaaaaaattggctgcatcaacaggtatggatgctatgacgcatgctattgaagggtttatcacaaaaggcgcttgggaaatgactgatatgctgcatttaaaagcaatcgaaatcatcggccattctttggaagtttctgtagatggcgatcaaaatgggcgagaaaaaatggcattaggacagtatattgcgggaatgggcttctcaaatgtcggtttaggactggtacacgggatggctcacccgttaagtgcatggtacaacattcctcatggcgtagcgtgtgcagcacttttgccaactgtcatgaaatataacaaagaatatactggagaaaagtaccgtgagatcgctcttgttctagggattaaaggagcagctgaaatgtctttagaagatgtaagagaagcggcttgtggtgagatcgatcggttgagcaaagcggttggaatcccagaaaccatttctgaattaggtgtaaaagaagcagatattccagcaattgcagaagatgctttgcgagatgtatgcacaccaggaaatccaagagaaacgacagtagaagaaatcattgctttatatcaaagtttgatgtaa

SEQ ID NO: 1198 - DNA (genomic), 1452 bp, Enterococcus faecium; double-stranded, circular
  misc_feature (B) LOCATION 1...1452
  hypothetical: NO
  anti-sense: NO
aaacggagtaacactttgattttcataaaacagtataaaaagaaagaaggaagatttatgtttttatctgatgattttttattaaaagacgattgggcgaaaaagctttaccattcctacgcaaaaaacatgcccattattgattatcactgtcacttagatccaaaagaaatttacgaaaacaacaatttcagcaatctgacagaagcttggttaggaggcgatcattacaaatggcgcttgatgcgagcttgcggcgtgcctgaagaaaaaatcacaggaaatgcttctgattttgaaaaatttttagcttggtgtcaaaccgtaccaaaaattatcggaaatccgctttacagttggtcacatcttgaattgaagcgtttcttcggtattgacttgttgataaatgaagaaaatgcagagaaaatttggacacaagcaaatgaaattttggcagctcctgattttcgccgtcgggaaatcgcaaaaaaatcgaatgtagaagtgatttgtacaacagatgatcccgcagacgacttgcactatcatcagttgcttgctcatgaagaaccagatttgaaggttctaccttcattccgtccagataaagcactcaatattgaaaaagaaggatttaatgcatgggtcacactactggaagaagcagctgaccaaacgatcaccacctatcaagaactgatagaagtcttagggcagcggatagaatacttccatcaacatggatgtcgtgtttccgaccacgctttagacatcttacgctataaagaagcggatgaaacagtattagaagagatttttcaaaaagcacgagctaacaaactattatcttcagatgaaatcgatgcttatcgtacagaaacactgatacatttgacccacttctatcattctcataattggacgatgcagctgcacatccatgcttatcgtaactgtaatacacaaatgttggaaaaattagggcccgataccggctatgatggaatgaatgatctttctttgactattcctctgcaaaaattattgaaccgtgcagaagaaacggatcagttgccaaagacgatcctttattcattgaatccgaatgactatcctgcgattttagctttgatgggctgtttccaaaaagaacagaatggaaaactgcagttaggttctggatggtggtacaacgatactcgagctggtatgcgcgatcaattgacacaatttgctgatggtagtgctttggggaattttgtcggcatgctgacagattcaagaagtttcctgtcctacactagacatgaatatttccgtcgtgttctttgtgaatttttaggcgaaatggtcatgcgaggagaagcacctgaagatgaacaacttttaggaagtctagttcaagcgattagttatacaaatgctaaaaattactttggcttttttgcctaa

SEQ ID NO: 1199 - DNA (genomic), 252 bp, Enterococcus faecium; double-stranded, circular
  misc_feature (B) LOCATION 1...252
  hypothetical: NO
  anti-sense: NO
aggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtga

SEQ ID NO: 1200 - DNA (genomic), 252 bp, Enterococcus faecium; double-stranded, circular; identical to SEQ ID NO: 1199
  misc_feature (B) LOCATION 1...252
  hypothetical: NO
  anti-sense: NO

SEQ ID NO: 1201 - DNA (genomic), 582 bp, Enterococcus faecium; double-stranded, circular
  misc_feature (B) LOCATION 1...582
  hypothetical: NO
  anti-sense: NO
aaagcaggtaatgacatgaaacaattaagtagtgcacaagttcgacaaatgtttcttgatttcttccaatctaaaggacatacgattgaacctagtgcgtctttgatccccgtgaacgatccaaccttattgtggatcaactctggtgttgcaacattgaaaaaatattttgatggttcagttgtgccagaaaatccaagaatcacaaatgcccaaaaatctattcgaacaaatgatatcgaaaatgtcggtaaaacagcacggcaccatacgatgtttgagatgctgggtaatttttcgattggtgactatttcaaaaatgaagccatccactgggcatgggaatttttgactgatccaaaatggatggcattcgatccagaaaaactttatgtaacagtttatccaaaagatacagaagcaaaacgcatctggcatgaagaagttggcctgccactagatcacattattgatgtagaacaacacttctgggatatcggtgcacgcccatgtggtccggatacggaaattttctatgaccgtgggagaagcttaggaccatttaccagaagacgatcctga

SEQ ID NO: 1202 - DNA (genomic), 786 bp, Enterococcus faecium; double-stranded, circular
  misc_feature (B) LOCATION 1...786
  hypothetical: NO
  anti-sense: NO
aaagaaggtaaaataatgatcaacttaggtattatcggaacaaattggattactcatcaatttgtccaagcagctttaagcacaaaaaaatatgaattgacagcggtatattctagacatttggaaaaagcacaggaatttggttctcattatgaaggggatatcgaattcgcaacagatttgaagacttttttcaatattactcatatggacaccatttatattgcttctccgaatagtcttcactttagtcaagctaagcaagcaattttggcaggaaaaaatgtgatagttgaaaagccagctttttcgacgccaaaagaaatggatgaaatcatccatttggcaaatgaacacaatgtgtatttttttgaagcagcaagaaatatccatgaatcaggttttaaaaagattgccgattacttaccattaaaagacgagataatcggtgcaaatttcagctatatgaaatattcttcgcgctatgaccaagtattagatggagaagaaccgaatatcttctcgactcatttctcaggtggtgcattgatggatttaggtgtttaccttgtatatgcagctgttgcttggtttggaatgccaaaagaagtccattatttcccaagaaagatttctactggtgtagatggtcttggatgggggatcttacgttatgagaattttgatgtatcgatccagccaggtaaaatcggtgattcttatttaccgtcagagatttattttgactcaggaacgctagtgatgaatggagtcaaatgcaattga

SEQ ID NO: 1203 - DNA (genomic), 426 bp, Enterococcus faecium; double-stranded, circular
  misc_feature (B) LOCATION 1...426
  hypothetical: NO
  anti-sense: NO
gaaggaggtaaaagatcaatggtcatgacagatccaattgcagattttctaactcgtatccgtaacgcaaacatggttaaacatgagtctttagaagtacctgcatcaaaaattaaacgtgacatcgctgaaatcttgaaacgtgaaggtttcgttcgtgatgttgaatacatcgaagatgacaaacaaggcgtgatccgtgttttcctaaaatttggtaaaaacggcgaacgtgttatcacaaacttaaaacgtatctctaaaccaggtttgcgtgcttatgtcaaagctgacgaagtaccaaaagtattgaacggtttaggtatcgcaatcatttcgacttctgaaggtgttgtcactgataaagaagctcgtgaaaaaaatatcggcggcgagagttatcgcttacgtatggtaatcaagtag

SEQ ID NO: 1204 - DNA (genomic), 1629 bp, Enterococcus faecium; double-stranded, circular
  misc_feature (B) LOCATION 1...1629
  hypothetical: NO
  anti-sense: NO
gttattatcctgaagtacttcaacaaaaagaatttattgaaaaagttatccgtacagaagaagaacgtttcaatgcaaacaatcaatgaaggtttggaaatcttaaatcaagtgatccaagaagtaaaaaacgaaaacgggacgactctagcaggaaaagacatcttcaaactatacgacacatatggcttcccggtagaattaacggaagaggtggcagaagatgaaggactgaaagttgatcatgctggttttgaaaaagaaatggatgcacaacgcgaacgtgctcgctctgcccgcagtactgaaaaatcaatgggggtacaatctgctttattgacagatatcaaagtagaaagtaaattcattggatacacagaacaagaatcagatagtcaattattggtcatcgttaaaggtgagtctcttttgaatgaagtcgcagaaggtgaagctcaaatgatctttgatcaaacacctttctatgcaaaaatgggtgggcaagtancggatcaaggatggatcatgaatgaagtacgcgaaatcgtancagttgttacagatgttcaaaaagcgcctaatggtcaatttatgcacaccgtagaagtaaaagcaccaatgagtgaaggacaaacctatcatctattgatcgatcaatcgatgcgcaatcggatcatcaaaaaccatacagcaacccatctactgcacaaggcattgaaagaagtacttggcgagccatgcaaatcaaggtggttctttaatcgctcctggaactttacgattggaattttacccacttttggtcaaatcacttcagatgaattagctgaaatggaaagaatcgtcaacgaaaaaatctgggaagctatcccagttgaaacaattgaaacagatatcgatacagccaaagacatgggtgcaatggctttgtttggtgaaaaatacggacatgacgttcgagtagtaaatattggcggctggtcaatcgaactgtgcggaggcacacatgtagcaaatacagaaaacatcggaatcttcaaaatcgtttctgaatcaggaattggtgcaggcgtgcgacgaatcgaggctgtaacaagtaaagaagcgtacgaactacttgaagaagaagaaaaacaactaaaacaagtagcaacaattgttaaatcacctcaattgaaagaagttgtttcaaaagcggaacaattgcaacagcaagtaagagagctacaaaaggaaaatgaacaattagctagcaagttagcgaatcaacaagctggtgatgtattcaaagatccagaaacgatcaatggaaaaacaatcattgcagcacaagtaaaagtgaaagatatgaatcagctgcgtcaattagctgaccaatggaaacaaaaaaatatttcagatattcttgttttagcaaacgaacaagaaggaaaagtcagtctgctagcggcaatgacgaaagaatcaaatgaagctggactaaaagctggcgacttgattaaagcaatcgcaccgaaagtaggcggtggcggtggtggacgtccagacatggcacaaggtggggggatatatcgtgttggtattcaagatccacttaaagctgggaaagaatgggttgcgcaacaatag

SEQ ID NO: 1205 - DNA (genomic), 333 bp, Enterococcus faecium; double-stranded, circular
  misc_feature (B) LOCATION 1...333
  hypothetical: NO
  anti-sense: NO
gaattcatccttcaagacctattcataagctgtttttttcataaaataaacaaaatcataaaaaaacactttgcttatttgacagaagacagccgcgctttgtatagtggacaagacttacatttttttgaagaatcagaaagatcaggtaaaggtcttagtaaacgcaagccattcagaataaccaatattgtgcttccttcgtgtcctacaactccaagaggtagatttaaaaattgcaggaagttagaagcaatcaacaagagaataacaagaatcgaaaaaataatattttgtttgatgatccgccgcatttttaaagatagccgatga

SEQ ID NO: 1206 - DNA (genomic), 1365 bp, Enterococcus faecium; double-stranded, circular
  misc_feature (B) LOCATION 1...1365
  hypothetical: NO
  anti-sense: NO
ccattaatcctaggcaggtggttgcttcgcggtttttctttttctacaataagatcaagaggtgattacacgatggctagaaagaaaagaaatcctgatgccgaaaagttagctgaatccattctgaatgcctatcaacctgaatctgtcgatgacatgcaagatgctttgaaagatgtgtttgggcccctttttgaaaaaatgcttcaaggagaattgaataatcatttaggttatgatgcccattctaaagagcctaaggaacacgataaccgtcgaaatggctatggaactaaaacgcttaaaaccagttttggtgaagtagctattgatgttcctagagaccgggaagcttcctttgaaccagagttaattcctaagagaaaacgagatgtctccgacatcgaagggaaggttctttccatgtatgcacgaggaatgagtcaacgagatattgccgcaaccgtcgaagctatttatggctttgatatttcccatgaaatgatttcagatatcactgacgctgtccttcctgaattggaagaatggcaagcccgccccctagcaaagtgttatgcctttctattcgttgattgtatgtatgttactttacgagaaaattatgaagccaaagaatatgctgtatacaccattcttggctatgatctcaaaggaaataaggagattttaggattatggttaaatcaaacagaatctaaaaatcgctggatgcaagtatttgatgaactgaaagcacgtggtgtcgaagatgtctttttcatttcgatggacggtgtttctggcctcgaagaaggcgcaaaagcgatctttccatcggtaattgttcagcgctgtattgttcatcttgttcgaaatgcattgcgctatattccaagtaaggactataaggaagtctgccgagatatgaaaaagttctacggtgcttcttctctaaacgctgcacatgctgcttttgacagttttcaaaatcggtggtctcattattctggtgctgtagatgtctggaaacggaactttgcacatgttgaacaactatttgattatggtagtgccattcgaaaaattatgtacactaccaatgcggttgaaagtgtccactccagcttcagaaaagtcacaaaaaaaggagcgttctctaatgagaatgcactcctaaaactactttatttacgcacgaaagaattacacgcgaagtggtcaggtggtcgaattcaaaactgggctatggtgcttaatcagttaatgatcaacgagaccttctcctctagaatgaaaagtatgcgatttaccttccgtaacaacggtaggtttattcaactatgtgtccgatcaaaatttatctga

SEQ ID NO: 1207 - DNA (genomic), 486 bp, Enterococcus faecium; double-stranded, circular
  misc_feature (B) LOCATION 1...486
  hypothetical: NO
  anti-sense: NO
ccatcaatcctaggcgggtggttgcttcacggtttttatttttctaaaataagatcaagaggtgattacacgatggctagaaagaaaagaaatcctgatgctgagaagttagctgaatccattttgaatacttatcaacccgaatctgtagaggatatgcaagatgttttaaaagatgtgtttggtcccttatttgaaaaaatgcttcaaggagaattgaataaccatttagggtatgacgcccattctaaagagccaaagaaacatgacaatcgacgaaacggttatggcaataagacgcttaaaacgagctttggtaaagtaaacattgatgttcccagagaccgggaggcttcttttgaacctgagttgattcctaatagaaaacgagatgtctccgacatcgcagactgtagacaaaagctgttccaaactcgtaactcgagcttggaacagctttttatctacttcgtttcgaatttttga

SEQ ID NO: 1208 - DNA (genomic), 279 bp, Enterococcus faecium; double-stranded, circular
  misc_feature (B) LOCATION 1...279
  hypothetical: NO
  anti-sense: NO
tcttctttcaagtttacaagtgtttcttcaaccgttcctgtcgaaatagggtccaaagcacttgccggctcgtctagcagcaagatatcaggtttcatcgcgatcgcacgagcaatacataaacgttgctgttgcccgccagataaagccaaggcacttttgtccaagctgtcttttacttggtcccacaaggcagcttgtttcaagcttgtttccacgatttcatctaatttcttatcgtttttttcgccgtgctgtttcaaagcaaatgtaatatag

SEQ ID NO: 1209 - DNA (genomic), 243 bp, Enterococcus faecium; double-stranded, circular
  misc_feature (B) LOCATION 1...243
  hypothetical: NO
  anti-sense: NO
aaacctttcaattggtggtatacttataaatggaatttcgttatcaacgcgttcgttgcctttcagcaagtatttaaagaaaggagaatggctatgacattctataacaaagatatacaatatcgagtaaccttggatacagatttgaatctatttgtcgtttttgacaaagaaaataccaatcatgtagcgacaggtgttacgatcgaacaagcagtgcaagaattaaaaaaatctgcataa

SEQ ID NO: 1210 - DNA (genomic), 2835 bp, Enterococcus faecium; double-stranded, circular
  misc_feature (B) LOCATION 1...2835
  hypothetical: NO
  anti-sense: NO
tataatttcaaaagaacattagaggcaggagaagaggaagatattttgaaaccaagaacttatgcagtcgttgatatcgagacgactgggacgaatccaaaagaagatcggatcatccaatttggctgcgtcatgattgaagctggtcggatcacttcacgtttttcgatcgatattcatccagggcggaagatttcaaaacaaatccagcatttaacagggatcacgaatcaacgcgtccaaaaagcgccttattttgaagatgtcgcccaaacgatttacaatcttttggcagacaccatatttgtcgcgcataatatttattttgattataattttttgaaccatgaactcatgcgatgcggacttcctagtttgaagataccgggcatcgataccgtagaacttgcacaaattttcttgccgacggaaccaagttttcgcttagctgatttgtcagaaagccttggctttattcatgagaatcctcatcaggcggatagtgatgccgaagtgacaggtcagcttcttttactgatcgaagaacgaatgaggaaattgccgatcatcacattagagcagattgcacgattaagtagccatacaggaatggatacgagtcgtttcatttaccacgtgcttgaagaaatgaaagaaaacccggagccccttgatctctcattagaaatcatcgatgggctagctttgcagaaaaaagaagtggaactattcacatccgtccattatggcgagcggacatatccaagaaaaaaacaagcaaaagaaaaaatgttcggtaaaacactgatgtatcgaaaagaacagaacaggctgatgaatgctgtctacgaccatttcacaaaagatgaatcaaaagatttgatgatcgaagcagctacaggaatgggcaaaacgattggttatctgttgcctttgagttatttggctacacctgaaaaaccagctgtcatcagcaccgtttcgcttgttttgcagcagcagatcatggaaaaagacattccattactgaatcaattactagaacagccgatacaacctgtgattatcaaaagctatcgccactatattgatttacagcgttttaaaggtacacttgtggaaccgccgggacaaaaacaatatgctttgtaccaaatggctgtcttagtatggctaacacaaacgaagaccggtgatttggatgaattacatttaactaatctgaaccatgcattctttgcagatgtcgcgcacagaggcaccgagtttttagcaaggaatcagtcgttttacaaacaagactttgtgcgtttcttgcaaaagaaaatcaaacaaagcaattttttgattgtcaaccatgcatttttagtacaagaaacacagcgaaaagaaccattgcttccagctagtccttatttgttgattgatgaagtgcatcatttgccggaaattgctgaaaaagtaaatgacaaacgactaagtattaactacttccataaacaaatccagcaactggaagagccgaatcagttatttgaccgcatacaaagttatttgccgaaggaacatgaagccttgcgctggttatcgatttatcgagaagaactctctgcactatgcgaagcgcagatttgtgtggcagagggattaatgaacttagtaagcagcaagcagcctaacggacaatatccagaagaagtcatgatgacaaaagaaatgttggatcagctgccactggaatctggaacagcaatggatcatctgcaacttttttatcaagagatccaacaactacaatcacagatgcgcttgacttttgagattatccaagaaagttggaccaaccagatgcggatcgatttagcaagtttatatagcttatttgatcaattagacaagcaatacttgctgatggaccaatggctagaagactggcgagatcatttgatccattggttcgttcccgggaatacagcacagcagatgatttttcatctccatgattttcaagcagctatgttgccgtcaactgtgtggtatcctcgatatgaccatatactttatattggaggaacactgaagatcggacctaatcgacagtatctctctaaacgacttggcattgaagcagcacctcttaaagtgattgcttctccttatgattacgagaaacaggcaagaatctatgtgccgaaagaagcacctgcagtccatcaagtcagcaatcaagcatatatcgactatttagaagcagcactcacaggattgattgaacaagaagatcggccgatccttgttttattcacttctcatgatgttttgcaaaaagtatatcagaaaatgcatttgtctatgctagaaaaaggacgtgaaattcttgctcaaggatttggcgggagtcgggaaaaacttttgaaacgcttcattttgtcagaaaaaagcgtcttatttggtgctgacagcttttgggaaggtgtagatttacctggagatgctttgcagattgttgtagtcacacgtttacccttcgacaacccgttacgtccgatggtcaaagctaggaatgcttatctggaatcagaggggatcaatcctttttatcaggaatccgtgcctaaagcagctttgaagttacgccaagcattaggccgtttgataaggacggagacagatcgtggcgtattacttattttggatcggagattagtcactgcaaaatatggtgcacgaatcatccatgcattaccgaaaaaagtaccgataaaagagctagctatggatgaaatctatcaggatatccatgaattcttaaagaaaaatgaagaaggaagttaa

SEQ ID NO: 1211 - DNA (genomic), 1659 bp, Enterococcus faecium; double-stranded, circular
  misc_feature (B) LOCATION 1...1659
  hypothetical: NO
  anti-sense: NO
accaatttcaataaaggaggagccataatgaaaatgggaatttggttgcgtaaagctgttttatttgcagctgtgttaggggctttgggggctgtttcaaaaactgttgaagcatctgccagcgaatttattcgcggagcagatatttcgatcctgtcagatatggaaaaatctggtgcaaaatattatgaagacgatatttcaaaagatgccttagagattttaaaaaataatggtgtcaactatgttcgactgcgtttgtggcaggatccttataatagtaatggagaaagttatggagcagggacaaatgatctggaaacgacgattgaccttgcaaaacgagcaaaaaatctgggacttaaggtgctgctggattttcactacagtgatttttgggttgatcctgggaaacagaatcttcctaaagcatggcaaggtctgacctttgaagaaatgaatacggcattgtacgactatacaaagaacgttctgtcggaaatgaagcagctggacgtttatcctgatatggttcagatcggcaatgaactgaatagcggaatgctctggccttatggcaagtcttggggagaaggcgggggagaatttgatcgattggctgcttttttgaagtctggtatccaagctgttcgagacactcaacctaaaacaactccagtaatgctccacttagctgatggtggcgatacaggagcatttacttggtggtttgatgaaatcacgagtcgaggtgtgtcatttgatttaattggagtgtcgtattatccgtattggcacggttcaatgaatgaacttcaaaccaatatgaatgcgatcagccaacggtatggtaaagaagtgatcgtagttgaaacagcttatgggcatacaacagcgaatgccgatactatgccaaatgcttttggtgaagccgaagcagctgcggggggatatgaaccaacaccgacaggacaagcagagtatttgctggatcttgccgatcggattcaggcagtaccgaataatcgcggggcgggcttcttctattgggaacctctttggtacaacggaaatgtgagttgggcaacacaagcaggtatgaattatctcagtgttcaatccactatgggaaacgaatgggacaaccaagcgatgtttgattttgctggaaacgccttgccaagcttgcgtgcgtttaaacaagcaggggcgcaaataaatctagttaaaaatgcaagtttcgaaagcgatggaccaacgaccagtccttccaattggcaaacctggtttcaacaaggaaccgctaagggtacgatcaaaacggaagcgggcactttttttggggactacaaactaactttttggcaggatcaagcatacgaggcatcagcttatcaaaatgttagtggcataagcaaaggaacttacacattgagtgcctatgtaatgtctgggggagagtttgatactaatcagttatatatcaaaaattatggtggagcggaactaaatactgcggttgttaaaacaagtgaatggacaaaaattacaatcaaagacattccaattacaacaggtgtttgtgaaattggggtttatagcaaggcttcaggaaatgcttggacgaacgttgattttgtttcattggtgaaacaatag

SEQ ID NO: 1212 - DNA (genomic), 870 bp, Enterococcus faecium; double-stranded, circular
  misc_feature (B) LOCATION 1...870
  hypothetical: NO
  anti-sense: NO
ttggatttcaaaaaaatcgaatggatatttttcgtcgcttttttagggttgaatgtgtttttattcagcagttatcatgacgcggtataccaagaaaacaatgtcattcgctctaatcagactgaatcaatccaacaacgtctggctagcgacgatatcacttacacggggaagatttcgtctgagaacaagcaaggctattatcttagcgcggagcagaccaatcttagcacttcattagcgaattatcgcaaggctggtaaaagcggcttgctggcaagtggtgtgtttttagacggtgatgttttgacgaaatctttatccagttcagatgctgaaaagaacgtgatcgatccagataaaattagtagttccttggaagattttttatctaacaaagacaatattttattcggtaatgattatgtgtacacgaaaaacttttctcatttagaagaagaaccactagaaatccaagcaagccaagagtatgaaggcatcccattcaatgatgatacagcaaaaatcgttctttctttagaaaaaaacgataatgattatagcatcacgaaatacatgcagacgcatttatctgatatcgagcagctgcgcgaaaagacggaactgtatacggaagaggaagcaatcaatacattgtacatcaataacaaaataccaagaggatcaaaaattttatggcgtcagctagcttattcctgtattctgaaagtccgggaaaaaaatgtgtatgttcctgtttggcatgtagcgatcgaaacaagcgataaagtggtccaaattgagagtgtcaacgctttcagcaatacgatcgtgacaaacaatactgtaccaaaagtggaagatcaataa

SEQ ID NO: 1213 - DNA (genomic), 207 bp, Enterococcus faecium; double-stranded, circular
  misc_feature (B) LOCATION 1...207
  hypothetical: NO
  anti-sense: NO
gccctcttcaatatcggaagaagcaaagatatatttgttaaaaaggtccaaaaaaaatatccgcacccccttttttttgtaaaaaactattgcacaatacaagtagcctacggctatcgaaatttccataactttcgagcaagaacttatctcattcaaggcttgatcttccaagtaaaacaaaaaccagttaagcactctgcctaa

SEQ ID NO: 1214 - DNA (genomic), 1449 bp, Enterococcus faecium; double-stranded, circular
  misc_feature (B) LOCATION 1...1449
  hypothetical: NO
  anti-sense: NO
aactacttcaaagacaccgttattttatccaaaaaatcaaggagagtgtcaacggtgagtaaatctgaagtaagtaaaatgggtcttgggacctttatcggtctgacaatggcactgtgtgcaacggttcggagtattcctacgttagccgcagtcggttggacattgattttttattcaatttttgcagttttgttttttgccggtccgatatcaatggtttccggtgagctttccacgatgcttcctcaagaaggcggtcctcagttatgggtaaaaacagcactgggcagcaaatggggatttgtcgttgcatggctattatgggtgcaaatgttcccaggtatggtaatggtcgcttctactttaggaccattgttaggaaacacatttggtaatgtagaacttggcaataatcactggttcgttttaggttgtattttagttatctactggatcatcacgatcttgaacttgaaattcgatatggcaaaagtcggcgggaacatcggtgtatggctaggggtatatatcccagtagtcatcatgttcgttttaggtgttttggcagccttcaaagtcggactagtctcaaacggctatctaggtgacttttcatggtcaaaagctttccctgacttggaacatattgattcattgaaatacttagctggtatcacatttatttttgttgggatcgaaatgagttctgtttacatgcctcgtttgaaagacgcaacaaaaaattatacaaaaggcgtatttatcgctttgatcggattagttttattgaatgtcatcaatgcgatgcttgtagcaaatgtcgtaccagatggaaaaatggaattagcaaatatcacgcagcctatcttgattgactgtcaaatcctaggcttaccagaagtgatcggaaatatcttcagcttcatggtatttattggtgtgcttttacaattatcagcttgggttactggaccatcaaaaacaatcatccaagtagctcgtgaaggattccttccaccaaaattcggattccataaagaaaacaaatacggcgtatctagaaatgtcgttctaacacaatcaatcgttatttcattatttgctttgctttatggtgtaatggatgacgtaagtgctgtattcttgacacttacaaatgctacaactgttatttattgtatcgtgtacattttgattgctgtttcattgcttaaaatgcgtaagaaacatccagaattcgaacgtccttaccgaattggtaaaaacggaaacggattatcttgggtagtcagctgcatgctgatcttctctatcatcgttgtcgtatttgctacattaggtacagcgacattgagtgatgcattattagtagcagctatcacagtggtcatgttcgttattccattgatcatcaatcacttcaagaaagagtctttgggggattga

SEQ ID NO: 1215 - DNA (genomic), 189 bp, Enterococcus faecium; double-stranded, circular
  misc_feature (B) LOCATION 1...189
  hypothetical: NO
  anti-sense: NO
gcaaacttcaaaataaaaattgcttggacaatatcagaagaagatttaaagtcttctgatatgtcgcaagcagttttttgttttatgcatttatttttgaatagcttgttaagacaagtggctgttttgctagaagaggataacttttaccattcattttcactgttccgcctgttctatcagaagtaa

SEQ ID NO: 1216 - DNA (genomic), 240 bp, Enterococcus faecium; double-stranded, circular
  misc_feature (B) LOCATION 1...240
  hypothetical: NO
  anti-sense: NO
ccattattcaaatcaactcccttaataattactttcctagtaagaataaaagataaatctgatacgtattattcacagaataggaatcttactaaccttatgttaactaatttacttagagaatttcatgaacattacaacaaaaaaagtacatttcttcatgtttttttcggatatttgtgctttttaaccattcagcagctgaaaacatataaaaagatatgtatgtattctttctga

SEQ ID NO: 1217 - DNA (genomic), 390 bp, Enterococcus faecium; double-stranded, circular
  misc_feature (B) LOCATION 1...390
  hypothetical: NO
  anti-sense: NO
atcaaattcaaattaaggggggcaaccctggaagtcttaaatttaccctcaatgaatggtattgaagatgaaaatttaaggcgtttgattaatagccttgtcattgaattgtacaagtatcaagcagaatcagaacgaaaaaaaattaaggaacgtcaggcacaaggaatcgaaattgctaagaaaaaaggcaaattcaaaggtcggcaactgaaatttaaaaaaaatgatccacgtttaaagcatgctttcgatttgtttttgaatggtttatccgataaagaagttgaagaacaaactgggatcaatcgccgaacgtttagaaggtatcgagcaagatataacgtgacagtagatcaaagaaaaaacaatgaaaagagggatagttaa

SEQ ID NO: 1218 - DNA (genomic), 309 bp, Enterococcus faecium; double-stranded, circular
  misc_feature (B) LOCATION 1...309
  hypothetical: NO
  anti-sense: NO
atcagattcaaaaacaaaagttgtaaaggcagcattggtaaaaatggcaggaacgtacttgcaatcagcacggaaaacatattgccaaaattagaacttgctgtagccttgatatatttcatgatattcccaaaagtttctcgtccagaaagaaggcctctttccaaaatcgtcaaatctttttctaaaaggatcacgtctgcagattctttcgcaatatccacagctgtatctacagaaataccgatatcagccactttcattgcaggagcgtcattgataccatctcctaaaaatccgacagtatga

SEQ ID NO: 1219 - DNA (genomic), 204 bp, Enterococcus faecium; double-stranded, circular
  misc_feature (B) LOCATION 1...204
  hypothetical: NO
  anti-sense: NO
atggtgttcaaaagcttttatctacggcaatcagtcttctcaaatgtaaaacatgaggagctaattttatttgagtattctttttgctcgatgcaggacggcttttttacaacctctgattcatggtgttcaatcagctgtccttcggtattagctcaaaaaacggcaaaatatgaaaaactattttgccgtttgtttctctaa

SEQ ID NO: 1220 - DNA (genomic), 246 bp, Enterococcus faecium; double-stranded, circular
  misc_feature (B) LOCATION 1...246
  hypothetical: NO
  anti-sense: NO
acggtgttcaaaagccagtttctcggtagtaagtcaaatttatgcaaaaatgtggaaacccatgtttacaaaatttttcttactactcgaaacgaagcggctttatcacaacctcttgataaacggcgttcaatcagctgtccctcggtattagctcaaaaacggcaaaatatgagaagctatttttccatttttttctctcatactcaggtcataacgctgatttcacaacctcttctttcataa

SEQ ID NO: 1221 - DNA (genomic), 216 bp, Enterococcus faecium; double-stranded, circular
  misc_feature (B) LOCATION 1...216
  hypothetical: NO
  anti-sense: NO
ataccactcaatgattggtttgaaatcaagaatgtattcattgattccagcatactctccattttcatcatgcattgcttggtaattatgcacaatatatttttctggcacttgttttggtacatgaacacgtaccgcatctgttgctccgcttcgcagttgttgaattacccactctacatttttatacgatttttctgggtgacagttggctaa

SEQ ID NO: 1222 - DNA (genomic), 216 bp, Enterococcus faecium; double-stranded, circular; identical to SEQ ID NO: 1221
  misc_feature (B) LOCATION 1...216
  hypothetical: NO
  anti-sense: NO

SEQ ID NO: 1223 - DNA (genomic), 375 bp, Enterococcus faecium; double-stranded, circular
  misc_feature (B) LOCATION 1...375
  hypothetical: NO
  anti-sense: NO
ccaaagatccttaccgcaagtggtactgcagtagcgacttttaccctagccgtcaaccgaaatttcacgaatcaaaacggcaatcgagaagccgattttattaactgcgtgatttggcgcaaaccagcagaaacaatggcgacattagctaaaaaaggtagcttgattggtgtagttgggcggattcaaacgcggacttacgacaaccagcaaggacaacgtgtatatgtgactgaagttgtagcagataactttcaactattagaaaataaagcagcgacagagagccgtgcgcacgctgatcaatcgtccaccagtccaagcaccgccacctttgaacaacggatacagcgacgcctaacaacaatggattga

SEQ ID NO: 1224 - DNA (genomic), 687 bp, Enterococcus faecium; double-stranded, circular
  misc_feature (B) LOCATION 1...687
  hypothetical: NO
  anti-sense: NO
atggttatcaataatttgcaacagcaagcttatgaatctatacgtaaacaaatcatttattccgagttagcacctggaagtaaaatctccgataaagtgttagaagaacaactagctatcgggcgtacaccgattcgagaagcactgatccaactgcgcaatcaagagcttgtaaaaaccattccacagtccggcacttatgtttcaaaaatcgatatccgatctgcttcattagcccgttatacgcgggaaaagttggaaaaaccgatcctgcaagaatgcagtgcgaaaatgaccaagcaagatcaagctaaactagaaaaaatactagaacaaaccgatcaggcagtaatcgctcaaaataaaaaagctttttttgatttggatactgattttcaccgaacttgttatgaaattgctggaaaacgagaaatttgggattggctagaaagttatagtacgcacttgaaccgtttcagatggttacgtttgacgatttcagaattagactggggtcgagtattagatgaacatcagacaatgcttcaatcaatgattgatcataactttgatgaagtcggatttctttgcacgatgcatttacatatgattatcgaggagcaagaatacgtgattcataattaccccgattattttgaagatattcaggacagacccatcaaataa

SEQ ID NO: 1225 - DNA (genomic), 669 bp, Enterococcus faecium; double-stranded, circular
  misc_feature (B) LOCATION 1...669
  hypothetical: NO
  anti-sense: NO
tgccatatcaaagaaatcggtgaacttttagcggatcatccagcttatttccatacagatgcggtacaagcgtacggaaaccaaacgatccatccagaagaattaggaatcgatttattaagtatctctgctcataaaatcaatgggccaaaaggcgtcggtttcttatataaacgagacggagtaaatatccctgcattgcttttaggcggggagcaggaagaaaagcggcgtgcaggtacagaaaatttagcagggatctggggtatggcaaaagcagttgaactgctgtcacctgaagaacgtgaagcacgtaacaacaaatataaaggattccagcaattgattcttgatacattagaagcaaacgaaatcccttatcaagtaaatggtgatttaacgaataaactccctcatgtgttgaatcttcgcttaattggcgaagcaaatgatttgctactgatgaagcttgatcttaatggggtcgctatttctactggttcagcttgtacagcaggaaatatcgagccttcacacgtattagaagcaatgtatggagaagatacaccgatactaaaagaatccatccgtatcagctttggtttgggaaataccgaagacgacatccagtatttccttgatcaattagttcgtgctgtcaaaaaataa

SEQ ID NO: 1226 - DNA (genomic), 201 bp, Enterococcus faecium; double-stranded, circular
  misc_feature (B) LOCATION 1...201
  hypothetical: NO
  anti-sense: NO
tttataatcaatatcgagccaatattcaggagatcatcaagagattgtgcaaatctaaaatataaatttgggtatcgacacttttgggtggaaggatactatgtgacaaaagtaggacaaaatgaagcgaccatcaaaaagtacattcaagaacaagaaaaacatgatagtgcgttagataagctgagtgtacgagagtaa

SEQ ID NO: 1227 - DNA (genomic), 219 bp, Enterococcus faecium; double-stranded, circular
  misc_feature (B) LOCATION 1...219
  hypothetical: NO
  anti-sense: NO
aaatcaatcaattctttgcaaatgtttaaattcttctcctcttttaaaaaaacaaaaatgttgtgtttttttaaaaaaaggaaacgcttccatgaaaaagaagatagctttgaaaacctgaaaaaagaggagggaatagggaaaaacgaactttttgaacaaaagttttacaaaatgcgtgttattatttttgttctgatactctttttgataaaataa

SEQ ID NO: 1228 - DNA (genomic), 186 bp, Enterococcus faecium; double-stranded, circular
  misc_feature (B) LOCATION 1...186
  hypothetical: NO
  anti-sense: NO
gtgccaatcaacaatatgaatcctgttataaaatacaaaccagtggcagttgttaagtattttcctttagcagtcaaaaacaatgctactgctaaaaaagcaagtgaaataaacaacacaacggcaaacagaccagtcatgtcctgtaataatccaaatgtattttctaaagacaaagttgaatga

SEQ ID NO: 1229 - DNA (genomic), 258 bp, Enterococcus faecium; double-stranded, circular
  misc_feature (B) LOCATION 1...258
  hypothetical: NO
  anti-sense: NO
caagaaatcaagctgtctgtagtagtcaatgtaggcaattaccgtgaaaagcgccaagagatcattcagcgtttagctgatcgcacggctgaaaaagtaaaacggacagggcagcctgtttttttaggacccatgcctgcatttgaaagtaaacaaatccatgctgcattaagcaaagatgaacatgtaaaaacacattcggaaggtgaggaaccttatcgttatttagtagtagaacctgctaaaaaatattattga

SEQ ID NO: 1230 - DNA (genomic), 390 bp, Enterococcus faecium; double-stranded, circular
  misc_feature (B) LOCATION 1...390
  hypothetical: NO
  anti-sense: NO
gagggaatcaaaatggaaattatttacccacctttagttgaagaaggattaaagtattatcttgaaacgacccagcaatcgctagataaatgcactttttatcgttcgatggtagagagaggaattattactgaaacgggtttaccgacccaacaggcaattgaaaatggattagtcaaagattactatgaggaccaaggcttatcatttgatgattttttaagaatctatccaatttttgaagagtatgacgaggagttatttcaatgtatcgatggttattgggagatacctgttgatatgaaagaaaatttagtttcacaattggaatctggcgagttaacttttgaagatgcacaacaaattcaagcatatcttgaagatcgataa

SEQ ID NO: 1231 - DNA (genomic), 864 bp, Enterococcus faecium; double-stranded, circular
  misc_feature (B) LOCATION 1...864
  hypothetical: NO
  anti-sense: NO
acgccgatcaaagccttagcggacagtgcgaataaaatggcaaacctgaaagaagtaccgccgccgttggagcgaaaggatgagcttggcgcactggctcacgacatgcattccatgtatatcaggctgaaagaaaccatcgcaaggctggaggatgaactcgcaagggaacatgagttggaggaaacacagcgatatttctctgcggcagcctctcatgagttaaaaacgcccatcgcgactgtaagcgttctgttggagggaatgcttgaaaatatcggtgactacaaagaccattctaagtatctgcgcgaatgcatcaaaatgatggacaggcagggcaaaaccatttccgaaatactggagcttgtcagcctgaacgatgggagaatcgtacccatagccgaaccgctggacatagggcgcacggttgccgagctgctacccgattttcaaaccttggcagaggcaaacaaccagcggttcgtcacagatattccagccggacaaattgtcctgtccgatccgaagctgatccaaaaggcgctatccaatgtcatattgaatgcggttcagaacacgccccagggaggtgaggtacggatatggagtgagcctggggctgaaaaataccgtctttccgttttgaacatgggcgttcacattgatgatactgcactttcaaagctgttcatcccattctatcgcattgatcaggcgcgaagcagaaaaagtgggcgaagcggtttggggcttgccatcgtacaaaaaacgctggatgccatgagcctccaatatgcgctggaaaacacctcagatggcgttttgttctggctggatttaccgcccacatcaacactataa

SEQ ID NO: 1232 - DNA (genomic), 1002 bp, Enterococcus faecium; double-stranded, circular
  misc_feature (B) LOCATION 1...1002
  hypothetical: NO
  anti-sense: NO
gatgcgatcaattgcattgtttctcatcagaaagggcgtatatctttgtcagaaaaacgagatttatttgaaaaactgttggaacaaatccaactagaggaagcagaaaaaaatcatccactgcttactgctggtgaaatggatagtgtagtggtccatcgtaaatcgcgtttatgggaatttacgctgcatttttccaaaattttgcctattatgctatatcggtcattgactcagcatctgactatcgcttttaaagatattgcacaagtcaaactgaatatcttagcagatgaccagacattcgatgaacagctcttgcaagattactgggcccaagctttggaaaatcagcaatgcgatacaccactagcacagcaagtattgaaaacgcaggtacctgtgataaaagatcgtaaagtcatcttgccaatcgacagtacaggagctatttcttatttgaagcaacaatacttgccattagtagaagagttgttcgtcagttacggattcccaaaatttcgtatcgaaccagaagtggatgagcagcaagcggaacgagtattgaaactttttgaagaacgcaaacaagaacaggcagaagcctttatgaagcaagcagctgaaagtctagttgtccacgaacaaaagaaaaaggaaagaaaagagcaatcgccagctcttgaaggacccatccacatccagctaggacgaaatattccagccgatgaaccaacgacaccaatgatcagtatcgttgaagaagaacgaagagtcacacttgaggggtacgtattcgacaaagaagtcagagaactacgttcaaaacgcaagatcttgactttgaaaatcacagattatacttcatcatttatcgtcaaaaaattctcgaacggcgaaaaagatgaacaagtatttgatgcgatcagtgtcggtagctggttaaaggtacgaggaagtattcaagaagatacgtttgtccgtgatttgttcagtgaatga

SEQ ID NO: 1233 - DNA (genomic), 189 bp, Enterococcus faecium; double-stranded, circular
  misc_feature (B) LOCATION 1...189
  hypothetical: NO
  anti-sense: NO
gtggcgatcaaatatttccgcatgggtttcacctcgcttttgtctgtggtttcgatttgtttttacactttactatacgcaagaggtgtgccaagtttttcgttatgggagaatgttgatgtggcggtgtttatgctggatgttgatgtgtttaaacagataggagattgcttaaacagatggtggtag

SEQ ID NO: 1234 - DNA (genomic), 192 bp, Enterococcus faecium; double-stranded, circular
  misc_feature (B) LOCATION 1...192
  hypothetical: NO
  anti-sense: NO
atcaagatcaatgggatgcagaaaaacaaagcatttatccattgtggtaaatattttaacaagaaaaagtcaaaaacaagaaacaatgtaagaaaaatggctagtatcaacgttaaaagattagctaatgaatgcgattctctacgtaaaactgtgacaccgttccaaaaaagaaaaacgatcaatccataa

SEQ ID NO: 1235 - DNA (genomic), 312 bp, Enterococcus faecium; double-stranded, circular
  misc_feature (B) LOCATION 1...312
  hypothetical: NO
  anti-sense: NO
ctaattgtcaaatcatcccaagatatgtcttcttcctctttttcttcgtggatgatttctgcattcggatctactggttttttcaataataaaatggttattcttgtgacaaaagaaccagttaacaatgcaccaatgaatgcccatggtctggtcatcgtagcgactgcaaacattccggatgccggaatacggctatctgcgccccaaaacatgcttaatccgccacctactgtcccaccgactcccgttgctatgacattgcgtgccaagtcgttcaatacgatagggaaacatccttctgtgatctga

SEQ ID NO: 1236 - DNA (genomic), 594 bp, Enterococcus faecium; double-stranded, circular
  misc_feature (B) LOCATION 1...594
  hypothetical: NO
  anti-sense: NO
atgcgagtcaaaggacaaaattcagttgataagaaatccatttttcagtttggaaaaccagaagaacgatctatcttggatttatttccttataaatcctgtacagaagagggagtcttagttactaaagaagatcattttcaacgttattatcgtgtagtttctacagacgtggaaggattaaatgaacaagagaaactagaacgaatgaatcagttgaccaccgtcatgcgtacgtatgtgccaacaattaagttagttagtttgaccacagagacggatttaacggaacaaatcgtacaaaagcggcagttattagataagaatcgtatggaacaatccttaggaagaaatctacagcgattaagaaaatatgaaaagaaattagtagaggaaatccaggaattgaaacgagcagaacaagaacgtcctgacttaagcttctttttcatcattgaaggaaggacaatcaaggatttacaaaccagaaaccgtcagttaatgcgatctagtggcattttagggttaaaaccactctacaaaaaagaattgatcaagattctgtatcgaatgaacaacatgaatgatgagtag

SEQ ID NO: 1237 - DNA (genomic), 438 bp, Enterococcus faecium; double-stranded, circular
  misc_feature (B) LOCATION 1...438
  hypothetical: NO
  anti-sense: NO
gaggtggtcaaaatggctattgttgttggtgcagatctcaaaggtacgagattaaaagatgttgtgaaaaattttcttgtagaagaaggttttgaggtaattgatgtgactaaggacggacaagattttgttgatgttaccttggcagttgcctctgaagtaaataaagatgagcaaaacttaggtattgtaattgatgcttatggagctggtccattcatggtagcaactaaaattaaaggtatggttgcagcagaagtttcagatgaacgctcagcttatatgacacgtggacataacaattcacgaatgattacggttggcgctgaaatcgtcggtgatgagcttgctaaaaacatcgctaaaggtttcgtcaatggtaaatatgatggcggacgtcatcaaatccgagtagatatgcttaacaaaatgtgttaa

SEQ ID NO: 1238 - DNA (genomic), 252 bp, Enterococcus faecium; double-stranded, circular
  misc_feature (B) LOCATION 1...252
  hypothetical: NO
  anti-sense: NO
acaaactgtttcgcaaaaaagaaaaaacagctagagaatacagtcgctagccgttactataaaaaagttttgaaagtgagttcagtcaaacgattgagctcatttttcgttggaatagaagaaatgtatacaatagggatatctagagaatctagagggaaattggaaatcaagatatctgttttttcaaaagaaatagtggaaagatcggttagttcgataggtaagaagcagacacgttttcctaagtaa

SEQ ID NO: 1239 - DNA (genomic), 804 bp, Enterococcus faecium; double-stranded, circular
  misc_feature (B) LOCATION 1...804
  hypothetical: NO
  anti-sense: NO
acttattccaataaaaaaggagttttatttgtgtcaaattatcgtgcaatcactttctttgatcttgatggaacattactagatgcgaagtcaaaaatcacacccgaagtggcaaaagctatgaacgcattaaaagaaaacaacgttcttcccgtcatcgccacaggacgtacagaagcagaaatccactcgattatggaagacgcgggcattacttctgcggtcaccatgaacggttctttcattcgagtaaacggtgaagaaatctactctcaaacattttcttcagaagaatgtcaaaaaatgtatgatcatgtacagttgaatgggcacgaactttcttactataacgaccagaaaatctggtgtaccggtcatagccaaacaatgatcgatgcttatgactttatccattcagatgtgccggaaatagatcctctaggctttaaagacaatacagtaaatatgttacttatcttatctcaatcgggtgacgaatactatcatgaacattttcctgagctaactttttatcggaatggtccttactcgattgatacagtgaagaaaggaatctcaaaaggcgcaggtgtcaaacgactgaaaaaagaacttcaattagaagaagttcctacttttggatttggcgatggtccgaatgattttgccttgttggaagcttgcgacaacaaaatcgctatgggcaatgcctatgatggattaaaagagctttctactttcatcacaaagaaaaatacagaggcggaaattgtccacgcattgaagcattttgatctgatttaa

SEQ ID NO: 1240 - DNA (genomic), 1260 bp, Enterococcus faecium; double-stranded, circular
  misc_feature (B) LOCATION 1...1260
  hypothetical: NO
  anti-sense: NO
actcattccaataaggaggatttcatgaagacaattctttttgctcctgcagtattcaatttagctgagacaacacgaatgattgaggttgccaaagctatgaaagaccgttattactgtgtattctttggcttttctaaaacttttgctcctttgatcacagaaagtggctttgagtatcatttactagcgccgatccttacgaaaaaacaagaagaacaaatcataaaatttgaccagttgcgtacacttaaaaacccttttaccaaagaaatggttgcctctcgtatcactagtgaacagagtctgattgctaagtttgagcctcgactgattgtgacaggttcgaatgtgacaatttttttatcggcccgcaataaaaagattcctttagtatatgttaaaccctatgctttgagtgaacctttttttcaatcagagcatgcgctgatgccccacgagttacgtttcttcggccctttaagcaatcccctttggcactggacaaaaaagcgtatagtaaatacccgatggatccccaatgccttcaaacacgctgcacaaaaagaaatgcttcctttaccaaaaacaagtttacaaatgatggatgctgatctaaatctcatcacaacgcctaaactatttttggaagaagaacagctgccggaaaattatcgaatcgttggtccaatttttgctaagctcagtacttccttgcctgaagaagtgctaacttttatacagcgaaagcaacaagaaagaaaacgtattatctatttcgcaatgggtagttcaggcaatccgcgtatgttacgcaaaattttgttcttcttacaaaaacaaccggatctagcggttattgcacctattgactatctgcttgatgacattcaatctgactcagaagatcttttaataacagaatatctgtctagtcatcttttgcatgaattcattgatttttcttttatccacggcggggaagggaccgtccaaactgcctgtgaatccggcaaaccgtttatcggtgtggggatgcaatttgagcaaagctgtaatattgactattgtgtaaaatacggaaacgcaatcgccctcacaaaaccagtgactgaaagaaaactgcagattgctctgcgcgaagtttcttcacccaagattcgtcagcaggcacgcacgctgcaagccgtttttccaataaatggtccacaacaagcaattcaagaaatcgaaaccttcctgagcaaccacccaatatag

SEQ ID NO: 1241 - DNA (genomic), 870 bp, Enterococcus faecium; double-stranded, circular
  misc_feature (B) LOCATION 1...870
  hypothetical: NO
  anti-sense: NO
ggagcatccaatggggcgaaaggttggctgcaaattgcaggattctcgatccaacctgccgaatacctaaaaatcatttctatctggtacctgtctctgactttatctaaaagacaaaacagtgtacaaaaagattttcttgggactgtgaaacgtccacttgcaatggttatcggacttactgcattagtcgctattcttcccgattttggtaatgcggcagttatctttatgattattttggttctgcttttagccagcggagtcaattatgtgtatactttgattgtaggagtaggaggcttttgtctaagtacttttacgatctggctgatcaatatcacaaacggaaagatcttacccggacgtttacagtatatctataatcgatttgctatttaccaaaatcctttctcagacgaattaaataaagggcatcaactagtcaacggctactatgccatgttcaacggaggactatttggcaggggattaggtaacagtatccagaaaaaaggatttttacaagaagcacaaaccgattttatttatgcaatcgtagtggaagaactgggagtgattatggggattttgatattagcgttgctattctttatgattgtgcgcattgtccttgtaggtatccgttcaaaagatccgttcaattcgcttttgtgcattgggatcggcgcaatgtttttgatccaagtatttgtcaatcttggaggaattactggcgttattcctttgacagggatcacgttcccatttttaagtcaaggaggctccagtttgctgatgctttcgatttgtgtcggctttgtcctcaacatcagtgcggatgaaaaacgcaagagcttaggtttataa

SEQ ID NO: 1242 - DNA (genomic), 1056 bp, Enterococcus faecium; double-stranded, circular
  misc_feature (B) LOCATION 1...1056
  hypothetical: NO
  anti-sense: NO
aacgctcccaaaaaggaggtgcatataaaattgaaacctactatttatgacattgcgaaaaaagctaatgtctcaaaatcaactgtctccagagtattaaataaccagccaaatatctctgataaagcaaaagcaagtgtacttcaagcaatcaaagaattgaattatgaaccgagcaaaattgcaagaggactgtcaggaaatggttttgacgcgattctagcattatctcatcgtacttctcatacgacctatggcaatccttttttttcagatgttattcaatccatttctgccgtttctgaacaaaataacttcgacttgattctacaaacggcaaaaacaccagaagaagagctagaaaaatgcgcgaaaaagatccaagaaaaaatgatccgaggaattattattttaagctctacgatggatgaaacacttctttttgaattggatcaatacaatattcctattgtggtaatcggaaaagtcggaaacgactacacgaacatctactcagtggacacggataatttccaggatagttacgatttggtggaaacactgatcaagaatggacaccgtcatatcggctgtctccatgctccgacagaagtttatgtatccaatgatcgtctcaatggttaccgtcaatgcttatttgatcaccacctagatatccgtaatgaatggattatagacggcggctttcgcttagaagatagcatggcagcaatgaatgatttaatgaagctacgagaaagaccaactgcgattttttctaccgatgcattaaaatcattgagtatttacaaagtggcagaacaatctggaaagcagatacctgatgatctttcgatcgcaggattcagtgatcccttattgtcctccctattttcgccacagttgactcggatagacattccgacaaatcagttaggaatcaaagccacagaacttttattccaactaatccaccaccaataccctgaagaaaaaagaatcattctttcaaccgagattactctcacagattcgatccaacaacaagaaatgtag

SEQ ID NO: 1243 - DNA (genomic), 1860 bp, Enterococcus faecium; double-stranded, circular
  misc_feature (B) LOCATION 1...1860
  hypothetical: NO
  anti-sense: NO
aagctacccaagcatttgaataaggaggaaatccatatgttttcaaacaagacaagacaagatagcattcaaaaaatgcagcaagaagaattggatctgttgatcatcggtggcggaatcactggtgccggtgtggcagtccagtcagcagcatcaggaatcaaaacaggattgatcgaaatgcaggattttgcagaagggacttcctctcgctcgaccaaacttgttcatggcggtattcgttatctgaagacatttgatgtggaagtagtagctgacacagttggtgaacgtgcagtcgtacaaagtattgccccacacatcccaaaaccagatccaatgcttttgccaatctatgagggcgaaggagcaacaaccttcaatatgttctcggtcaaagtagcaatggacctttatgacaaactggcaaatgtgacaggaaccaaatatgagaattatacgctgacaccagaagaagtattggaaagagaaccgtttttgaaaaaagaagggctaaaaggcgcgggtgtctatctagatttccgcaacaatgatgcccgtttagtgattgataatatcaaaaaggctgccgaagatggggcttatctagtaagtaaaatgaaagcggttggctttttatatgatggcgatcaaatcgttggcgtcaaagctcgtgacctgctgacagatgaagtgatcgaaatcaaagcaaaattagtgatcaatacgagtggtccttgggtagataaagtacgaaacttgaattttacgcgtccagtctctcctaaaatgcgtccaactaaagggatccatttagttgtagatgcgaaaaaactgcctgtaccgcaacccacatacttcgatacaggaaagcaagatgggcggatggtttttgctattccaagagaaaacaagacttactttggtacgacagatacggattaccaaggagattttacggatccgaaagtcacacaagaagatgtagattatctattggatgtgatcaatcatcgctatccagaagcaaatatcacattgaatgatatcgaagcaagctgggcaggacttcgtccactgttgattggtaattctggttctgattacaatggtggagataatggatcgatttcagacaagagcttcaataaagttgtcgatacagtaagtgaatataaggaaaacaaagtttctcgtgctgaagtagaagacgtgttgaaccatttggaaaacagccgtgatgaaaaagcaccttctacgatttccagaggtagttctttagaaagagaaccagatggtttgctgactttatctggtgggaaaatcaccgattaccgtaagatggcagaaggagctttgcgattgatacgccaattattaaaagaagaatacggaatagagacgaaagaaatcgactctaaaaaatatcagatttcaggtggaaacttcgatccaactaaattagaagaaacagtgacagaattagcaaaagaaggagtagcagccggtttagaggaagaagatgctacttatatcgctgatttttacgggactaatgcccgacgtatctttgaattagcaaaagaaatggcaccttatcctggtttgagtctcgctgagtcagctcggttacgttatggtttagaagaagaaatggttttggccccaggcgattatctcattcgtcgtacaaatcatctgttgtttgaacgagatcagcttgatgagatcaagcaacctgtgatcgatgcaattgctggatattttgaatggacagaagaggagaaggcgcaacagactaaacgtttagaagcattgattgcagaatcagatctgcgggaactaaagggggagaaataa

SEQ ID NO: 1244 - DNA (genomic), 192 bp, Enterococcus faecium; double-stranded, circular
  misc_feature (B) LOCATION 1...192
  hypothetical: NO
  anti-sense: NO
gttatgcccaaagatttgctcaattacgtgtcgcttcaaaagaatttgattgggacttgccatttggtgaaatcgcaaaaatctggcgcgctgggatgtatcatccgagctcgattcttgcaaaaaattacggatgcctatgacaaaaatcctgagatcgaaaaattaatgctagatgattacttccgttga

SEQ ID NO: 1245 - DNA (genomic), 402 bp, Enterococcus faecium; double-stranded, circular
  misc_feature (B) LOCATION 1...402
  hypothetical: NO
  anti-sense: NO
ttttgctgtttttgtgggtccacaagaaaaagaaaaaaggagaaacaacatgatgaggtgatttcgttgaaaacatcgatcttattgggagggattattgcaagtttgctgttcttcagctggcaagagccagtccaagcagataccaaaagttcaggtacgattacattttatgatctaagtccagttccgcatccaagtggttcagtcaatggcgcatcaaaacagcagacacagctaccgatttataaagaatctaatcaacatggcgtattcccggagacgaatgaagaaaagatccgttttctttatttgatcattggtatagaattatggcttcttgcgtggttgttgttatggagaagaaaggaaaaggaggatgaacatgttgctacaaaataa

SEQ ID NO: 1246 - DNA (genomic), 978 bp, Enterococcus faecium; double-stranded, circular
  misc_feature (B) LOCATION 1...978
  hypothetical: NO
  anti-sense: NO
ttgattaccaatgttaattctgggaaaggatctgcaagatacattgcaccctttcctttttcattggatttgcgctacaatgtgaaagtaggtgataggatgaattatttgaaacgtagcttaggcaacgcgtgggattttttgaaaggaacacaagcttatttccgtgatgtcttgctgatgcatggctttattttatttatttgtttacccttattgagcagtacgactcgttttattttgcaccgaggagcaattgactatttgtcttatgacaatattcctttgattttctctcagcatcctggagttctgctgtcgttaatcgccgttttattgacgattttactattggtttatttcgaatttgcatttcttttgatgagtgtcttctttattaaaaagaaagaacccgtttctttaaagcagctcttgcacttgacgatacttcaactgaagaaagtgagacctattacttttctgttttttcttgcttattttttattgattctaccgatcagcgggttaagtttcaattctgatctactgtcaaaaataaaaatccctgcttttatcatggattttatttttgctaaccgttggatcgtcgtcagttcctttttactcgtttacatttttcttggctatattgggattcggctgattttcgctttacctgaaatgattttacgagatcgaccttttcgagcatccattcgagaaagctggttgctgaccaaatcacgtctttttgctatcacggggcaatttatcgtgattggcggtacgattttacttctttcttctttgggatatatcgttgttattttggcacaaagtgttgttgaagaatttttcccgaattacgcattgatcagcgctgtatttgcgatgacgcttttacaaggaattttattattcaatatcgtgatgtctactgtaggaattttttatatcatccctggatttcatggatga

SEQ ID NO: 1247 - DNA (genomic), 390 bp, Enterococcus faecium; double-stranded, circular
  misc_feature (B) LOCATION 1...390
  hypothetical: NO
  anti-sense: NO
cttactaccaaatcaattaagaggaaaattttatcaaacgcaattaagaaaataggaggtttttctttgtatagcactgatccaaaaatgaaaaaaatacaacagattacgttgaaaatgtctcaagagattgttgatttttgtctaaaaaatcaacttctttgttatttctgcggtggtggtgccatcggtactgtgagagaacaagggtttattccatgggatgatgatttagatttctttatgcctagagaggattatgaaaaattttatcaactatgggttaattcagaaaaaagtaaaaaatatcccatacagaaggcttctaaaaattataatgatcataattcttttaccaatatccgcgatggcagatataacatttattaa

SEQ ID NO: 1248 - DNA (genomic), 1956 bp, Enterococcus faecium; double-stranded, circular
  misc_feature (B) LOCATION 1...1956
  hypothetical: NO
  anti-sense: NO
acaatgaccaagcttaaaagattagccacgaaggaagatgaaattgtagatgttaaaattccgatttcaaacgaagaattaaaagatagggctaaacaatatgatttattaactccaaaacgatttgcaacaaggtataacaaaatgttgttcttgccaacgtcttttaaatggaacggttctgaatatcccattcaatataattactgcatcaatccgttttgttgtaattttgggaaagaacagcacaaattcaaagatgtaaaagggaaaccaagtcgatataaaatgactggtagttccaaagataaaggtcataaaggtatgtactgcaatgacaatcctattggcagaggtgtatcgcaaaactgtacagtaacccctttatctaattggtctgttgttgaagaaattaaacgccttatagaaatcaatagcatccaagatgttgagccagattatcaatttcataaagaaggctgctcggaagaagaatcaaccccattcaatgagccgaagcaattttacaaaagggggaaaagtaggggcaaatctcaacgctatcaatgtaaggcgtgtaagaagttcactaatgttctaccaaaaagagaagaaaccactacttatcaccaacaaaagaacaccattcttccaatgttcgctaagatggttgttggaagggtttcagtcagtcgtacttgtgatattttaggaattggagttggaacctactatcataagctggagtggctgtataggcgttgtttggagtttttagaacgatatgagacacaaccccttcaaacaaagaaatttaacgagatgtggcttaatacggacaagatgcactactacctaaataacgtccgtaagaaaggacaaggttcaaagaaatatacggggtttgaagaccttaatatgcaaacgtatatagttgtatctgctgaggtcttatcaagatatgtgttccgttctgatgttgcctatgattggaatatttcaatggatgaattaaatgaagatacaagaaaattcaaagaagaccatctcaatacttttagtcgtaaaaatgataggttagattggtcttattatccacaagaaccatccgctaacgatagcgaaaataggaatgcttatcttcacgaattagggaaaattactaataggagtagatttgtcgatggtttaaatgttgatgctccttatactacaactgctcactattggttaattaaacaaatggttaatgccgacgaatggcgaatgattagtgatgatgacttctctattagaaacgccttttatagagtattcacgaaagaattaaggttgagcgatgcacatcattttatttgccaagttaacaagacgaaaagcagaaaacaatgcttaaaagaattcggacaagcaaaagcagaactgctcgattggggagatatcagaggattcaaaacaaagtttctacggactttggcatctcattatctaactgaattactaacaagtcatcaattccacgaagaggctattagtaaagatggagaaagatatcgcaaatatgccgataaccctatcaaacatccattagccactaaggataaaggattttattcagttgattgtagaacggatttatctgctctggaaccaaacgaaatcgcaaagatgctattaaatgttaatgaccattcgaccaatagctttattcaacagataagacgttatatatcatctcttgaaagaccattaacaacagctcgtggtgataagaagagctatatttacgctaacttcaatccgaagtatgctcaatttgcgattacaattctaagaacttactacaacttttgtcgcccttttaaatcagcggataaaaaggttttgacacctgctcaaagattagggattacagataaacaatttgattggaaagatataatttatttcaaatga

SEQ ID NO: 1249 - DNA (genomic), 222 bp, Enterococcus faecium; double-stranded, circular
  misc_feature (B) LOCATION 1...222
  hypothetical: NO
  anti-sense: NO
tccattgccaaggcagtaataaaagaaagaacgctagctattaccaaaccaagcactgcttcatttaatgtcgtgacagaatgggaaagtaatacttgtgcatctgccgctaatgcagaaaatacagcagcaggtccgggtaaaataaaggcaggtattttccaaactatgacaacaatctgccaaataattaaaatgaatgccatactgactgctggataa

SEQ ID NO: 1250 - DNA (genomic), 1020 bp, Enterococcus faecium; double-stranded, circular
  misc_feature (B) LOCATION 1...1020
  hypothetical: NO
  anti-sense: NO
tctgttgccaaaagagcaggaggatcaattatgaaggctaggaaaaaaaacaaactcttgcttttgatctgttttgttcttttgatcattttttttattgctctttcaaatggcgcagcgagtgtgggaaaaacagccttttggcaggctttggttgattttgatggatcaaaacaaagtcatcaaatcataagaaacattcgcttgcctcgggtcgcaggggcatttctcgtagggagttgttttgcattgagcggtgcattgatgcaaggtgtgacaagaaatccgttagcagattcaggtttactaggaatcaacgctggtgcttcgttggcaatggctcttagttttgctttttggcccaaagcttctgggttttctgtgtttctggtgtcattggcaggttcttttgctgtgactttgctcgtatttggctttttgcagttttcgaaaatgggcatgaatcctttacagctgattttagctggcgtagctattagttctttttttactgcaatcagtcaagcacttacccaattttttaatctacagcaggatcttgccttttggtttgtaggtggagctgccaatatcacatggaaacagttaacagtgttgttccctgtatatgtgcttgctgtcttggtttctttttcattaggaaaagcgatatccttgattagtttgagtgaaactcatgcattagctcttggaggtcgtcctaaacgaacacggttgattgttttctgtctagttgcagtgttagcagccattgccgtttcgttagtcggacctgtttcatttattgggctgttggttccgccgattgttcgcggaatggttgggacagactatcgttatgtcctacctgtctcttttttagttggaggcggactggttatgttggcggatcttgtagcaaggatgatcaatccaccttttgaaacaccttttggattagtcattgcattgattggcgttccgtttttactgatacaagtaaggagggaacgacggtga

SEQ ID NO: 1251 - DNA (genomic), 882 bp, Enterococcus faecium; double-stranded, circular
  misc_feature (B) LOCATION 1...882
  hypothetical: NO
  anti-sense: NO
aaatatgccaattggctgtttttcttttttgaaaatttcgttatactcttattcatggaggaaaatgttatgaaaagaatcttgacaattggcggttctgatccatttgctggtggaggaatccaaacagatttaaaaacttttgagaattttggtctattcggactaagcgccttgacttctataggggcactagatattaatgagcgatttatgctggaatctatatctttggaattgcttaaacgacagttagtttcgattgataaaatgacttcattagatggtatcaaaattgggttattgaattcaagtgaagcaatcatggttgttcgagacttcataaaaacaaaacaaaatatcccaatcattttagaccctgttttggcattcaaagaaactgaagctgtgatcaatcaattgtatatttcgcagctcatcgaagaactttttccacttgttacgatgattacgcctaatttggcagaagctgctttactttctggtcaagctcttccctcttcgttaacagaaatgatccatctcgctaaagaactcactgcttcaggaacaaaaaacattgtgatcaaaggcggcacaaggatggctggagatgaagctgtggatcttctctattcaattgatcattatgaggtattttctcataaaaaaatcgacactacaacagtaaacggggccggttgtgccttttcttctgcaataacagcgaatcttgtgttaggggcagattttaccaaagcagtagcagaaagtaaaaaatttgttgcccattgtatttctaatggcgtgctgatgaacgatcataccggaagtgtctggtctggcggtattcaaaaaggaggaatgagaaatgaaaactaa

SEQ ID NO: 1252 - DNA (genomic), 456 bp, Enterococcus faecium; double-stranded, circular
  misc_feature (B) LOCATION 1...456
  hypothetical: NO
  anti-sense: NO
ggaggtgccaaacctatgaaacttcatgaattaaaacctgctgaaggttcacgccaagtacgtaaccgtgttggtcgtggtacttcatctggtaacggaaaaactgccggacgcggacaaaaaggacaaaaagctcgttcaggcggcggtgtgcgtttaggatttgaagggggacaaacaccattgttccgtcgtttaccaaaacgaggattcacaaacgtgaaccgtaaagactatgcagtcattaatcttgatgtattgaaccgctttgaagacggagctgaagtaactcctgttgctttagttgaagctggaatcgtgaaaaacgaaaaagctggaatcaaagtattagctaatggggaactaaacaagaaattaactgtgaaagcagcaaaattctctaaagcagctcaagaagcaattgaagcggctggtggatcaatcgaggtgatctaa

SEQ ID NO: 1253 - DNA (genomic), 267 bp, Enterococcus faecium; double-stranded, circular
  misc_feature (B) LOCATION 1...267
  hypothetical: NO
  anti-sense: NO
gtcagctgtttgatttgctttttttgctgccatagtgttgccgaagcagtcaaaaatacaatcagtgcaccaatcagcgcagaaccgatgatcactaagatcaatggcgcagaaaaggaagtgaagccaaaacttacaggaacatttttattgttcaatacagcaaaaagaacaataatcaaaactaaaacaaatccaagaatcacattgctttgctttttcaattccttcacctactttttgttaaaaattccgctggctaaataa

SEQ ID NO: 1254 - DNA (genomic), 732 bp, Enterococcus faecium; double-stranded, circular
  misc_feature (B) LOCATION 1...732
  hypothetical: NO
  anti-sense: NO
ttgctttacaagaaaatcaaccaattactggaatctgaagaagtagaacctgcgaagctaatgaagttctgtccggtaaagaatcaagtacctatccgtaaagataattttgcctaccgtttagttcagcttttaaaggaacacggaaaagagtatttttggagttgggaaatgagccacatcggttatgataaatatgaagaaggaaatgcactgcttacgaaaaaaacattggaaagtcaggtccttaccgtctcccaatttcaaaagaaagaagattatcagacacgcaagatcttgattgggaaaacaaagatagatgatcaggacatttttgtctcgagctgccacttttcttggtggacagataaaaaaagtggcttttattttgagtggaaaaacttggaaaactactttttggaaactcgcgtaccactttttttcctaggtgatttcaataatccagtagactctcaaggttattatactgtaagagaaagttgccttcttcttcaagattcgtatgttgtcgcgaatgaaaaaggaaaagcagctactgtggaaaagaaaatagatggttgggaacaaaatacagaaaaattgcgtatagattttattttcgtccctgaaggaatgcaggttaaaaaatatcaacggatttttgatgggatcgatagtccaatcatcagtgatcactacggggtggaaatcgaattagatgtgaacgaataa

SEQ ID NO: 1255 - DNA (genomic), 309 bp, Enterococcus faecium; double-stranded, circular
  misc_feature (B) LOCATION 1...309
  hypothetical: NO
  anti-sense: NO
ttatgttacaaaaatgtttcaaaacaacttttaaaaatgacaaaactgttcgtttcagaaaatgatcatgaaaaagccgcgttaagtctagcatttcttaagataacaacgattctttttcgctttcgacctaaaaataaaaaaagaaattattcatcactgaataatttcttaaagggaaaaatgaataatacaaatataatcatgttcaacagcagtgtaggtcctaaaaaccttgtaataaaatacgtgttatttactactgctaatttaaaaatcaactggaccaccatcgtaaacaattcataa

SEQ ID NO: 1256 - DNA (genomic), 960 bp, Enterococcus faecium; double-stranded, circular
  misc_feature (B) LOCATION 1...960
  hypothetical: NO
  anti-sense: NO
atgacctacaaacatcttaccatagacgaactgacaatgatagaatcatattatcttcaacataataagccggttgaaatcgctaaccgaatgggacgtgctatacaaactatttataatgtagtcaataagttcaagcaaggcaagactgctcttgattattggcaccagtataaagaaaataagaaaaaatgtggtagaaaagtcattcaattacctgctcatgaagtagattacattaaagagaaagtcactcttggttggacgcctgacgtcattatcgggcgaaaagaaaggcctgtttcatgcggtatgagaacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagaaaagtgaatcagacatttatttccagtgtcagcaatcaacgtaatcatattccaagaaaatcattgaattacagaacaccaatcgaaatatttttgagctatgtacaagaagcattttattctagcttaatttga

SEQ ID NO: 1257 - DNA (genomic), 231 bp, Enterococcus faecium; double-stranded, circular
  misc_feature (B) LOCATION 1...231
  hypothetical: NO
  anti-sense: NO
atgacctacaaacatcttaccatagacgaactgacaatgatagaatcatattatcttcaacataataagccggttgaaatcgctaaccgaatgggacgtgctatacaaactatttataatgtagtcaataagttcaagcaaggcaagaatgctcttgattattggcaccagtataaagaaaataaaaacaatgtggtagaccagtcatccaataacctgctcatgaagtag

SEQ ID NO: 1258 - DNA (genomic), 960 bp, Enterococcus faecium; double-stranded, circular
  misc_feature (B) LOCATION 1...960
  hypothetical: NO
  anti-sense: NO
atgacctacaaacatcttaccatagacgaactgacaatgatagaatcatattatcttcaacataataagccggttgaaatcgctaaccgaatgggacgtgctatacaaactatttataatgtagtcaataagttcaagcaaggcaagactgctcttgattattggcaccagtataaagaaaataagaaaaaatgtgggagaaaagtcattcaattacctgctcatgaagtagattacattaaagagaaagtcactcttggttggacgcctgacgtcattatcgggcgaaaagaaaggcctgtttcatgcggtatgagaacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagaaaagtgaatcagacatttatttccagtgtcagcaatcaacgtaatcatattccaagaaaatcattgaattacagaacaccaatcgaaatatttttgagctatgtacaagaagcattttattctagcttaatttga

SEQ ID NO: 1259 - DNA (genomic), 384 bp, Enterococcus faecium; double-stranded, circular
  misc_feature (B) LOCATION 1...384
  hypothetical: NO
  anti-sense: NO
aaggcctacaagttaggccttttttctatgtatgaaaaggagaaatcatttatggataaatatattaacatgaaaaatcctccaagatttagtggggaatggaagttttttgcctttttctttttggatctattaacgcttggtggttgctttttttgggcgaaaatagtcaataaccttgtccatttaccactcttttttgcactcttgaattatggcttatggattgcgatagctctagtgattgtttggcgaccctataataacccaggtcaacgacaaatttttgcgattatcgagtctattttttttacggacaagaaccattatcatgcgttagatcctaaccgaaattatcatggtacgtataaggaggatgaataa

SEQ ID NO: 1260 - DNA (genomic), 231 bp, Enterococcus faecium; double-stranded, circular
  misc_feature (B) LOCATION 1...231
  hypothetical: NO
  anti-sense: NO
gttcgagtcctacaaggtccattgtggcgttgtaagtttcatatggaggattacccaagtccggctgaagggaacggtcttgaaaaccgtcaggcgggtaaaaccgtgcaagggttcgaatcccttatcctcctttttcatattatcgcgggatggagcagtctggtagctcgtcgggctcataacccgaaggtcgtaggttcaaatcctgctcccgcaattaaaaactaa

SEQ ID NO: 1261 - DNA (genomic), 639 bp, Enterococcus faecium; double-stranded, circular
  misc_feature (B) LOCATION 1...639
  hypothetical: NO
  anti-sense: NO
agaggagtcctaacaggaggatttcaaatgaagaacacccgtgtacagaaaatggttgcagtagcgatgtttgctgcgatcgcattagttttacagtattttgcttttccgatcatgccggcttttagttttttgaagatcgattttagtgatatctcggtattgatcagcatgttcttattcggtccagcggccggagttgcaacagcgttcttgcgttcagtattacatctgctgactacaggtttttctccggataatttggtaggagacactgctagtttcttatcaacaacgatctttacattcccgatttattatttctttagtgtaaagaaacagcataaaggaagaaacaaatttttaggtgtcattacaggaaccatcgctctaactatttttatgagtatcgcaaattatttcgttattacgcctctttacttaatgtttttagggctgaacgcaacacagatgctgggcatgtctttagcaaactatgtactgattgggatcgttcctttcaacttgatcaaaggattcatcgtgagtgctgtctttttagtgctgcatgcgcaacttcttccatggttaagtcgaaaacaacatcagttcgaacaacgtcatacagcagtcaaataa

SEQ ID NO: 1262 - DNA (genomic), 651 bp, Enterococcus faecium; double-stranded, circular
  misc_feature (B) LOCATION 1...651
  hypothetical: NO
  anti-sense: NO
agacaatacaacgatcgtagaaggttctggagaaaaagaacaatcgaagctcgtgtgcaattgatcaaaaaccaaattgctgaaacaacttctgattttgaccgcgaaaaattacaagaacgcttagctaaattagcaggtggtgtagctgttgttaaagttggtgcagctactgaaacagaattgaaagaattaaaattacgcattgaagatgcattgaatgctacacgtgccgcagtagaagaaggaatggtctcaggtggtggtacagctctagtgaacgttatcagcaaagtttctgctgtagaagcagaaggagacgtggcaacaggtatcaagatcgttgttcgtgctttagaagaaccaattcgtcaaatcgctgaaaacgctggttatgaaggatcagtgattgttgataaattgaagaacgtggaactaggcactggtttcaatgctgctactggagaatgggtaaacatggttgaagcaggtatcgtagacccaactaaagtaacacgttctgccttgcaaaatgccgcttccgtttctgccttgttattaacgacagaagcagtcgttgcagataaaccagaaccagcagcgccagcagctcctgcaatggatccatcaatgatgggcggtatgatgtag

SEQ ID NO: 1263 - DNA (genomic), 897 bp, Enterococcus faecium; double-stranded, circular
  misc_feature (B) LOCATION 1...897
  hypothetical: NO
  anti-sense: NO
actgaatacaacttcatagaaatttggtggaaaataaatatgaaaaaaaatttaaagtcattctttagagaaaacggacgctacgcagcagctagtttcctgattccgtttttgattttagcacttgtttatctaagtatcggaatctatcctggaagcagcagaagtattttggcaagtgatgccttttcacagttttctaattttcatgccagcttccgaaatgttcttcttggaaagcaaagtattttttatacatggaatgcttctctaggattgaattatttatctttaatttcttactatctaggcgggatcttcacgccactggtgttcttttttccaaaccagatgatgccagatgcactgtatgttctgactttgcttaaggtcggctgtgccggattggctttttggtttcttgcacgtacgttcaagattcctcgctgggggcatgttgcacttagcgtcagttacgcattgatctcatttatcactgcacattcggagatcatcatgtggctggatgcatttttttatcttccattagtgattttggggattcatcgtgttatggatcttaaacggccgaaacttttatttatcagttatttactcttgtttttatccagtttttatatgggttttatgattggcgtattttctttcttatattttatcgcccgtctattgacaaactggtcagaatataaaaaaacgattgttccttatggtatcacttctttactggcaggcggcgcttcaatgatcattgtattgcccagcagtgctggatcttcggtcaaatggcgaggcactgagtcagatcactacgttgaaaacagaagcgacttcttatctggatctaatcatgaaaaatatgattggtgtttatga

SEQ ID NO: 1264 - DNA (genomic), 1194 bp, Enterococcus faecium; double-stranded, circular
  misc_feature (B) LOCATION 1...1194
  hypothetical: NO
  anti-sense: NO
gagagatacaaagaatcaaggaggagtcatatggcaagttatatcgaaccgattcgttttgcgctgattgtttttccatttttagccttagcgatctcatctgttttttttatttatgaatatcgaaagtatggaacatttctagtaacaagggcagttattttgtattctttcgttttttatttattgtgtgcgtattttttggtgatcttaccacttccggcaaaggagacggttgcccaaatgacagggccaaagatggagctgcatttatttgcttcatggcaacatttcagagacaacacggtattggtcttgtctgaacctagtacctacctgccggcaatgaagcagagtgtatttttggaaccagcttttaatgttttattactcataccatttggcatttatttaagatattatttccggctttcttttatgaaaacgatgattgctagtttctgcctttctctattttttgaattgacgcagctaagtggactttattttatctacccaagaccataccgcttatttgatgtgaatgatttagtgacaaatacattgggtggaatcattggttttgtcgttacgctgttatttacatttatgcttcctacaagaagacgaatggatgaactttcttatgaaaaaggaaagactgtctcattgactcgacgcttggtcgcttatttgatcgactggacatttttatctcttattaatttggtagcggcgattttctttaaaattgcgttcgattcaggggcagttacttctcatatctggtggcttttattagaagtaggggtatactttatgattgtaccgtttataaccaatggatggacacttggcaaaaaaattgtgcgtatccgtttggtggaagaagaccgcgaacgaatttctttaaaagcattgatgatccgctacgggtatctgtactttcttttttatggtttaagctggttggggcagttgcttcagcaaatcatgaattcgacaacgaatacggtgttgcagatgagtgcagtattcatttctctcggtgtcttgttactacaaggtatttttattttaaatatcttgctatcatttttgagaaaaaaacggattctgttttatgaaaaagctagtcacacatatactgttagcacgattggccaaacaaaggatgatgattctcgaaattag

SEQ ID NO: 1265 - DNA (genomic), 945 bp, Enterococcus faecium; double-stranded, circular
  misc_feature (B) LOCATION 1...945
  hypothetical: NO
  anti-sense: NO
agaaggtacaaaatgaatcaggtgatcgaagaaacgaaaatctggcaaatgatggggacaacaattacattacaagttgggcatgaagagcctagtcgattactagcagagttaggcgaatggttgcacgtttatgaacatcgcttcagcgcacatgatgcaacttctgaattaatggccatcaatcaagctgctggacgacaagctgtgattgtacatcctgaactttttgagctcatcaaattaggaaaagcacatagttgtgcaagaaatagttatctgaatattgctattggtccggttgtacaaaaatggcacattggatttgaagatgcattggttccaacaaaagcagagataactgagttacttctgctaacggatccacaccaaattcaattagatgaaaaaatgaaaaccgtttttttaaccaaaccaggaatgatgattgacttgggggcgttagcaaaaggttacattgcagataaattaattacacattgccgagagcgaaatgcagcgtttgctttagttaacttaggaggaaatatcgttgtttttggtgaatcaccaagacgttcggatggtgcttggcgtattggtttgcgaaatcctaaaggttcacgtgaagagtcgcttgcggtggttaaactaaacaaccaatctttagttacctctggaatctacgaacgttatctacaaaatggttcgtcagtgtatcatcacatcattgatccgaaaactggctttccagttaaaaatgacgtagcaagcctgacgattttgtctgattcttctgtagatggagaaatctggactacacgtgtatttggagcatcttctttagaagtgttgaaagcgcttgaaaaacaaccgggtatccacggagcatttgtctcaaaagagaaacaattcttgtattccaaaggatttgaaaaaatttag

SEQ ID NO: 1266 - DNA (genomic), 768 bp, Enterococcus faecium; double-stranded, circular
  misc_feature (B) LOCATION 1...768
  hypothetical: NO
  anti-sense: NO
aatattcacaagtttaacgacaattatgaaaatttatgtcgtgctaaaggagttttgttattggatgaaaagttagatataaaaactgcgatcaaagacacgttacctaccgttttcggttatatcggtattggacttgcatttggtatcgttgggaaagctgccggatttcatccactagtcgtcacgttgatgtccctgctggtctatgctggttctgcccaatttatcacagtcagcatgcttgctagtcacagcccattgctttccatcgttttctcgacctttctagtcaattcccgaatgattctgatgagtatgacgattgctccttatttcaagaaaaatcggctgcttcaaaatctgctgattggcacattgctgacagatgaaagtttcgcactgggaatgaataaattgaactatactggacaaaagttaaactttcgttggatgaatacagctaattggatttcttatttgacgtgggtgggttcttctcttgttggcgcacttttagggaattttattactgatccgaaaaagtttggtttggatttcgccatcgtcgctatgtttatcgggttactttatcttcaagtcatttctgatagaaacacctctaaacgattacagttgatcctgattggtctcactttgattctggtatatgtcggactgatttttatcccaagcaacttagtgattgtagttgtaacactgattgggtgcggattgggggtgtggatcaaacatgccttcttttga

SEQ ID NO: 1267 - DNA (genomic), 348 bp, Enterococcus faecium; double-stranded, circular
  misc_feature (B) LOCATION 1...348
  hypothetical: NO
  anti-sense: NO
gataaacacaaagggggtgtcgagatgctgaatatgtactttgtttttggcgtacctatttttttactgttcctttatgctacgatcgcttatgtaagaaaaagaactacaattcattatttaggatttattctcctgattatttcgggtttcatgctagtcttcaatcttcagacttggcagcaagcacttcttgaaatggataaaatgactccacatgctttgtctaaagtgcttggctaccctgtctatctgatttggcttcccattttcatttctggttgcttggttttattaaatatttatcgcggcgtacgccgaatagttcagttacgcaaatcaaagtaa

SEQ ID NO: 1268 - DNA (genomic), 1437 bp, Enterococcus faecium; double-stranded, circular
  misc_feature (B) LOCATION 1...1437
  hypothetical: NO
  anti-sense: NO
atggaacacaaagaacttacctcatttccaaaagattttctgtggggctctgcttctgcagcgtatcaagtagaaggagcttggcaagaagatgggaaaggagaatcagtctgggatcgatttgtacggatacctggaaagacatttaaaggaacgaacggtgatttggcagtagaccactatcatcgttataaagaagatattgctttaatgaaagaacaaggtctgaaagcttaccgcttctctgtagcttggacacggatttttcctaatggacgaggagaagtcaatcaagctgggctcgctttttatgagagattgatcgacgaattgattgaaaacgatattgaacctatgttgactttatatcattgggatcttccacaagcattgcaagatgaatataatggttgggaatcacgtcagatcattgaagatttcactcattatgcagaaacattatttgaggcattccgcgggaaagtccattactggattagtttgaatgaacaaaatatcttcacttcattaggttatttgttagcagcacatccgccaggtgtgacagacccgaaacgaatgtatgaagttaaccatattgctaatttagcaaatgcatctgtcatcaataaatttcacgagttagaaatgcctggaaaaatcggaccaagctttgcgtatacgccaaattatccaattgacagtaatcctgaaaatgttctggctgctgaaaatgcagaagacctgatggccaattattggatggatgtctatatgtggggaaaatatccgattgctgccatgaggttcttagaagaaaaaggatgggcaccaacgattgaagctggcgatgcagaattgctagaatctgctaaaccagattttcttgggatcaattactatcaaacggcgacgaatgcattcaatccattaaacggagttggtgctggaaaaatgaatacgacaggaaaaaaaggttcatcagaagaaactggagttcctggaatgtataaaaaagttgagaatccatttgtcgaacgaacaaattgggactgggagattgacccagaaggattaaggatcggactgcgtcgtatcacaagccgttaccgcatgccggtactgattacggaaaatggcttaggagagtatgacaagttgacagaagataaacaaatccatgacgactatcgaatcaattacttacaaagccacgtcaaagccatcaaagaagcaatttcggatggagcagaagtcctaggctattgcacctggtcttatacagatttgcttagctggctgaacggttatcaaaagcgatatggatttgtatatgttgatcaagacgaaacacaagaaggatctttggaacgatataagaaagacagttattactggtaccaaaaactgattgaagaaaatggagagaacctttag

SEQ ID NO: 1269 - DNA (genomic), 912 bp, Enterococcus faecium; double-stranded, circular
  misc_feature (B) LOCATION 1...912
  hypothetical: NO
  anti-sense: NO
aggccgcacaaaacttcaaagatgagatcattcgtatctgggggtaaggaaatggctcaaattgggatttatgaaaaagcgttacccaaagatatttcatggaaagaacgtttttcccttgtaaaagaaatggacttcgattttatcgagatgtcgattgatgagacggatgagcggttagcacgattagattggtctgaagaaaagatagctgagctgagagaagagatgttcagctccggtgtacgtatccattcgatttgtttaagtgcgcatcggcgatttccgtttggttctgctgatccagaaaagaaaaaagcagcgaaacaactaatgaaaaaagcaatccatttggcgcataatctaagcgtcaaagtaatccaaatagctggatacgatgtttattatgaagagaaatcaatgaattccagagaagactttatcgaaggaataaaagaaagcgtaaaggaagcttctaaatatggcatcattctttccgtggaaatcatggatgatccatttatgaactccatttcaaaatttttagaaatcaaagaacagattcattcaccttttctacaagtatatccagacctaggcaatttgtccgcatggccggaaaataatccggctcgagaacttgagaaagggatcgattatatcactgctatccacttaaaagatacttaccctgtaacaaaagaatattcaggccagtttcgtgatgttccttttggtagcggttgtgttgattttcttggattattaagacatttgaaacgtctagattatgatggaacatttctgattgaaatgtggagtgaaaaaagccaagactttcgaagagaaatccagcaggcaaaagactacttaagttctaaattgaaggaggctggctatgatgtcttgtga

SEQ ID NO: 1270 - DNA (genomic), 951 bp, Enterococcus faecium; double-stranded, circular
  misc_feature (B) LOCATION 1...951
  hypothetical: NO
  anti-sense: NO
cagaagcacaaaatgccggaaagaaaggatgggaataaattgaaaaaaatcatgaatgatccaagcaatattgtcgaagaaatgctggaaggattagtaaaaagctatccagaacttgttcatcgtgtagaatcttcccgtgttgtagccaagaatcagaaagcggaacaagttggtttggtttctggtggaggaagcggacatgaaccatcccatgccgggtttgtaggggaagggatgttaagtgcagcggtgcttggtgatgtgtttacttctccaactccagatcagattcagacggctattaaggaagccgatagtggaaaaggagttttgctgatcgttaagaattatacaggggatgcattgaacttcgatatggcaaaggaattagctgctatggacgatattgaagtagaaagtgtgatcgtagatgatgatatcgccgttgaaaatagtacgtatactgctggaaaacgcggagttgcaggtactgtccttgtacacaaaatcgtgggcgatgcagcaagaaacggtgcttccctagctgagttgaaagaactgggagaaaaggtcgtacaggcaactaaaacgatcggtctagcgcttcgagcagcaactgtaccagaagtagggaaaccaggattcgaactaggagaagatgagatcgagtatggtgttggtatccacggtgagccaggctatcgtcgagaaaagatgcagccttctaaagtactggcaaaggaacttgttactaagattttagatgattactcgaatttaccaaaagaagcaggtgtactagtcaacggaatgggcgggacgcctttgatggaacagttcgtgttcatgaatgatgttttagctctgttggaagaaagaggcgtcaatgtagttttccgaaaagtcggtaattttatgacctcactagatatgcaaggctttctctaa

SEQ ID NO: 1271 - DNA (genomic), 942 bp, Enterococcus faecium; double-stranded, circular
  misc_feature (B) LOCATION 1...942
  hypothetical: NO
  anti-sense: NO
acgattaacaatgaatttaatttaggtgtaaatgaaggtagctctcaagtagcgaataatcagtatattttactgcatgaaacagctaacgaaacagcaacaggacgcaatgaagcacagtatatgcaacgttcatggactagtgcttacactgcttacattgtgggagacggcggaattgtttaccaagttggacaacttggttatgtgcagtatggcgctggttcatatgctaatgcaaatagtcctgtgcaaatcgagttacaacatacacatgataaagaaacttttgaaaagaactataaagtatacgttgaattggcaagagattcagcaatgaaatatggtattccattaacattagacactccttataaccaaccaggaatcaaatcgcatttatgggtaacacaaaatatttggggcgatcatacagatccttacggttatctttctgaaatgggtgtaagtaaagaaaaactagcctatgatttggctcatggttttacggatgataatccaactacttcggaggataaaccagtaattgatccaactcgagcaggtgctgcaaattctacgctgacagatggaacaaattacgcccacattgatcagttcggagaaatcgaaaacgcaaacttgcatgtagctggatggcacattgctaattataaatacgagtatattttcattatggactacaatactggaaaagaactagctagagtaagagctgatgggatttatagaccagacgtaaatcaagcttataatactttaggaaatgttggctatcatgtatctttcaatatgcgtgatttccctaataagaaagtatacgtcatgatgcgtgcgacaaacgatccagaaggaaatactaagggtggagcacaagattttcatgacaagccgtggtatttaaatattccacaacgataa

SEQ ID NO: 1272 - DNA (genomic), 480 bp, Enterococcus faecium; double-stranded, circular
  misc_feature (B) LOCATION 1...480
  hypothetical: NO
  anti-sense: NO
atggaggtcctgtgggccactgggatgcgcgtcagtgaattgattggattgaaattgggagatcttcatctttctcttggactggtacagacagttggaaaaggagataaagagcggatcattcctttaggtgattatgcgatccaatggctggaacgctacttagacgaagcacgtccattacttgtaaaggacgcatctgaaatgcatgtatttgtcaataatcatgggaaaggtctttctcggcaaggaatctggaaaaatctgaagcagttagtacgagaggctgggatttacaaagaagtaacaccacatacgctgcggcatagctttgccacacatctgctagaaaatggagctgatttgcggacagtacaggaattgttaggtcacgcggatatctctacgactcagatttatacacatatcacgaagaaaagaatgacggatgtttataagcagcattttccaagggcttag

SEQ ID NO: 1273 - DNA (genomic), 219 bp, Enterococcus faecium; double-stranded, circular
  misc_feature (B) LOCATION 1...219
  hypothetical: NO
  anti-sense: NO
agaataaacaaaaaggaggctatttttatgtacgacttgcacgatatcgttgaaatgaaaaaacctcacgcttgccagacgaatcgctgggaagtcattcgaatgggcgcagatatcaaaatcagatgtatgaattgcggacatatcgtcatgatgacccgtcgagattttgaaaagaaattaaaaaaagtaattgaaaaaaatgcagagaaagagtga

SEQ ID NO: 1274 - DNA (genomic), 183 bp, Enterococcus faecium; double-stranded, circular
  misc_feature (B) LOCATION 1...183
  hypothetical: NO
  anti-sense: NO
ttcgcaaacaaaaattttagcggaagaagcatctgggaaagagatggagatgggattcatttttatccatgggcaggatcatttaatgaccactttattgctgagagatctgattcaagactttattgtactgtacagacagaatcaaggataggagaagaacgctatggatggaatcattaa

SEQ ID NO: 1275 - DNA (genomic), 378 bp, Enterococcus faecium; double-stranded, circular
  misc_feature (B) LOCATION 1...378
  hypothetical: NO
  anti-sense: NO
gtcgcaaacaaaatacatctaaggagatgttaccacatggaaaaagaactttccactctagatcaatatttgattgatcctgattggggcaagccgaaaattgaggaaacaagtggtcgaaaaatcagatgtaatcttctgacagatgaagaactagcatgtgatcaagatgatttgggcaattttgtgagcatttgggatcatgtttaccttattcatctatcaaaacattcaaacaaacctgaatacatctatgtcatcgaagatggcttgattgatgcgctagaagagtatgacagagataacttgattgatatctcttattacggaccaggtaagaaatacattgctgaaatggaggcagaatttgatgagtga

SEQ ID NO: 1276 - DNA (genomic), 267 bp, Enterococcus faecium; double-stranded, circular
  misc_feature (B) LOCATION 1...267
  hypothetical: NO
  anti-sense: NO
aataaaaacaatcatattattctccttaagttaggatggttagaaatgtcactactatgtaaacttgtacctgaacgctgtattgcatgcggtctttgtcaaatcgaagcgccagatattttcgattatgatgaagaaggaatcgttttatttgcccaagaaccagaggctcatcaacagttcgtgatgccggaagaagaaacatatgtaaaaaaagcgtatcaaaaatgtccagttcgagcgattttattagaaaataaaatataa

SEQ ID NO: 1277 - DNA (genomic), 804 bp, Enterococcus faecium; double-stranded, circular
  misc_feature (B) LOCATION 1...804
  hypothetical: NO
  anti-sense: NO
atagaaaacaatagttttgattgtcgaccatttccaatatgcgctatactagcgttgaggatggtgatccacatgaaatcattgatttatgctattggggatgtccatggcaaacatgagctttttgaaaaacttattcactattatgatccaaagatccatcagcttgttttattaggggatctcaatgatcgaggtcctcgtacaaaagaatgttttttattaggaaagcaattagtcgaagaaacaggagccatttacctccggggaaaccatgaagaatattttttgcaatttctgcaatcaccggaggactggtatgcgccttatatgagaaatggtggaaaagaaacgtttgaaagcctgattcacccaggggcatcggaggaatactccccaactgaaatctcgatgatgatccaatcgagatattcagaactgattaaatttttagtccagcgccccttgtattatgaatgggaaaattatctttttgtccatgccggtgtggatttgacaaagaaagactggcgtaagacaagtctaagagactttatttggataagggaaccatttcatgaagggaaaaacaatacaggtaagacaattgtatttggacatacgattacaccaatgctccatggagatatgcagacaacagacctctggattcaggatcataaaatcggaatggacggtggggctgtattcggagggtcattgcatggggttgtttttgacaaggaaggtattcttcaagatattgaatatcagaacaacgaaggaccttggcatggaatctga

SEQ ID NO: 1278 - DNA (genomic), 285 bp, Enterococcus faecium; double-stranded, circular
  misc_feature (B) LOCATION 1...285
  hypothetical: NO
  anti-sense: NO
tggcagaacaattttttcattgtaaaaattgttcagttgttaatctatgggatttcggtagcatgggcatttttttatagaggaatcacaccaacctggccgttttatctcttgttagtgggaatattagtaggaaattttgcccctcttcactatcgtacgaacttttttccaactgattctggcctttttcttaaaacaaagacgcgaaaattagaaaacattattgaaatgacaattacctgtataatcattttcttagttatattcctaaacgtcttctaa

SEQ ID NO: 1279 - DNA (genomic), 1140 bp, Enterococcus faecium; double-stranded, circular
  misc_feature (B) LOCATION 1...1140
  hypothetical: NO
  anti-sense: NO
ctaaagaacaaattttaccgattaaaacaattattggaggcgtcatatatgacaattagctatggaaagtttgatttaaaagaagtcattaatgcatcgggaaaaatgacgatcctaggggtttctaaggtatctgaaagtgtcctagcagcacaacgatttggaggcgagcatttttttgagatgagtgatcttgccatcaaaaccggcgcttatctttctcaattactgaaagtggaagatgcgcaaatcgtttcttctgcttcagcagggattgctcaatctgttgctgctttaatcggacagggcgacatgtaccatgtctatcatccctatacagaaaaaatcgctagacgggaaatcatcatacctaagggacataatgtagattatgggacaccggttgaagtaatggttgctcaaggtggaggaaaagtcatagaagctggctatgcaaatatgtgtacaccggaacatgtttccatgatgattacggaaaaaactgctgcgcttctatatattaaaagtcatcatgcagttcagaaaagtatgctgacggtggcagaaatggtagaagttgccaaagctcatcgtttgccattgatcgttgatgcagctgcggaagaagatttattcaaatatagcgaaatgggcgttgacttagtgatttactctggggcaaaagcaatcgaaggtccgagtgccggactggtcataggaaaaaagaagtatattcaatggattcggctacagtctaaaggtattggccgagcaatgaaaatcggtaaagataatattttaggctttacccaggcactagaagattatttaaaaaatgggagcgaatccggtgactccatgaagcaacgattagcgccttttgttaacgcaatcaatcaacttcctgacctttcagcgaaaatagttcaagatggtgccggcagagatatttatcgagcaagtgtaacgattaatggcgataaaagtgcgaaagaagtcattcaggaattaaaagcacgaaatccagcagtctacacccgagaatatcaagcaaataacggaatcattgagttcgacattcgttccgtcagccaaaacgaaatggaaaaaattataaaaagattgagagaaatcatgtag

SEQ ID NO: 1280 - DNA (genomic), 906 bp, Enterococcus faecium; double-stranded, circular
  misc_feature (B) LOCATION 1...906
  hypothetical: NO
  anti-sense: NO
actaggaacaagaagcagaaaggaacgataatcattatgatcaaattaattgcatcagatatggacggcacattattagatgcccatatgagtgtttctcctgaaaatgccgaggcgatacgttttgcaaatgatgccggtgttgagttcatggtcgctactggtcgaaactatcaagaagctcgcgcagctttagatgaggtaggaatcgattgtgcgatgatcactttgaacggggcacaggtatttgataaagaaggaaattcattgtttaccgtgtcgattccaaataatcaagcaatctctgttttagatattctagatgctaacggtatttactatgaagtagcaaccaacgatggtctttattctgaaaatcaagcgaaacgaattgaaagttttgcttccatggtggctacccatttacctcaccttacgtataaaatggcgattgccatggcctcagctaagctggagttattgcacatcacatacgtggacagtattcgtgctattttggaagaaaagaatctggaagttttaaaaattatttgttttcatacagaagggccagctgtattaggtccagttggaaagcagatttctcttttaggcgatctagccgttacttcctctggtcaaaacaatatcgaagtgaaccataaaaacgctcaaaaaggaattgctgttgcccatgtcgctcacgagcgtgggatttctttagaagaagtcatgacgattggcgataacttcaatgatgtcagcatgctgcaagtagcaggagtcagtttcgcaatgggaaatgcagaaatcgaagtaaaagattatgccaaatatacaacggacacaaaccttgaatctggcgtaggaaaagccatattgcgcgcgattgcagaagacttgtag

SEQ ID NO: 1281 - DNA (genomic), 267 bp, Enterococcus faecium; double-stranded, circular
  misc_feature (B) LOCATION 1...267
  hypothetical: NO
  anti-sense: NO
tggaggaacaacatgagtgaatatcgtgaaattgcgacaccctctagaacaaaagagattttattgaaacatggtttttcatttaaaaaaagtttaggacaaaattttctgactgaaccaaatattttaaggaaaatcgtagaaactgcgcaaatagatgaacatacgaacgtgatcgaagttggaccaggaatcggtgcattgacggaacaattacccaagcatgcaatacaagtcataagccttgataaatcaccatggttcgca

SEQ ID NO: 1282 - DNA (genomic), 1059 bp, Enterococcus faecium; double-stranded, circular
  misc_feature (B) LOCATION 1...1059
  hypothetical: NO
  anti-sense: NO
aggaggaacaagcacatgtctctacaagcacaattagagagcttgaaagaagcaacgctcgtcaaaatcacagcggcacaagatttaaatgaattaaatcaaatacgtgttgaaacgttaggaaaaaaaggaccgatcacagaagtattacgtgggatgaaagatctaagtccagaagagcgaccaaaagtcggaagtttcgcaaatgagatccgagatcttttgacagaagagatcgagcgaaaaaaacaagtattagaagaagaagcgttaaatgcagctttggcaaaagaaacaatagacgtgacactacctggtagaaaagtaaaacatggtacacgtcatatcgtgacacaaatcatggaagaaattgaagatatttttgtgggtatgggctatcagatcgtagaaggatatgaagtagaatctgatcattacaatttcgaacggatgaatctgccaaaagatcatccagcaagggacatgcaagatactttctatatttcagacgagatattgattcggacacatacttcaccagtccaagcacggacaatggaaaaacatgatttctctaagggtgctctacgaatgatctcgccagggaaagtcttccgcagagatacagatgatgcgacccacagtcatcagttccatcaaattgaagggctagttgttgataaaaacatcacaatgggcgaccttaaaggaacattagaagtcgtaatgaaaaaaatgtttggggaagatcgtgaaattcgtttgcgtccaagttatttcccatttacggaaccatcagtagaagtagatgtcagctgtttcaaatgtggtggtgccggttgtaacgtatgtaaatacactggatggatcgaaattttaggagctggcatggtacacccgaatgtgttgaagatgtcaggaatcgatccagaagaatattcaggctttgctttcggccttggaccagaccgcgtagctatgttgcggtatggagtgaatgatatccgtaatttctatcaaaatgacttacgtttcttaagtcagttcaagggggagtaa

SEQ ID NO: 1283 - DNA (genomic), 228 bp, Enterococcus faecium; double-stranded, circular
  misc_feature (B) LOCATION 1...228
  hypothetical: NO
  anti-sense: NO
ctttttgacaagcgaactagtcgatccgctggaaaaagaagcaaccggcaaactattgacttatttatcggtgacacaaaagcggagtttagctcatatccaaaaagcagtagaataccaaccagatcattttttgaaaatggattattattcaaaattcaacctagaattaagccaatctattcggactgggaaaaagcacggcactcttctatggttgttagatga

SEQ ID NO: 1284 - DNA (genomic), 2070 bp, Enterococcus faecium; double-stranded, circular
  misc_feature (B) LOCATION 1...2070
  hypothetical: NO
  anti-sense: NO
aggaatgacaagcaagagaaggaggaaaaaatgaaaagaagtgacaagcacggcaaaaatcgaacaggcgcttatattgccggcgcagtgatcttaatagcagctgcgggtggcggttatttttactaccagcactatcaagaaacccaagcagtagaagctggagaaaagacagttgagcaatttgtccaagctttgaacaagggagattataacaaagctgcagaaatgacatcaaaaaaggcggcaaataaaagtgcattatctgaaaaagagatcttagataaataccagaatatatacggtgctgctgatgtcaaaggacttcagatatcgaatctaaaagtagataaaaaagacgattctacttacagtttttcatataaagcaaagatgaatacctcattaggtgaattgaaagatctttcttataaaggaacattagacagaaatgatggtcaaaccacgatcaactggcaacccaacttggtttttccagaaatggaaggaaatgacaaagtaagcctgaccacacaagaagcagcaagagggaatattatagatcgaaatggtgaaccattagcaacaacaggcaaactaaaacaattaggagtcgttccaagtaaacttggagatggaggcgaaaaaacagccaatatcaaagcgattgcttcctccttcgacttaacagaagatgctatcaatcaggcgatttcacaaagctgggtacaacccgattactttgtcccattgaaaatcattgatggagcaacgccagaacttccagctggagctaccattcaagaagtagacggcagatattatcctttgggtgaagcagctgctcagctgattggttacgtgggagatatcacagcagaagatattgataagaatccagaattaagcagtaatggaaaaatcggtcgctcaggtttggagatggcttttgataaggatcttcgtgggacaacaggtgggaaattaagcattacagatgcagacggtgtagagaaaaaagttctgatcgaacatgaagttcaaaatggcaaagatatcaaattgacaatcgatgcgaaggcacaaaaaacagcttttgaccgtctaggaggaaaagctggatcaactgttgcgacaacgccaaaaaccggtgatcttcttgcgcttgctagctctccaagctatgatccaaacaaaatgacaaacgggatctcacaagaagattacaaagcttatgaagaaaatcctgaacagccattcatcagccgatttgcgacaggttatgctcctggatctacgtttaaaatgattacagcagcaatcggtctcgacaacggcactatcgatccaaatgaagtgttgacgatcaacgggcttaaatggcaaaaagacagttcttggggatcttatcaagtaacgcgtgtcagtgatgtatcacaacaagtagacttaaaaactgctttgatctattccgataatatatatacggcacaagaaacgttgaaaatgggtgagaaaaaatttcgtacaggcttagataaattcatttttggtgaagaccttgatttgccaattagtatgaatccagcacaaatttctaatgaagatagctttaactcagatatcttgctagctgatactggatatggacagggcgaacttctaattaatcctatccagcaagcagcaatgtattctgtttttgccaacaatggcacacttgtctatcctaaattgattgcagataaagagacaaaagataagaagaatgtcatcggcgaaacagcattacaaacgatcgtgccagatctgagagaagttgtgcaagatgtaaatggtacagcacattctctttctgctttagggattccgttggcagcgaaaactggtacagcggaaatcaaagaaaaacaggatgtaaaggggaaagagaacagtttcttgtttgctttcaatcctgataaccaaggttatatgatggtcagcatgttggaaaataaagaagatgatgattcagcaaccaaacgagcatcggaactattgcaatacctcaaccaaaattatcaataa

SEQ ID NO: 1285 - DNA (genomic), 996 bp, Enterococcus faecium; double-stranded, circular
  misc_feature (B) LOCATION 1...996
  hypothetical: NO
  anti-sense: NO
aaaggtgacaaaatgggcataccagttacaatcgtttctgggtttttaggggctggaaaaacaacgctaatcaatcaagccttgcaagtctcaccctaccccagggaagaaattattataattgaaaatgagtttggtgaagttgggattgatcacaaattattagttcatagcgaggaacgggtgttacaactaaataatggatgtatgtgttgcagtcttcgcagtgatttattagcaatattgatttctttactggaaacaatagaagaacatcaacaaccaatttcacaaatcatcattgaaactacaggtatagcagatccccaaccaatcattcaaacacttttaacagcgcctcaactaagaggaagagtatatatcgatagtttattgactgttattgatagtgacagttttgaacttattgaaagagaaccacaagcccttaagcaacttgtcatggcagatcgcatttttgtgtctagaaaacaaaacttgaatttatctgcactaaaaaaattacagagagaaatcaaaagtattaaccctttatccgatattcgaatgttcacacatagtgaaacgattcaaaaaaaggatttttataatttgaaaaaatttaatcatcccttagtttttgaaagtgattcatcagaaaatcactataatggcaaatactatcatcaacaccatcaagtacatgagtttaaatcaattctcttaacttcagatcaagacataaaaaaagattttttactccaatggattgactggctgattttaaccaaccaagggagcctgtatcgttttaaaggattgattgctttacaagagcaggattttatagttgccatgcaagaggtaaacgaacaggttaattttcaatacaccactcgacaaaaagaccaaaccactattattctaatcggaaaaatgttggatgaagaaaggatcaaacagagttttgataaattactggcggaaagcaaataa

SEQ ID NO: 1286 - DNA (genomic), 527 bp, Enterococcus faecium; double-stranded, circular
  misc_feature (B) LOCATION 1...527
  hypothetical: NO
  anti-sense: NO
ccatcgacaacctcagcggcaagttgctggaagagtttattgtggtggcggtagtctgtgcgctgtttctctggcatgtgcgctcgggcgctggtggcgattatttcgttgccgcgggggtagtgtattgcttttatgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatggggcactggatccgcattcagccg

SEQ ID NO: 1287 - DNA (genomic), 726 bp, Enterococcus faecium; double-stranded, circular
  misc_feature (B) LOCATION 1...726
  hypothetical: NO
  anti-sense: NO
gaacacgacaatgggaaaggagtccatacagtaatggcgtataaatatttagtgattgtagaatcacctgcaaaagccaagacaattgagaaatatcttggacgaaactataaagtaatggccagtgttggccatataagagatttaccgaaaagtaaaatgggtatcgattttgaaaacaattatgaaccccattatatttctatacgcggaaaaggcgatgtcatcaaaagcctgaaagccgcagcaaaaaaagctcaaaaagtttacttggcaagtgacccggatagagaaggagaagcgattgcttggcatttagcgtacctacttgggttggatctgaaagaaaaaaatcgggtggtcttcaatgaaatcacaaaagacgcagtcaaagcagcttttaaggaaccaagaacgatcgatgtagatttagtagatgcacagcaagctcgtcgtaccttagacagaatcgttggttattcgatcagtcctattctctggcgtaaggtcaagaaagggttaagtgcaggacgtgtccaatctgtcgctttaaaaattattattgaccgtgaaaaagagatccgagaatttgttccagaagaatattggagcatcgacggtaattttaaaaaagctcgcaagaaattcaaagcaaatttctggggaatcgacggtaagaaaaagaaattaccagatgcacaaagtgtaaaaagaagtcactgctag

SEQ ID NO: 1288 - DNA (genomic), 1236 bp, Enterococcus faecium; double-stranded, circular
  misc_feature (B) LOCATION 1...1236
  hypothetical: NO
  anti-sense: NO
agtcaagacaatcaagggaatttaataggtaaaggaatgaatgggatggagttatcaaaaagaacgaaacgattagaaccatctgttactttggcagctgcggcaaaagccaaggcgttaaaagcaaaaggaagagatgtgctgagtttgactgtgggagaaccggattttgcgacaccagaaaacatccaagaagcagcaatcgaagcaatccgtaacggaaaagctagctattatacaccaacagcaggaatcccagaacttcgacaggcgatcgttgattatctgaagaaaaacgatggacttgtctatgaatcttcacaaacggtcgtaacagatggcgcgaaatttgctttgtatacactttttcaaacaattctggacccgcaagatgaagtcatcattcctgtgccttattgggtcagttacggcgagcaagtgaaactggcagaaggcctgcctgtctttgtgaaagggaaagaatctaataactggaaagtcactgttgaacagttagaacaagcacgttcaggaaaaacaaaagccgtgatcatcaattcgccatcgaatccgactggaatgatttatagcaagaatgaactgcaggcaattggtgaatgggcagtaaaaaatgatattttgatagttgctgatgatatttatggtcgtttagtttataatggcaatgagtttactccaattgcaacgatttcagaagcaatcaaaaatcagaccatcatcataaatggcgtgtctaagacctatgcgatgacaggctggcgcatcggttatgcggttgggaatcctgaaattatcaatgggatgatcgctgttgcttcccaatcaactagcaatccgaccgcagtcagtcaatatgcagctgttgaagcattgaaaggtgagcaagatacagtagaagaaatgcggaacgcctttgaagaacgcctgaatacgttatatccgcttgtggcagaactaccaggtgtttctcttgaaaagccgcaaggagctttttatctttttcctaatgtaaaagaaacgcttcgcatgtgtaagtatgaaaatgtcacacaatgggtagaagatcttttagaagaaacaggggtagcacttgtgactggcgaaggatttggggcaccagagaatgtccgcatgagttatgcgactgatcgggctacgttagaagaagcggtacgcagaatcaagcaatttattgagagtaaaagtcaaaattaa

SEQ ID NO: 1289 - DNA (genomic), 891 bp, Enterococcus faecium; double-stranded, circular
  misc_feature (B) LOCATION 1...891
  hypothetical: NO
  anti-sense: NO
gattcggacaatcggattcgaggaggaaaacgaatgtatggcggaatagaagcaggcggaacaaaatttgtgtgtgcggtttcagatggtggagaaattttagaaaaattaagtatccctaccacaacaccagaagaaacattggatcaggtatttgaattttttgatcgttatgaattgaagggaatcgggattggctcattcggcccgattggtatcgacaaaacaaaagataattacggatacgttttggcaactcccaaaaaagggtgggcacaattcgattttcttggcacaatcaaggaacgctacaatattcctgctgcttggacaacggatgtcaatgctgctgcatatggggaattgaagcaaggagcagcacaaggaaaaaatagttgtatttaccttaccgtgggaacaggaatcggtgcaggtgtcgtgatcaatgaagaaattttttcagggatcgcacatcctgaaatgggacatatttgggtgaaacgccatccagatgaccattatgaaggtacttgtccttatcataaagattgtttagaaggattagcagcaggaccgtctattgaggcacgcacagggatcaaagggcaagatctgccgcaagatcatcctgtttgggctattcaggcttattatattgctcaagcactgatcaactatacgttgacgttagcacctgaaaagattattttaggcggtggggtaatgaatcaggatcatctccttcaaaaaatccgtcagcaatttgttgaattgatgggtggttatatggaaacacctcaagtaagtgaatatatcgttcgttggggactgccgaatgaaagtgggattatcggtagtttgctgttagcagaacacgaacatcaaaagtaa

SEQ ID NO: 1290 - DNA (genomic), 486 bp, Enterococcus faecium; double-stranded, circular
  misc_feature (B) LOCATION 1...486
  hypothetical: NO
  anti-sense: NO
aaggaggacaacatgggacaccctaaaatattacacgatacaaaaggcaatatatcaagtgaagaaaaagcaatccgtgtggacgctagagaagaattgttcaagcagcaaccattaataaatatcacgccccctgactggatggcagcgagcgctagaagtgaatggaatcgtatcgtaccaacattaaaaaaagattatccattgagtgaagcagattatggttcattggtagcctattgtttagcctttgctcgaatgaaaacagccgaagccgagataagaaaatcaggtacgtttatcacatgcgaaaacggagtaaagaaagccaatccagcggttcgggttcaatcacaagctatgagtgatttgaaaaaacaagccacctcactaggtatgaccttagaatcacgatcaaaactagctttgaacaaggttaaaaatgatgaacccgaagacccgttcaaagagttgatgaattcatga

SEQ ID NO: 1291 - DNA (genomic), 279 bp, Enterococcus faecium; double-stranded, circular
  misc_feature (B) LOCATION 1...279
  hypothetical: NO
  anti-sense: NO
cagggggacaataattattcgaaaaaaggggactgtgacaaaagccgtgtcacagtccttttttttcgaataaacggtgttcaaaagcttgcatctgcggtaataagtccagccaagttaaaaacattaggagctgtttttacttggctgttcttattacttgatgcagaacagcttttttacaacctctccaataaacgatgttcaatcagctgtccctcgatattagctcaaaaaacggcaaaatatgaggaactatttttccgtttgtttctctaa

SEQ ID NO: 1292 - DNA (genomic), 1464 bp, Enterococcus faecium; double-stranded, circular
  misc_feature (B) LOCATION 1...1464
  hypothetical: NO
  anti-sense: NO
aagagttgcaagatatcgtggataaagcaaaagaaaataataaagagaataataaagaaaacaattaagaaacaaaaaggaggcatttccttggaaaatgcttggaaagagcttcaaccaaaaaatatttaccaaggaagaaaagcggctccgctgagagaagacagcaagaacgccttgctgtatctttatcagccactaatcggcggagaagccttgagtatctatttcaccctgttatcagaaatctctcaagaatctggcaaaggtcctgaagggatgcatgcagatctgcttagtagtctaggctgcggtatcccgcaattttatgatgcaagaaaaaagctagaaggaatcggcttactggatgtttattttaaagaagatagtgatctgggacctcgttttatttatgagctgttagaaccactcattcctaaagcatttttcaaagactctgttctggcttttcttcttctggaaaaagttggtgaacgacgattccagaagcttacccaattctttgaacctaaaaggcatacagcagagggatatcaaaaaatcacaaaaaaatttttagatgtttatcgcttcaatgaagcagtgtacgctgctaatcaagaaaacatcgaatcgctgaataaatcttttgaagaatctgaatcagtagcattacttgaagcagattcgacattcgattggcagtttttgaatgattggctggcaaaaaaacatattgcaagtcttgatgatccaatcatcaaacaagtcgacatgtatcatcagctttacggtttcgatgaattgacacttggcgaactgatcagtcaatcttatgactttagtgaacaaaaagtatctgaaaaagaactgcaaaaagccattttggcaatgcagagacgtccggtgaagcaaacaaaagaaacagttgcggtttctgaaaacagtaatgaaccctcgtcaaacgaacatttgacaaacgcagcgcttcagctgataaaagaagcacagagcattccaccgatgaaatatctggaagcaatcaagtcagaaaaaggcggatatgtttctaaacaagaaaactggttactgcaagatcttgtttctcaatcaggtctttccagtagcgtgatcaatgttttgctgaattatgtactagtgatcaagaataatgctagcttaaatgccagttatgtaaatacagtggcaaatgaatgggcacaaaagaaaatcgccacagcagaagaagcgatccagcacattcggcaaataagtaatcaagcaaaacaatcaaaacaaaagaagcaaacaaattatcaaactggcaagcgaaatgttcgacgggaaaagcttcctgattgggtcaaccagccaaaagatgaaaaacagatcagcagcgagaaaaaagcagagattgaccgccgttttaaagaatacctggcaaaaaaggagggtgatatctag

SEQ ID NO: 1293 - DNA (genomic), 1005 bp, Enterococcus faecium; double-stranded, circular
  misc_feature (B) LOCATION 1...1005
  hypothetical: NO
  anti-sense: NO
cggctatgcaaaattattcgtaaggaagtctgtaaaatgaaaaaaatacttgtactacacaccggcggaacgatcgccatgaaagaaaacatgctcacgggcggtgttagtcctgatgtggcaaacccattattagatgcagaaatcacaatccccaagcatgtagaattattagttgaagatatcttcaatcttccctcaccacacatcatgccttctcacatgttggtattaaaagaacgtatcttgtccgcttatgcatcaggtatatccggagtggtgatcacacaccgtacagatacattagaagaaactgctttttttcttgatacaacgattggcaacaaattaccaattgttttgactggggcaatgcgttcaagtaatgaacttggaagtgacggcctttataattttgaaagtgcgattcgtgtcgcaagttgtgaagaagcgctagataagggggttttggtggtcatgaacgatgagatccattctgcacgctacgtgacaaagacccataccacaaatgttgctactttccgaacacctacattgggtcccatcggcttagtaactaagaatcgaattttattcttgcaggaacttttagaaacaaagcgactggacatttccgctgtagatgggactatcccgatcgttaaagcatatgctgggatgcaaggggacttattggaagccatcgcccatacgaaagtagacggtttggtaatcgaagctttaggtgcggggaatctccctccacaagccttagctgctttggaaaagcttcttgtccaaaaaatccctgtagtacttgtttctcgttgtttcaatggaatcgcagagcctgtttatgattatgaaggcgggggaaaagaactagaaaaaatggggattattttctgtaacagtattaatagtcaaaaagcacgtgtaaaactattgattgctgtaaactatggtttgtcgggtgaagaattgatttcgtttatccaaaactaa

SEQ ID NO: 1294 - DNA (genomic), 501 bp, Enterococcus faecium; double-stranded, circular
  misc_feature (B) LOCATION 1...501
  hypothetical: NO
  anti-sense: NO
caactccgcaactacttatatgggggacaaaaaatgatcgaagaactaaacaagaaagatttaccatggtccttgttattagatgcagatcctgataaagaaaaagttcaagtatatgtttccagagggagtggctggatatggaaagaaaaagaaaaaacaataggtgtactgatctatgtggcaagggaaaaagaatacgaaatcgtcaatgtagcagtagccccaacgtatcaaggaaaggggattggcggaaaattacttgagacagcttttcagaagctttcacaactcgcttccagtcaaactcagatcatcatacgaaccggcagtactagcagtgcggcgttacatctctatcaaaaaatgggctatgtggagattggtcgagtcaaagactattttatccatcattactctgagcccatttttgaaaatggagatcaattaagggatcaagtaattttagcaattcacttacctaaaaatagctttaactaa

SEQ ID NO: 1295 - DNA (genomic), 183 bp, Enterococcus faecium; double-stranded, circular
  misc_feature (B) LOCATION 1...183
  hypothetical: NO
  anti-sense: NO
cggttacgcaaagcaacggcaacagatttttttgctgcgtgctgtcctacaatatattcatctaattcacttacgatttgtcttggtgtttgttttaattcatacatatctactcacctcttacagttcttctacgataatattatgattagtaaagatacagatatctgcggcaatatttaa

SEQ ID NO: 1296 - DNA (genomic), 768 bp, Enterococcus faecium; double-stranded, circular
  misc_feature (B) LOCATION 1...768
  hypothetical: NO
  anti-sense: NO
aacaatagcaatactataaggaggaacgttatggatgtaaaaggaaaaaatgtatttatcacaggtagtacaagaggaatcggcaaagcgatggccttagcttttgcaaaagctggagcaaatatcattttgaatggtcgcggagagattccaaaagaaaagatagaagaaatcgaagcattcggtgtaaaatgcgtaggagtttccggtgacatctctgattatgagaaagcgggacaaatgatcaaagaagcagaagaaaagcttggatcgatccatgtgttagtaaacaatgccggaatcacaaatgacaaacttgtgatgcgaatggatgcagaagatttcaaaaaatgtctggatatcaatttgattggaaccttcaatatgacgcagcacgtattgaaaaaaatgatgaagcagcgagaaggggccatcattaatctctctagtgtatctgggttgattggaaatattggtcaagcaaattatgcagctagtaaagctggcgtagtaggattaacaaaatctgtggcacgagaagctgcaactagaggcattacatgtaatgccattgcgccaggattcatcacaactgatatgacggaagttttagcagacaaagtcaaggaacaagcggaaaagcaaattccgatgcagcgtttcggacaagtagaagatattgcacaaacagcagttttcttagcacaaaatccatatatcaccggacaagtcatcaatgtcgatggcggattggtcatgcacggataa

SEQ ID NO: 1297 - DNA (genomic), 438 bp, Enterococcus faecium; double-stranded, circular
  misc_feature (B) LOCATION 1...438
  hypothetical: NO
  anti-sense: NO
ccaagtagcaaatggtcaatcgaaaggagcagtacaatgaaaaaagcatacgaaacagcaatgatcaaccatggcgggcgcaatggagaagtcgaggcaccaaatggctcgatgcatatgaaaatcactcctccaggaatccatgcagaaggaacaaatccagaacaattatttgcagcaggttatgcttcttgtttcaatggggcggtacaacatatgatcaaagaagcaggaatgacagcagagtccacagtaaaagcacgtgtctctctttataatttagatgatggcggctatcagatcggtgtagtattagaagtgcatatcgatggcatcagcgaagaagaagcccaaaaaattgcagaagatgcgcatgaattctgcccttactccaaagcaactagaggaaatatcgatgtagaagtaacgattgtttag

SEQ ID NO: 1298 - DNA (genomic), 525 bp, Enterococcus faecium; double-stranded, circular
  misc_feature (B) LOCATION 1...525
  hypothetical: NO
  anti-sense: NO
gagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaa

SEQ ID NO: 1299 - DNA (genomic), 906 bp, Enterococcus faecium; double-stranded, circular
  misc_feature (B) LOCATION 1...906
  hypothetical: NO
  anti-sense: NO
gaaaggagcaataaaatgaaaaaagtattgtttactctaggcatgattggagttcttttagccggatgcggctcaggatcaggaaatacagatggctctgccacacaaaataattcaagtgactcaaatgaacaggtaaaaatcgttgcggtaggttcgacagcattacagcctttggtcgatgcagcacaagaaagttttgtacaagaaaatccgaattatcaaatctctgtacaaggaggaggaagtggaactggtttgagccaagtcgaagctggagcagttactatcggaaactctgatgtatttgcagaagaaagagacgggatcgatgcctctaaattagtggatcataaagtagcagtagttgggatggcaccaatcgtcaacaaagatacaggtgtcaaagatatcacaaaacaggaattgattgatatctttacaggaaaaatcactaattggaatgaagttggcgggaaagatcaaaagatcaacgttgtgaaccgtgcaaacggcagcggtacccgtgcgacatttgaaaaatggggattagatggtgccacacctatacagtcccaagaacaagactcatcaggaactgttcggcagttggtaagtcaaacaccaggagcaatcagctatttggccttctcatatctcgatgattccacacaagcactaagtatcgacggtgtagaaccaaaagaagagaatgtagcagataacagctggaaaatctggtcctatgaacatatgtacacgaacggaaaaccttcccctgaagtccaaaaattcttagactacatgatgacagaagaaatccaagaaggacctgttaaagaattgggctatttaccaatcacaatgatggaagtagaacgtgaccacgaaggaaatatcaaataa

SEQ ID NO: 1300 - DNA (genomic), 1197 bp, Enterococcus faecium; double-stranded, circular
  misc_feature (B) LOCATION 1...1197
  hypothetical: NO
  anti-sense: NO
aagaggagcaaaataatgcataaactcattgaacttattgagaaagggaaaccgttctttgagaaaatctctcgaaacatctatcttcgtgctattcgtgatggatttatcgctggtatgccagtcatccttttctcatctatctttatccttattgcctatgtcccaaatgcttggggattccactggtcaaaagacattgagaccttcttgatgactccttatagctattcgatgggtatcctagcattctttgttggtggtactaccgctaaagctttgacggactcaatgaaccgtgacctacctgcgaccaatcagattaacttcttatctacgatgctagcgtctatggtagggttccttttgatggcagctgagcctgcaaaagaaggatgcttcttgacagccttcacgggaacaaaaggtcttttgacagcatttattgcagcctttgtgacagttaatgtctacaacgtctgtgtgaaaaataatgttactattcgtatgcctgaagaagttccaccaaatatctctcaagtatttaaagacttgattccattcactgtagcggttgttctcctttatggatttgaactcattgttaagggaactcttggtgtaaccgttgcagaatcaatcggtacccttcttgctcctctcttctcagctgcagatggttaccttggaattacacttatctttggtgcttatgccttcttctggtttgttggtatccacggtccttcaattgtcgaaccagcaatcgctgctatcacttatgccaatatcgatgccaacttgcatcttatccaagctggacaacatgcagataaagttatcacttctggtactcaaatgtttattgttaccatgggtggaacaggagctacattgattgttccattcttgttcatgtggatttgtaaatcagaacgtaaccgtgccatcggacgtgcctcagttgttccaacattctttggggttaatgagccaatcttatttggtgcaccaatcgtattgaatccgattttctttgtaccgttcattttcgctccgattgtcaacgtttggatctttaaattctttgttgacacattgaacatgaactcattctctgccaaccttccatgggttactcctggtccgttgggaattgtactcggtactaacttccaagttctatcatttatctga

SEQ ID NO: 1301 - DNA (genomic), 525 bp, Enterococcus faecium; double-stranded, circular
  misc_feature (B) LOCATION 1...525
  hypothetical: NO
  anti-sense: NO
agggggagcaataatatggtcgtcaaaactgagactttagaagaaaaggcaagagaactattgaaggaacgtggcgtaactgtagaagatatcgcacaacttgtcatgtttttacaaaaagactatatttctgatttgactttggcggattgtactgaaagtgtcaacagcgtgctaacaaagcgtgaagtacataacgccattatcactggaatccaattagatatattagcagaaaagaaaaaattgatgagtccgttgcaacatattatcgaagatgacgaaggcctttacggtatcgatgagatcctagccttgtcaatcgtgaatgtttacggtacgatcggctttacgaattatggttatatcgacaaggtgaaacctggtattttaaaagaactaaacagccacgatggcgttcatgtccataccttcttagatgatatcgtcggagcgatcgccgctgctgctgccagtcgattagcacacaaagaaccagaaaaaagaagtcgccttactcaataa

SEQ ID NO: 1302 - DNA (genomic), 195 bp, Enterococcus faecium; double-stranded, circular
  misc_feature (B) LOCATION 1...195
  hypothetical: NO
  anti-sense: NO
cctatcggcaataaggcacgattttgtaaaatatgggaagcgatttttcaaaatcgcttcttatcgctcaaggctgaacatctctgtcacaacctctccactaaatggtgtttaaaagcttgcatctgcgataataagaacaaccaaacgaaaaataggaagcactattttagtttagttgttcttattacttga

SEQ ID NO: 1303 - DNA (genomic), 252 bp, Enterococcus faecium; double-stranded, circular
  misc_feature (B) LOCATION 1...252
  hypothetical: NO
  anti-sense: NO
actatcggcaataaggcacaattttgtaaaataggggaagctattttacaaaatcgcttcttattgctcaaggctgaacatctctttcacaacctctttatttatctgtatcttttaaatagatacttcctgttgtcgttgaaagttgcacttgcgcgatttcaccatctgaaacacgacggaattgcaacatttggtttgtccgttcttttttctcacgaactacttcgtaattggacagacggctgttga

SEQ ID NO: 1304 - DNA (genomic), 264 bp, Enterococcus faecium; double-stranded, circular
  misc_feature (B) LOCATION 1...264
  hypothetical: NO
  anti-sense: NO
atattaggcaaaaacaatgcaaaaatattaagtcttttattaagccaaaataaaaaaacgttgatttatcaacgttttttacagtatctattagtctcaaccatacatatatatatggagacggcgggttcaggcaataacattggggtgtacgttgatgcagcaactgctagatatgccaagccagttgcaggatttgcgacaactgaaaataaaattattggcagaggtttgattatcaataatgggcaggtgttaagttaa

SEQ ID NO: 1305 - DNA (genomic), 472 bp, Enterococcus faecium; double-stranded, circular
  misc_feature (B) LOCATION 1...472
  hypothetical: NO
  anti-sense: NO
tgaaggcaaggaagtatctgatacgatccaagtcggcatcatgatcgagattccagcagcagcagtgttagcagacaagtttgcaaaagaagtagatttcttctctgtaggtacgaacgatttgattcaatacacaatggcagcagaccgtatgaacgaacgcgtttcttacttgtaccaaccatataacccatcaattttacgtttgatcaaaaatgtaattgatgcagcacacgctgaaggaaaatgggcaggtatgtgtggagaaatggctggagatcaaacagctgttccattgctagtaggtatgggtctagatgagttctcaatgagtgcgacatctattcttaaaacgcgtagtttaatgaaacgcttggacacagcgaaaatggctgaacttgctgatcgtgcattgaaagaatgcgatatgatggaagaagtcgttgaacttgttcatgaatatgtaaaataa

SEQ ID NO: 1306 - DNA (genomic), 312 bp, Enterococcus faecium; double-stranded, circular
  misc_feature (B) LOCATION 1...312
  hypothetical: NO
  anti-sense: NO
aaaatgggcaaatttcaagtgatcgatcatccattgattcaacacaaactaactattattcgggacaaaaactgcggaacaaaggtttttcgtgaagtagtcgatgaaatcgctatgttgatggcatatgaagtatcacgggatatgccattggaagacatcgtgatcgaaacaccgatcactgaaacaacacaaaaaacgttgtctggtaaaaaagtagcgattattccaatcttgcgcgcaggtattggaatggttgacggtatcttggaattgattccagtttntaaagtggggcacatcgatctttat

SEQ ID NO: 1307 - DNA (genomic), 621 bp, Enterococcus faecium; double-stranded, circular
  misc_feature (B) LOCATION 1...621
  hypothetical: NO
  anti-sense: NO
gtatttttaaattacaagactattcttaaggcgggtaaaaaaatgccaatacgcgtaattcttatcgatgatgaacagacgattttagatggaatgaaacagttgatcaattggtctgagcacgggtttcaattaatagggactttttccagtccgctgaaagcgcttgatttttctttggtacatgcaatcgatatcgtggtcacagatgtaatgatgcctgaattaaatggaatcgaattatcgcggctattaaaacagcaacaacctgaaacacagatccttatcctctctagctatgatgaatttgatatggttaaagattcttttaaagaaggcgtcgctgattatcttttaaagcctcgattgagtcctgatttttttctaaattccttaactgccgtttcacaaaaaatcaaaaaaaagcccaacaaaagcccaatcaccaatcgttatgagcagatctgcgagaatctttcacagcagattgctggacaaactcgtccattgcttgaccctcttctttttgaacacaccttgtttttctgttatataccgaaaaacggccattcagttcaaaacaaggctctaaacaaaaacagtcgatcacccattcattga

SEQ ID NO: 1308 - DNA (genomic), 291 bp, Enterococcus faecium; double-stranded, circular
  misc_feature (B) LOCATION 1...291
  hypothetical: NO
  anti-sense: NO
gcatttttaaaaattgttcttttttctttaaaattttggtttcgactacttcaacctgtgtttggttcccctctaattcacactgtacacgttttgactccaaacgaagcagatcatgtttcagacgttccaactgacgatacatcaatatatttcttttacgcaacttacaaagtatttgacggcggtcatccatcgaaagggcgccatagcgatcatgcaacagttttttttgttgttcaaaactctttctcattttcgagctntcatatacacgtattcatgacttaa

SEQ ID NO: 1309 - DNA (genomic), 714 bp, Enterococcus faecium; double-stranded, circular
  misc_feature (B) LOCATION 1...714
  hypothetical: NO
  anti-sense: NO
aaagttttaaagtactgtatgatctttttagatgaaagtttggatgggggagcatcattggatagtagagtcttaaaggaatatttggataaaaatggttttccgattatacgcaaaggatatcataaatatttgacattcgaagggatggaagattcccatacgtatatcttgaaagagggaacggtaaaagcaagtgttatttcaaatgatgggagagaatttaaccttcgctatatcaaagatcttgaaatcgtctctcttttaaaagacgaatattcacaattcatcgattcgccgtataatattcgagttgaatcagaatatgcagagttttatcgaatcaatcgtgtgcgcttttggcaaaatatcaaccaagacccaaagctacaacactatgtaaaagagtattaccgctatcgtctgctttattcgatgaaaaaaatgcagcaaatgctattaaacggaaagctgggagctgtttgtacgcaactttacgaattatatgatttattcggtgtgcggacagaagaagggatgctgatcgatttttcgatcacgaatgaagaaatcgccaaattttgtggcatctcaactgctagcagtgtgaacagaattttaaaacaactgaaaaaagatggtattatcaccgttaaagaccatcatatcgttattttgaatatggacttgttagaagacaatattatcttttga

SEQ ID NO: 1310 - DNA (genomic), 825 bp, Enterococcus faecium; double-stranded, circular
  misc_feature (B) LOCATION 1...825
  hypothetical: NO
  anti-sense: NO
gtattttccctctattttgttatcattaaagataacaaaatagtaaattggaaaggaacagttatgaagaaaaataaagttattttaagtattagtttagcagcagcattgctgtttgctgctggttgttctgcaaacaacacgacttcttctagttcgtctacagaaagttcaaaaagtacatctactgcggaaagcacgactgccagtagcgtcgatttgaacgcattggaattaccacaattgacgaaagatgtcgccgaaaatgaagatctggtcgaaatggtgacgaataaaggcacaatcaaaatcaaattatttcccgaacacgcaccaaaagcggttgaaaactttatgacacatgcaaaagacggttactacaacggactgactttccatcgcgtcatcaaagatttcatgatccaaggtggcgatcctaaaggcgatggcactggaggggaaagcatttggggagaaggatttgaaacagagatcaacaaccacctttataatataagaggtgcgttatctatggctcgctcacaagatcctaacagtcacggcagccagttctttatcgttcgatatacagatgatatgcatgatggtcttntaaaagacgattatcctcaagcaatcatcgacgattataaaaacggcggttatccttcactagatggcctttatactgtcttcggccaagtgattgaaggaatcgatgtcgtggatgctattgcaaatatcgaaacagatagttcagacaaaccaacagaagaagttaaaatcgataacatcaatatactgcaagaagcaacacaaaaataa

SEQ ID NO: 1311 - DNA (genomic), 561 bp, Enterococcus faecium; double-stranded, circular
  misc_feature (B) LOCATION 1...561
  hypothetical: NO
  anti-sense: NO
cagctcttaaaggagatgctaaaaatgaacaaaccccggttagacgcacgtatgattgctattatgggcttattgattgcattgatggtcactttgtcccgactggtagcaatcgagaccccatttattaaaatcagtgtcacatttattccacaagtgatcatgggcattctttttggtcctttttggtcagggataggcgcagttttagctgatttagtaggaatggccctcttctcgaaatctgcattctttattggatttacattgaatgcatttattgaaggagcaatctacggattctttttctatcgaaaagagatcacttggaaaaatgccattctggctacgcttagtgtcacgctgatcatcaacttatttttgacaccattatggcttgcgttgatgtaccatgtgccattgttcagctgggtcgtttgggcgccccgcctgttaaaaacagtaatatggttaccgattcaatcaattgccatttattacgtaggacgtagtattccttacaaaaaaattttaagaagtttagcgatccacgctaaataa

SEQ ID NO: 1312 - DNA (genomic), 702 bp, Enterococcus faecium; double-stranded, circular
  misc_feature (B) LOCATION 1...702
  hypothetical: NO
  anti-sense: NO
gtaaacttaaaatttatttttaaaaatgctatgataacagtaaaactacaagtaaattttacatgtaaattatatcattttttaaaaggagtttttatggcaaaaattggatatattagagtgtcttcacaagatcaaaatttagatcgacaattggcaatgatggaagaccttaacattgataaattattccaagaaaaagccagtggtaaagatatccagcgacctgagtttcaaaaattactaaattatatccgagaaggtgattgtgtcattgttgcatcactggatcgcctaggcagagattatgaagacataaaaaatacagttacctttatgaaacagaaaaaagtagcattaaaaatactagatgcacagtttttagattttaatactggaaatgaactcctagatactgctatgttcgatatgtttttatcattgctaagttatattgcacaaaacgaacgtgagaaaatccgtgaacgtcagcggcaaggagtattattggccaaaaaagctggtcgatataaggggcgaccaattgaatattctgagaactcaacagatccgcaaaaacgattagtctttaaaactgtggtggacatgttaaatcaaggagttccagttgcagaaattgccaaagaaaatggtctctctcgaccaaccatatataaaataaagaaagcgaatgatttgtag

SEQ ID NO: 1313 - DNA (genomic), 312 bp, Enterococcus faecium; double-stranded, circular
  misc_feature (B) LOCATION 1...312
  hypothetical: NO
  anti-sense: NO
gtgaacttaaacatgcaaaagaacttagagaggagtggttcacaaatgatgattaaaaaattgattgaagaaaagcaaaaagacaaagattttgcagaagcatatgaccgtgaaggaagaaaactcgaaactgcggttgctctttatcatgcacgggaggaagcaggcctaactcaagcggagcttgcacaaaaagcacatacaactcaatctactattgctcgaattgagagaggggataacgtatctttcgataaacttgatgatatcgctagggcattaggcaaaaagctggtagtagaatttgcttaa

SEQ ID NO: 1314 - DNA (genomic), 525 bp, Enterococcus faecium; double-stranded, circular
  misc_feature (B) LOCATION 1...525
  hypothetical: NO
  anti-sense: NO
catatattaaaaataattgcaagaaaagaaatttatagtggtcgataccaaattatcaaagcaatgttattttgttgctgtctattaatttatgtattggaggaaaaacgaatggataaagaaatcaaagtaactgtcaaattagatttgactgaactaaaagaactgctcaacaaggctagtgaccaagtcgaacaaataaagtatcaaggtatggatcgaaaacggttgattgatattattgagcaacaacgtttagaattgatccaaaaagaagctgtatgtaaagagtacaaaaaacatttagaacaagtaattgagtatcattcagtagaaaagtacagatcagtggtgcaaaaaaatagagcaacgagtcctgatcctcgtcaagatgtatcgattagtatcaagacgccagtatttaattctgttaaatcagaaaagctagaaagtatctcaactgctttggtagaaaaagcagctgaaatgaactccctagcaaatgaagttagtcgtcttatttag

SEQ ID NO: 1315 - DNA (genomic), 240 bp, Enterococcus faecium; double-stranded, circular
  misc_feature (B) LOCATION 1...240
  hypothetical: NO
  anti-sense: NO
ttaacattaaaatatttaccatctttttttgttattgatattgaagaattagaactttcatataaagccttttctatttcattgcttgatttcattattgttaaacaagaatacaagcaagaaagaactatagttaatatgataaaaattattaaagttctatttttctttcttgtaatatatgctatagcattttttatcactttcctaactactcctctctattttcttactccataa

SEQ ID NO: 1316 - DNA (genomic), 936 bp, Enterococcus faecium; double-stranded, circular
  misc_feature (B) LOCATION 1...936
  hypothetical: NO
  anti-sense: NO
agccaattaaattgtctgttttttattcactttatgagaaagaaatcgctgatgaagcggtttaaggggagtaaaatgagtaaaaaaataggcaaagagtcattatcgctcggattgaaaaaagaaattgttaaatttaaaagtatgtatagagagccggaatttagactcatttttcaattagatatagtgagagggctgaaaattagttttagttgtttaggttatctggtctggctattcattgctagagtaggatggagcaatgcttatagcttttataaactgttcgccggaactgatcgattaaaagaatcattagaggtgaaagaagccttaaatattttaggaagtcttgctttcagcctgtttatttttgctttatttatcttacaagtaggaaaaataatgatgtcaacaaatgacaattatattaattatttgaagccttttcaaaaaggaataaaaatcatttgtagacagggcacagttttatttctacttagcctgtatgagcatgaaattcattttcaaaattattataatacgacaactaaacttggtgcatttttactcctatatttagttagtaatatagctgaaaaaatgctgtttaaacatattgtaaagcaagtcttttctgatattcaaaaggaaagctattgtttaaaaacaccttatggaaatttaaaaaatgttgagctgtttttatttaaaatggatagtaagtgggataaatatatctatagaagtaaagaagtatttttaactggtagttataacaaaactcttcaggagagcctgtacgacacaggagcaatatttaataatgaacctatggttttgaaagatttctttggagattatgaactagtttggaatccaaaacagcttagtgaacagggggcagaaaatgaatttgctgaagttcactaa

SEQ ID NO: 1317 - DNA (genomic), 894 bp, Enterococcus faecium; double-stranded, circular
  misc_feature (B) LOCATION 1...894
  hypothetical: NO
  anti-sense: NO
ataaaattaaatgaaagaaggagtgcgcaaatagtggaaaaaaggcaaaaaatggaaaatcaagaagtggggtacacaaccaaagactggatgttacggtttgtgaagggaatgtttatcggttcaggatttatcttgccaggagtcagcggtggtgcattagcagctgtctttggcatgtatgagcggctgatttcttttttagcccaccttacaaaaaatttcaaagaaaatgttttgttttttctgcctgttggtctaggcggagtgacaggcatctttctactttcttttttagtcagttttttattaggtgcgtatgaaacaacgatattatggttttttgtcggatgtatcgctggaactgttcctgcgttatggaaagaagcagggaaaaaaggaagagatacttctgatgtgatcatcatggttgttacttttgttctggcttatttgtttttattatacggcgctcaattatttgacgggcaagtcgatcagaattttggaacatggctgattgccggcggattgattggtttgggtatgatcgtcccaggattgagcccttctaattttttggtgtatatgggattgtataaagcgatggctgacggatttaaagaagtacgacttgaagtgattgtgccgatcggaattggtgggattctttgtgttcttggattgtcaaaaatcatggattacattttctcaaaggcatatagcaagctattccatttcattttaggtgtagtttttgcttcaacgattatgatcattcctaccgattacgcgggattgggagttgctggggtactagcttgtcctgttctttttatagccggtacagcactaggttggtggatgagccgtttggaggaacaatataagtaa

SEQ ID NO: 1318 - DNA (genomic), 1152 bp, Enterococcus faecium; double-stranded, circular
  misc_feature (B) LOCATION 1...1152
  hypothetical: NO
  anti-sense: NO
gagatgttaaaagtgtgggttgaacaaaccaaagatgggcgattcaagtttattgaaagatatgtagatccttatacagaaaaaacacggaaaaaatctacaacacttacaagtaattcaccacaagcgtggaaaaaagctcagaaaattctagataaaaaaattaaagaagcactcgaagattacaataaatcagatatcacttttggtgagttgtataaagaatggtatgaatattataagcagcatgttaaacgtactagctatttgaaggttccaatgatgatgaaacatgtttctaagcacataagcgatgatacgatcgttagaaacattgatgagacactcattaataagataattgaagatatgtatacgtttggtgacctctcactgaactacacaaaacaaacaaaaacaactctatctgttatgctaaactatgcaatcgatagaaaatacattcaaagaaaccctgcgctagcagttaaaatccatcctaaaaaagtggaagaagaaaaaagaaggctttctatgaataaaaaatatctggagaaagaagaaattgatcaaatactgaaacagctatactccaatcctcgcagaaaactacacggcataatagctgagtttctatatttaactggtttgagatatggggaattgctagctttgcaaatgaaggactatgaggatgggaaaatttccattaatgggaccttagattacacatctgtgaaaatggataatgctataaaaacaactccaaaaaatacttattcgcaacgtgaagtgcaattacccaatcgtgcaaaagaattgattgaaagtgtgatagctgacaatattcttgcaggtagacccacagatcccgatcaatatatatttatatctacaagtggcactccgcttgcgctgcactcatttaacgctatactccataaagtagaggaagagttggaattagaaaaaagtctatcctcacatatattcagacatagccacgtttcactattatctgaattaggcgtacctcttaaagccattatggagcgtgtagggcattctgatgcaaacacaactctgtctatttataaccatgtaacaaaaagagccaaacaacaagtaattgataaactaaatagcctttga

SEQ ID NO: 1319 - DNA (genomic), 909 bp, Enterococcus faecium; double-stranded, circular
  misc_feature (B) LOCATION 1...909
  hypothetical: NO
  anti-sense: NO
aagtttctaaagggggccaatcaagtgttaaaaaaatcgacaatgaaagacaatttgataggttacggctttctagcgccagctttgctgctgctgacgatttttctgatcatacccgtaatcatggtaatttattatgcctttactgattattatttgttaacgccagatgctagacaatttatcggcttagaaaattttaagcgactgttcgctgatccaatttttgtaaaaagtatttggaacacggctaaatttgttgtttggattattccggtccaattaggggcagctttaggaatggcacttattatcaacaaaaatcgtaaaggaaatatcttttttaaagtagccttttttgcgccagtcgtgatgtccttagtcgttatttcgattttatggttgtacttgttaaatcctaatgaaggtctggttaatacgctatttgcaaagattggaattgcttcgcagccttttttgactagtcccaaacaagcaatgtatacgcttgttttcgtatcggcatggcaaggtgcaggatatcagatgctgctgtttttagggggaatgcaaaatattccgcaagacgtttatgaggcagccgaaattgatggtttttctaagtttcagcaatttcgctatatcaccatgccattattaaagcccacggcgatttttattttacttaccacattgatttcggcctttaaactaatcattcagccaatggtaatgactcaaggtggaccaatgaattctactatgacaatggtttattacatttaccaaactggatttacagaccgtatggtaggctactccagctccattgcgttaatctttaccactatgattggtttaattacaattgctcaaagaaaattggtaaaggaggatgatccagcatga

SEQ ID NO: 1320 - DNA (genomic), 1038 bp, Enterococcus faecium; double-stranded, circular
  misc_feature (B) LOCATION 1...1038
  hypothetical: NO
  anti-sense: NO
aattccctaaaacttgtccattatttcaaaatttgttatagtctttttattcaaagcgtaaaaggagatcctatgttaaaagaaaaaatgaaaactctccccatgctgccgggtgtctatcttatgaaagaccgagatggtaaggtcatctatgttggtaaagcaaaacggctcaaaaatagagtaagcagctattttcatcagaataaacagcattcaaaaaaagtattacgtatgattcatcatataacagattttgatttcgtcgtagtagacacggaattagatgctttattgctcgagtgtcaattgatccaacattaccgtcctttttataaccgacaaatgaattatttcagtaattataattatgtacatattaccaataagggatttgtattaacagatactcctacggctcgaacatacgggccttttcgtctctataaaaaaatgccgtctattttgcgtataatggaagaaacttatcaaatgccttggttgtctgaaattagtttgttagctttgcgagtccagcttcctgacctacaggaaatgacttttgaacagaaaaaaaaggaactccaagggctgtttcaaggccgaaataaaaagctactgacttacttgaaaaaaagacaacaacatttcatctatcagttgaatttcgaaaaagccggtatgcttcaaaaagatatcgaattagttacttattttattagacggatccaggaacaaaagcagtttttaagaacaccatcgctcaccttcagcatgccattagcagcagatgagagtcagaaaaagcactacctcgtttgttatggtcaacttgcagaaacaatgattacctctggtgacgtttctcctgacttctattatgaaaagaaagaagctcatttatctttgaaacgtcaattgtcaaaagaagaaatcgatcctgtacaaatcttgatcagttaccgcaaaaaattagaaaaagaacagtttgaaattgaactgttaaacaaaaaagaagctgaaaagcaactaaattag

SEQ ID NO: 1321 - DNA (genomic), 966 bp, Enterococcus faecium; double-stranded, circular
  misc_feature (B) LOCATION 1...966
  hypothetical: NO
  anti-sense: NO
aaaatactaaagaaatcagtattgagaaattccaatcaaatcaatcagaaaatatggatgaactggttgttcgtaaaaactttgcttatgcagttgaatgattttttaggtgctccatctagcagacatacccctagtggaaaacgattataccgagaaaaacaaaacggttttatgcttgaatactatcaattgtacttaaatgaattggaaacagtaccagccctctatgcttatccagaaaaagaaggaccgtttccgccggtcctttacctgcattctcacggcggagatttttcagtcgggaaaagtgaattgatccatggtgctccttacttagcttctccatcttttgcagaagtactgacaggaatgggatatgctgtttggtcgattgatgcttggggatttgaagaacgcggaggtatttctgaaagcgagttgttcaaacaatttttattaacaggaaaaacgttatggggaatgcgtatttatgatgtgatcagcttgatcgattatttggagacaagggaagacacagatactcaacggctcgcaacgattggtctttctatgggaggcttattaagctggtgggtgacagcattggattctcgtgtcaaagtttgtattgatctagcggcacaggtggacatcgaaatacttttgctacatcgccgcctagatcatcatgggttttattactatgtgccaaatctattgacagcttatacaacgttagcaatccaagaaaaaatcgctccgcgccctcgtcttagcttagttggaaaaaacgatacgatgtgcttggacgaaggcgtactgaagctgagaaaagggctggacaaaaagtatcaatcaatgggtagtccagaaaactttttttttttttctttaacaggcggtcatatggaaacacaagaaatgagaaatatttggaaacaattcataagggagcatttatga

SEQ ID NO: 1322 - DNA (genomic), 984 bp, Enterococcus faecium; double-stranded, circular
  misc_feature (B) LOCATION 1...984
  hypothetical: NO
  anti-sense: NO
gagtatataaaagcagctctttttgattacaaaaaacgtggtataataaaattgtgcataagtgaacaaaaggaggtgcggcacatgctccaaaagaaaatcagcggtgaacaagtcaatacgatggtttctgatcagtatgaaatctatcatgtcaaagatgtcgtcagccaaaataaaacgatctatcatcatcatgatttctatgagatccatgctacattaaagggagaagcgactttttatttgaacggacgacaatttacgatcaaagcaggaagtgtgctgctcatccattccaatgatttgcatcgtatcgtccgccaatcttcagatgtattcgagcgtgtctatatctttgtcaccccttcttttctagaaagtcgttccacgccatggtctaatctatcggcttgttttcaaccaatgggagagaagaggagtcgtgtattgcaaatagaacaggaagtattgaagcaaaaattatcatttatcgaccatcctcctgataaaaaaatttacggtgaagacataaaatatgaacaagctctggtagaatacttgatttttctcaatcaagttgtacaaaaagaagagagtgcgcaagaacagaatgctgtagttcctaatgagcgtgtggaacaaatgttacaatatatctcaaaaaatttatctcatccgctttctttagaggaaatggaaaagcagttttttgtcagcaaataccatatcacacgagaatttaaaaagtacactggatttacgtttcatcagtatgtaatgaagaaaaagctgatctatgccaagcacttgttgcgagaataccgcagctctagtgctgtatatagtaaaagtggtttttcttcttatccgcattttctgaaagcattcaagagagagttcggcataacgcctaaagaatttttgaaacgtgatacacagaaacagttggttcattatgaacattttgaagatgaacaatga

SEQ ID NO: 1323 - DNA (genomic), 339 bp, Enterococcus faecium; double-stranded, circular
  misc_feature (B) LOCATION 1...339
  hypothetical: NO
  anti-sense: NO
aacaatataaaatcattccagagcacgcaaaaaaagcataaacttactttcatcttctttcatccagactatactgtcggctttggaatttcaccaaatcatgcctttcggctcgtgggctataccaccggtagggaattacaccctgccctgaagatagttattcaattacggacaattataatatctgatattatatctgtcaataaaaagtttttttctcgtttatccaaatacaataatttgcaagcaggtaaacacaggttatttcttaatatccttttgtttgggaaactcctgtctcccatttggaaacagaagcttttgtcacacctatga

SEQ ID NO: 1324 - DNA (genomic), 648 bp, Enterococcus faecium; double-stranded, circular
  misc_feature (B) LOCATION 1...648
  hypothetical: NO
  anti-sense: NO
gaaagtataaacttaatgtttggaggagaagatatgttagggaaggttttggaagagttatttatccggatctgggtcattataaaactaaccttgtatttctggatatatacatttgccggcgggatcatctttggattaggtgcggcatggaaaacagtcaatgaactattttatttgtacggattcgagtataaagaaatcacaataaaaagaggctggaatatatataaaagaaattttttaagaggcaatctgctatttagtttatttttatctggtactgctttattgagttacaatttatatttatctgttcaaatcaaagggctcatttttttagctattgattttattttactttttgccttgctctgcctatttgctacttatcaatacagtatgattttagatagtgaatatacgatctctgttcctaatctgctaaagctaagttttatttcggttttttccagcttttcgtcttttctaaaaataattattggtagcggtataattttaggcgtgacttggcaattcaaaggattgatcctgtttggtgtcattggtcttttgacggtttggaatggtacgatgacaacacattggcgtgaagaattagataaacagttggaaagttatgaataa

SEQ ID NO: 1325 - DNA (genomic), 345 bp, Enterococcus faecium; double-stranded, circular
  misc_feature (B) LOCATION 1...345
  hypothetical: NO
  anti-sense: NO
aaatacataaaagaggtgagcgccatgaaattggtaaatgtaacaaacagccattcccgtcttgtattaaaccagcttgaaaacactgatgcccatctagtcaaggtctacacagccggaaataccactattgtctacactgaagcccctgaacataatgaaattctgctgatcaatgacaaacgtaaaatccagccgaaagaaatcgaagatgctaaaaattatttcttagataaaatcaaagacgccgtttaccacgaggatgaaatcaaagtaatcgaattggcaggccttgttgaaatctcgattccaaaacatgaattaggcgctacattagccgtgtaa

SEQ ID NO: 1326 - DNA (genomic), 192 bp, Enterococcus faecium; double-stranded, circular
  misc_feature (B) LOCATION 1...192
  hypothetical: NO
  anti-sense: NO
caaataataaatgaggtggattcaatgaaaaaatttgtatctggaatattagtaggcagcttggcaacagccgctgccgttgctggtttggtcgcttctgtgaaaaaaacagtgatcgatccgattgacgaaaaagaagcaatgatcgaagaaaatcgtaaaaaagcaatgcgcaaacgcgtttctcgttaa

SEQ ID NO: 1327 - DNA (genomic), 210 bp, Enterococcus faecium; double-stranded, circular
  misc_feature (B) LOCATION 1...210
  hypothetical: NO
  anti-sense: NO
gttcaaataaagcatctccaacttacatggttacatgaggatatcaaatcgaaattactcaagcttcctatggctagagtcgcgagaagttgttgggcagtagacataggttatattgttcttagctacacgatcattagaaaggaaatcctattatgtatagttatcaagaagatgcaaaagtccaaaaaaatcgctggtggattttga

SEQ ID NO: 1328 - DNA (genomic), 504 bp, Enterococcus faecium; double-stranded, circular
  misc_feature (B) LOCATION 1...504
  hypothetical: NO
  anti-sense: NO
aagcaaataaaaaaaagccggatcgctccgactgttctaataaattccacaaatttattatatcacataaaggagcggtttgacttgatgcaattgttgcgagaggtagatttcaaacagacaagatgtaatgcgagagacgtgctgaagaactttcggcgtttggagcggatggcaggtcgctctttgatagatattaagtcgccgattataacggatatgccgaaggcgccgaagcacggcaataaggcagaagacgcgatcattcagatgatggatatagaagcagagagagatgcgattctagcggctttgatggctcttagtctgattagtcgtcagatactctactacagcttctgtgacgtaaacaagcactctaattatgaaatagggcaattgatacgaggatacggcgaaaagaatgtagagaagctgaaatctatcgcgctgatcgaatttgcagaagcatacaaaaaaggcgtgttagttcagtatcgttaa

SEQ ID NO: 1329 - DNA (genomic), 765 bp, Enterococcus faecium; double-stranded, circular
  misc_feature (B) LOCATION 1...765
  hypothetical: NO
  anti-sense: NO
ataaaaataaatggcggaggaaaaagaatgagtttaattatcgatcatgtcacaggggggtacggacatctccctgtgttaaaagatatcagtttcgatgtacagcctggagagatagtagggttgattggactgaacggagcagggaaaagtacgaccatcaagcacattatcggtctgctggaagcttcaaaaggaacgatagaaatcaatcatctatccttaaagaaaaatacggaagaatatcgcaaacaaattgggtatattccagagactccttctttatatgaagaattgacattgagagaacatatcgaagtcactgcgatggcctacgatatacctatggatatagcaatgaaaagagcagaaaagttgttggagacttttcggttatctaatcgtcttgactggttcccagctaatttttcaaagggaatgaaacagaaagtgatgatcttatgcgcctttttgatcgagccttctttatatatcatcgacgaaccatttttaggcttggatccactagctatcaatgcattgcttgaattgatggtagaaatgaaaaaagaaggagccggtattttgatgtctacgcatattttagctactgcagaaaaatattgtgatcgttttgtggtcttacataacggagagatacgagcagacggttctcttgagatgttgagaaaagaatttcagctgccggattcttctttggacgaaatctatattgctttaacaaaggagcaggcacatgagtag

SEQ ID NO: 1330 - DNA (genomic), 321 bp, Enterococcus faecium; double-stranded, circular
  misc_feature (B) LOCATION 1...321
  hypothetical: NO
  anti-sense: NO
aatcgaataaaaattctcaattttagctgtttttgctataattttagcgaggtgatcgtgatggaacaatatattggtttactcgataaaattagggtgatcaagacacagccattgcttgtgcgatttacattacgcacgagtcatgaaccaatcaattgtgtagtggccaatatagaaatagcggataaattgctgattttggaagaaggcaagtatactatttcagtgacaggtcaattcaataaacgaaatcaactagtcattgaatcaatgcaaattagaaaccctgatcattttacgcgatcgatgggcatataa

SEQ ID NO: 1331 - DNA (genomic), 846 bp, Enterococcus faecium; double-stranded, circular
  misc_feature (B) LOCATION 1...846
  hypothetical: NO
  anti-sense: NO
atgctgataaacgaacaactagtgaaaagagtcatcacacctcgtccaaaaatttcacataaaggaacatttggacgtatcgttttgattggcggcaatgaacaatatggcggagcaatcattatgagtgctttagctgccgtacacagcggagcgggtctcacgactgtagtaactgatgaaaaaaatcggagtgctcttcacagtcatctgccagaagcaatgattgtagtttggacggatactgaccagtttctttccgtaataaagcaagcagatgtactcttgattggtcccggattgggtacttcttctaagagtttggaacgtttcaaacaagtactagaaaaccaatcaaaagaacaatggctggtgattgatggctctgctttaagtttacttgctgctaatcatcttttgctaccctatcccgaacaaactgtacttacacctcatcaaatggagtggcaacggttgagttctctaccgatacaagaacaacgggataaagaaaacaaaaagaagcaacaggaaatcggtgctgtgctcgttttgaaaagtcatgagacaaaaatttatggtcaccagcacttctacaccaatcctttaggttctgctgctatggcaacgggcggcatgggtgacactttagctgggatgatcacaggatttttagcccagtttcctcaaaatgaccaaacgattgcagcagctatttatcttcatagtttcattggagaccagctggcaaaagaacaatatattgttttgccgacacaaatcagcgaagcacttccgaaatggatgaattatttttgtaaaaaatcaatggaaaacgaggcatga

SEQ ID NO: 1332 - DNA (genomic), 1380 bp, Enterococcus faecium; double-stranded, circular
  misc_feature (B) LOCATION 1...1380
  hypothetical: NO
  anti-sense: NO
ataatgataaaaaatgcatttgcttatgtaactagaaaaagtttaaaatcattaattatcatattagttattttatctatgtcaactttaagtctcattagtttatctattaaagatgctacggacagagcttcaaaagaaacatttgctaatataacaaatagtttttctatggagataaatagacaagtaaatccaggaacacctagaggtgggggaaatgtaaaaggtgaagatattaaaaagatatctcaaacagatagtatagactcctatgtaaaaagaataaacagtgttgcagatttagttgattatgatattattgaaactcaagagactcttgcgaatcaatcacctgaaagagcaaagaattttaaaagaacagttatgttaactggggttaacgactcaacaaaagaaacaaaatttgtatcagaagcatataaattagtagaaggaaagcatttagaaaatgaagataaaaataaaatcttaatgcataaagatttagctgaaaaaaataaccttaaagttggagataagataaaaataaaatctaatttatttgatgctgataatgagaaaggtgcagatgaaacagtagaagtagaaattaaaggtctattcgatgggcataatagcggtgtagtaagtgcagcacaagaactatacgaaaatacattaatcactgatattcatacagctgctaaagtttatggtaataccgaagatacagctgtataccaagatgcaacattctttgtaaaaggtgataagaatcttgatagtgtaataaaagatcttgggaaattagatataaattggagagaatataatttgattaaaagttcatcaaattaccctgcattacaacaatctatatcaggtatttactcaatttcaaataaattattttttggctcattaatatttgcaggagttgtagtttcattattattattcttatggatgaatgctagaaagaaagaaatagcagtattactatcattaggtatatcaaaattagaaatttttggtcaattcctaattgagatggtatttatatcaatccccgcattcgttggttcctatttcttagctcaatatacagctgacaagcttgggaataatatattgaataaggttactggtgatatagctaaacaaatagctaaacaatctgcatctagccaattaggtggtggggcagaagctgaaggatttaacaagacattatcaagtttagatatcaatgtattacctaaattcatgatttatgtagttatatttatgagtttagtacttcttgtatcattgattatttcttcattcaatatattaagaaggaatccaaaagaattattaattgacaataattaa

SEQ ID NO: 1333 - DNA (genomic), 699 bp, Enterococcus faecium; double-stranded, circular
  misc_feature (B) LOCATION 1...699
  hypothetical: NO
  anti-sense: NO
atcaagataaagtcgcttataataacaattaaaagcataggtaattgttattggaggcgtatcatggattttttacgtaaatttggttttttctttttattattaggcgtgctgagtgattttttgactccgtacgtattaggattgtattatcctgaattagatcaaatgaagagcgtgatcagtgtatttggagaggtttccagtcctgtaagaaaagcgtttcttatttggtctgtggtttcagggatctttttcatcctgtcattgcctgcattgtatgctgcatttgtaagtacatctcgtgtgttagctaccctagttacagcagccatcgcgttctatggtataggtgattgtatctttacaggtttgttcagtatcaatacccatgaatcttcgtggaatgtctcgacatgggtccataatatcggatcaggtttaggttacagtggttttttattgtttccagttcttcttttcttgatctatcgaaaaaatgggcaaatggacgtaagccacttataccttggactgtctgtgatcagtttgctttttgcggcgatttatggactggcaagaattccttctataaattcttggccattactgaataaaataggtttttgccaaagaatcagttttttctttaattatgtgcccattgcctggttgagtatcttgcatctcaaacagtaa

SEQ ID NO: 1334 - DNA (genomic), 1836 bp, Enterococcus faecium; double-stranded, circular
  misc_feature (B) LOCATION 1...1836
  hypothetical: NO
  anti-sense: NO
ttctggataaaattaatgggggaggaaataatagtgggattatttgattttctaaagaaaaaacaaggaaaggttagtaaacacgttgattatcaactggcttctagtctatttcgtactggtaaagtttttgctgaaaaattggaagtggacatatcaaatgtagatgagtttcgtaaaacttttatcgcttttgatgtggaaacaactggcctaaattcttcttcagatagaattgtagagattggtgcggtgctatttaaagaaggagttccaattcaatcattcggaactcttgtcaatccaaaagttagaattgcagcctcagcttcggcaataaataatataactaatgaaatgctaaactctgctccaaatgagcaggaagtttacccccagttggtagaatttttaggagatgcactagatggaaaaatcactatgtgtgcacacaatgcaagtttcgattttggatttttaagtaacacattttctagacttgggtatgatgctaaaattaagtatgttgatactctgagtctctctagaaaacatataaaaggcattgtaaatcataagcaagagactgtagcggaatatttcggattaataaatgacactgcccatagagcggaatcagatgcagatatatgcggaaagattttttggggtgttttagatattattgaggagtcgttggaagaacaaaaaaagcaaatagaaaagatgactccagacataaaagaacttgaagcttgtgcttttattcaagatattattgagaaaaaaggatgcgacaccagttggatcaggtatcgaaaaaacagtaataattatgtcgatgtaacttgtctatatacattcttaaagtttaagtttgctaagaagggaaattacatcattattagaaaagatgctacaaatggaattgatttacctatagaaccttgtactgtaagtgaaggcggtacaacaaatgtgcgagtctattttcgtagcccctttgacttaacgcctctttcaaattatattttcagtgcttatagcgattgttataattctatgaatgaatatatgagtgttagtaattacactaaaaaagaagcagagcaaagccttagtatgctgaaatctatttcaaaatcagcgatgaaagagttattattcgatgcaaaaaatcgtggatatgatgagactgaagttaacctaaatattgaaaaagtgatatctagagaagatgtaattattaacgggttgcataatcgagtttcattaaacaagatacgaaatatagggaattgggagaaaggatttgatgcaggttatccatattgggaacgtggagaaactgctaggaaaaatggcaaagtagatgaagctattgcactttttgataaagctcgatataacggctatgatgctcctgcgctatatgattcttatgctaaagcttatcgaaaaattaaggattacgataatgaaattctcattcttgatgaaggaattatgcgtaaaacacggcacgatgttggtactttagaggctcgtagggataaggcaattaagctattatttgctaaacaagaggcagagcggatagctaaggaaaaatctgattttctaaaagcgaacaaaaaagaggatgcgattagtgagcctagcaagaagcgtggaagacagattattcaaatgactgatgatggaacaataataaaagaattcgatactatagcttctgctgtaaaagaagttggcgttaactcaaaaagtattagggatgctgcaaatggagttcaaaaacatgctggaggatactactggaaatacaaagattag

SEQ ID NO: 1335 - DNA (genomic), 969 bp, Enterococcus faecium; double-stranded, circular
  misc_feature (B) LOCATION 1...969
  hypothetical: NO
  anti-sense: NO
caccggataaagcccagtaaaaaatctgccagaatcgtcggagatgtcatgggtaaataccatcctcatggagacagtgcgatctatgagtcaatggtacggatggcacagccattcagctaccgttatatgctagtggatggtcatggaaactttggttctgttgacggtgacggtgccgccgctatgcgttataccgaagcacggatgagcaaaatcgctacagaaatgctgcgtgatatcaataagaacactgttgatttccaaagcaactatgatgatacagaaaaagaaccagttgtactacctgctcgcttcccgaatcttttagtgaacggaacaacggggatcgccgtaggtatggccacgaatatcccacctcataacttgtctgaggtagtagcggctatcgatttgctgatggataatcctgatgtgacgaccaatgaattgatggaagtattacctggaccagattttccaacaggtggtttggttatggggaaatcaggaatccgaagagcgtatgaaacaggtaagggttctattaccgtacgtgcaaaagttgagattactgagatgccaaatggtaaagaacggatcatcgtgacagaattgccttatatggtcaataaagcaaaattgatcgaacggatttctgaactgcacagagacaagcgtatcgaagggatcacagatttgcgggacgaatcttcccgtgaaggtatgcggatcgtcattgacatccgtcgtgacgccagcgcatccgttatcttgaataacttatataaattgacatccttgcaaaattcatttggattcaaatatgttggcgatcgaaaaaggtgtgccgaaagttttgagcttgaaccaattcctggaaaaatatttcggaacatcaacgcgaagtcatcacacgacggacggtctttgaaaaagaaaaagcagaagcaagagcacacatcttag

SEQ ID NO: 1336 - DNA (genomic), 195 bp, Enterococcus faecium; double-stranded, circular
  misc_feature (B) LOCATION 1...195
  hypothetical: NO
  anti-sense: NO
tctcttgtaaaatcgcgattttttcttcttttttcatctaatcctctcccttgccatttctttttattgtatttgagtgtgctcgaattttcaaataggagcaaccaaagtaaaaatgaagaaagagagccactttatgaaaaatatgctgctacttccctcctattttatttatacgagaggacttgctcatag

SEQ ID NO: 1337 - DNA (genomic), 1113 bp, Enterococcus faecium; double-stranded, circular
  misc_feature (B) LOCATION 1...1113
  hypothetical: NO
  anti-sense: NO
atgactgtaaaaaataaaagtaaaaagaaaggacgacaacaggtggatttttatcagtctctacaactagatccgtttattttaaaacaaaaaatacgagaagcagcttctaaaaaagaaaagtgcatgtatatttgttcattgtttttacgatcattattcatcgtattgtttgccatttgttttatcattataattacaacattatttgaatcgaagcataaaccatacgctgtggttttattctgtatgttgatgagtattcgttttgttgactttggttataagatttcccattcgatcataggtttagcaatcgtcatgttctcactattagtagcaccgtatgtccagctgatcaaatggtcagttatgggcatgttgattcattttattttactaagcagcatattaatggcaaccgctagtgatcccaaaatggggaatgcttctttgtacggcttttcatatctctttattgtttattcgttacctaaagattcgttgaacaagaatttctttacacaaacaagtagcttattatttttgtttttttgttggttttcagttctcctttacagaaaacatcgagaaaagaacaaagacaaaagcttgtttaaagagatttttttgaaaggcatgtattcgcaggaaaaaatttggatgctcatctatgcatttggcattagtcttttgatcgttgcaggagagtatgtcccttttcagcgattgatgtgggcagggtttgcattttcttctattgtatctagctatggattgatgtcgattggtttcaaagaacgagcagtagaccgaatcattggctcattgattggatgtgttttatttattggtatcagccaatttattccttttaactgggtcggtatattaggtggtctagctttaggtgtttgttctacctatagatataaaacagtttttaattcttttggtgctttggcaatcactgccagtttattcggggttccaggagcagtaacgatccgcatttttgagaatatccttggggtatgtttaggaatcatgtatattggggtgactgaaatacttatccgaaaaataagagaaaaacacggtttgaatcattag

SEQ ID NO: 1338 - DNA (genomic), 210 bp, Enterococcus faecium; double-stranded, circular
  misc_feature (B) LOCATION 1...210
  hypothetical: NO
  anti-sense: NO
atatatgtaaaaatgtggaaagccatattcacaaaatttttcttactactcgaaactaagcggctatttcacaaactcttggtaaacggtgttcaatcagctaaccctcggtattcgctcacaaaacgacaaaatatgaggaactatttttccgtttgtttctctaataatcaggtcaaggtgctgattgcccaacctttttttgtataa

SEQ ID NO: 1339 - DNA (genomic), 186 bp, Enterococcus faecium; double-stranded, circular
  misc_feature (B) LOCATION 1...186
  hypothetical: NO
  anti-sense: NO
agtcatgtaaaaaatagtttttttgtacaacttgcagtcgtttggaaaaagaacgaattaatggtttactttaagatagcagaatttcttgaagaatttgtaaagaaagtcttttacagcctcggatatgttagaataggagtagtttatttagggaggaaaaccggtgagaaaaagaggatttga

SEQ ID NO: 1340 - DNA (genomic), 930 bp, Enterococcus faecium; double-stranded, circular
  misc_feature (B) LOCATION 1...930
  hypothetical: NO
  anti-sense: NO
gtacaagtaaataataagaagagaaaaagagaaagaagagatatagtgaaaagaaattatttagttatcagtattattgctttatccgtgcttttgtttttcgaaattacttcggtggcctccttgatcaccgaagtaaaaggacaaacacactcttcggagcattcgtcacaatctttcaaacaatcagaacaatcaaccattaaaagccaatcaactgaaacagctaacgtcaaagaagccattcaagaatcagcggaaaaggtacaaagtcagtcatcacaatcaacacaagacagtacaaaaacgagccgagatccggctgtcaaaagcgtcgcaatcagctttgatgatggaccaggagcgaccacaacaccgcagcttctgcgaatcttaaaagaaaaaaacgtgcatgccacttttttcgtcttaggagaaaatacggcgcagcatcctgaaatcgtgaagcagacagctgaagcagggcacgagattggcaatcacacatacgatcatcagaatctggccactctttctgcccagtcgatgacggaggaagtgacgaaagcagacactgagatcaaaaaagtcactggcaaaacccccacttttgttcgtccgccctatggttctgtcacgaatgtaggagcaacgatcatccagcgaccgatcatcgaatggtctgttgattcagaagattggaagacaagaaatcctgatttgattttgcagaagatccaagcaacagtatacgatggggcaattattttattccatgatatctatcctgaaacgattcgtgccgttcctcaagtgatcgattatctgaaagagcaagggtatcgcatcacgacagttggggatttattagggcatccaacggctgtcgagaactattatggcagaaacgatcatcggccagttcagtaa

SEQ ID NO: 1341 - DNA (genomic), 516 bp, Enterococcus faecium; double-stranded, circular
  misc_feature (B) LOCATION 1...516
  hypothetical: NO
  anti-sense: NO
tcaaaagtaaaggagagagacttcatgaatgatatgtatctattcatagttttcgcagcttcagcttatgtgctgcaagcagttatcagttggaagcaactaaagcatttcaatcaaacatatagcgaactgcgaagaaaaggaaaagtagcgattggtaaacgacctgggaaaatccgttcaggcacgattgttatgctagctatagacgatcatgatcaagttttagaagtcagaaaaatgcaaggggttacatctttggcaaaatttcattcattacctgtctatgcgggtgaagatatccattacatcgatcgttaccatccctcagttcgagcggaagatcgtttgacacaagcagctttagaaaatgccagagaagtatacttacgaatagaggcaggaaatgaaaaaagtgaacaaccttcattgccttttattgctatgctcaataattttcggatatggaaaagtacgatcaaagaaaaaaggagtgacaaacgatggatatcataa

SEQ ID NO: 1342 - DNA (genomic), 2229 bp, Enterococcus faecium; double-stranded, circular
  misc_feature (B) LOCATION 1...2229
  hypothetical: NO
  anti-sense: NO
aaaaaagtaaacggtttccgttttgttgggagtgaaatgatggatattacgcatagaaaaacagataaaaatttcatcttatttgatgaaaagagccgagtcttccatttacgaaatacatttctttcttatctgataaagatagaagaaagcaatgtattggcgcatatttattttggcaaaccagtcaagcagtacaaagacaataaaaattatccccgaagagatcgtggattttcaggaaatgttcccttaaatcctgaccggtctctgtcgaaagatacactaccgcaagaatactcttctcatggcagcatggactttcgaacgcccgcatcgatcattcagcgcaagaatggatcagacttactggatctgagatatgacagccattatattacagatgggaagccagagatcgaaggcttgcctcaaacttatgtgatggacaagtcagaggcacaaacgttggtgatttcacttaaggatagagaaacagcgatttatttcgatttgttctataccatatttactgatagagcagtgatcacacgatctgtaaagataagaaatgaaaccggagaaacaatcaaactagaaaaagcggctagtttccagctagactttgcccatactaggcgatttgatgaagtcattgctttgccaggagcacatgtcaatgaaagacagatttcacggcaatctgttttatctggaacaaaagtatttgaaagccgtcgaggaacgagcagtcaccatatgaataactttattgctttagttcatcatcatacgacagaaaatactggagaagcgatcggacttcaatttgtttattccggcaaccattctttcgaacttgaaaaagatcagatcaatcaattgagagtcgtcggtgggatcaacagccatcgtttttcgtgggaattgaatgcaggccagtcttttcaaacacctgaaatgatcctttcttactcaagtcagggattgaacaaaatgagtcagatccaccatgagttgctacgtgaaagaatcgcaagaggtcgtcatcaatttgctgaacggccgattctggtcaataactgggaagccacttactttgacttcaatagtgaaaaaatcaaggcgatcattgatgaagcaaaggagctaggcatcgaaatgttcgtattagatgatggctggtttggaaaaagagatgcggacaattcttcattaggagactggttcgagtatgaaggcaagttgacaaatggattacgtgaaatagcagattatgctcatagcaaaggattgaaatttggtttatggtttgaacctgaaatgatctcggttgattctgaactgtatcgaacacatcctgattttcttatgcaggagccaggtagaatgccttctgcttccagatcacaacatgtactggattttacaaggttagatgttcggcagacgattgagaaacaaatgagaaagattttagatacgattcctcttgactacatcaaatgggatatgaaccgttcgctttcagatgtctattcgattacccttgacccacagagacaaggagaagtagcgcatcgttatatgctcgggctttatgaactacttgaacatttgacaactgattatccggaaatcttatgggaaggctgttctggtggaggtggacggtttgatgccgggtttatttattatatgccgcagtcatggacaagtgataacacggatgcagtggagcgtatgaaaatccaatatggaacaagccttgcttatccgatttcgtccatcacagctcatgtatcagctgtaccaaatcatcagaccgacagatctacttcgttgaaaacaagaggagaaacagctatgagcgctgtttttggttatgaactggatttgacaaagctgtctcctgaagaaaaaaagcaagtaaaagaccaaattatatcctatcaaacgattcgtccggtgatccagtatggccattattatcgtttggcgagtccttttgaagaaaatattgccgcatggatgtttgtgtctcctaaacaagatgaagctattgtgtttttagggaggatactagcttcagctcaaccagcgttccatgaagtatatctgatggggttagatgatgaggcactttatcaggaacagacctcgaagcggatattttcggggagccgaattgatgacagttggactttacttccccgattttcaaggtga

SEQ ID NO: 1343 - DNA (genomic), 732 bp, Enterococcus faecium; double-stranded, circular
  misc_feature (B) LOCATION 1...732
  hypothetical: NO
  anti-sense: NO
tttagatgttttccattctattatgttattaaattttatattggaggcctatctatgacattactgatcaaaaacatgaacatgaaacgtggtaaaaaacgtgtgattcgacaattgaatcttttagtagaatcaggagaagtagctgctttgattgccccgaacggatttggcaaaacaactttgctgaatggcattgcccaactgctgccaacaacttatgatcaattgtcccttcacaacatctctcctactgcttatacagattatcgccggtctttcttttttctagaatcaacgaatcagttatccgactatctatcggctgttgattatttgactttgatcaaatactattggcagagcaaagtagaatgccaaactgttttccaacgattgaagatgactgagtaccttactttgccgattggaaaaatgtctctaggaatgaaacaacatgtcttgcttgctgcttacttgatcagtgattcatctgtcatgttattcgatgaaccgttgaacggattagacccaggaagtattgatatcttgaatagcctcatcagacaatggcagaaagaggggaagacgattcttctttcttcccacgctatcgcgaatatccaatcgatttgttctaaagcatgttttctaaaaaatggagaaatcgtcacagaatcctcaaatatggaagagattttagctatttatcgtaaattatatgaggtgtaa

SEQ ID NO: 1344 - DNA (genomic), 381 bp, Enterococcus faecium; double-stranded, circular
  misc_feature (B) LOCATION 1...381
  hypothetical: NO
  anti-sense: NO
cgtggggtaaattcaaaggctcccggcgaattcggcggaaaagggttcaaatcggaaggattggaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaagttccaaagcatcaacacaaacgtgcactcgtcctaaccgcaagaaaatttacgcgtctggtggatacgctactacgtaaacaccaactctatacgccaccaaggagtgtgatagagaaataa

SEQ ID NO: 1345 - DNA (genomic), 330 bp, Enterococcus faecium; double-stranded, circular
  misc_feature (B) LOCATION 1...330
  hypothetical: NO
  anti-sense: NO
tctttttcaaattcttcttttgttttgatgtccactacgttagcgttgacttcgatcacttctaaatgtgtcatattttttacttctttgccgattacttcttgcatttcttcaaagattttttcgatatctttgccatattccacaatgacatccatatcaactgctacttgttttttaccgacttctgtttcgatcccagccgttacattatctgtattcacaagttttcctgccacattagagaagaaaccaccgtttgcagataataaaccgtctacttgttcaattgcgattccgatgattttttgcacaactttatcttcataa

SEQ ID NO: 1346 - DNA (genomic), 207 bp, Enterococcus faecium; double-stranded, circular
  misc_feature (B) LOCATION 1...207
  hypothetical: NO
  anti-sense: NO
ataaattcaaaagacatgtataaacaacaatttcatggatggagtatgtccattttttcgaacgacagtagaataggtgaaagctatgacagatttggtgatttagtcatagttatttcgttcagagtaggaaaagatgtgatgcagtttttttgcaaacagatttttctgctcttttttagtatcgataattgttgttttacatga

SEQ ID NO: 1347 - DNA (genomic), 2226 bp, Enterococcus faecium; double-stranded, circular
  misc_feature (B) LOCATION 1...2226
  hypothetical: NO
  anti-sense: NO
acaaattcaaagaagaaagatgggaaggaaatcaatcagttgaatgaaaaagaaattctccgattacaaaaagaattgaaacgctgggagaacaagtataaaaagcttcaacaagtctttcggctacaagaagaaatcattgctacctatgaagcggcttatggcgaagcacccggacttattgaggaagaagtacaagtaaaagaaagtgaaggaaacagctctttctttaaaatgatggagaaacgttcctataatcgcttcaatcaagaacaaaaagcagctatcacatatgatatgaagaaacatcttcgaatcatagcaggagctgggagcggcaaaacgcaaacaatctgtgcaaaagctgtttatctgatgacgcaaaaacaagtagacgaagaacgcatactaatgatcacttttacaaggaacgctgcaaatgaactaaaaaaacgagtagataatttcagccagagaaaaaccgctgtccatatcggaacattccatagtatcttttttaggatatacaatgaaatttgtcgaaaatttcctgaagtagcaatgcaaggaatacaaggagacttttcaaaggatactgcacaaaaagtgaatgctgttttgcaacagctgatacgtaaatataatctttatatatttgatcaatatggagaaaaaacgattgcttctcggttagactattggcagaatatgaacctttcagtagaagaaatggttcagttagttaaagaaaaatatgattccattgataagaatgcacgacagccgatatcagaacgactgtatggattgctcacggaactccaagaacaaaaaagaagccagcaattgctagagttcaatgatgtactccaaaatctgaaaagcgctttggagaatgaggagatccagcattatatcggccaaaaatatgattatctattcattgatgaatttcaagatactaatccacttcaatgggaaatcgtgaaacggatgacaaaggaaaacaggatcaagttgattgttgttggagatgatgatcagagtatctatggattcagaggatcagagccagcatacatcaagaactttgaaaaagaatatcctaccaaaactcttttcttattaactaattatcgttctcgggcagctattgtccaaggagcaaatagattgatcagctataataaaaatgatcggataccaaaggcgatgattccagcacaaaaagaagcaggtgttatggaagcctatttgttttctgatactaaagcagaaagtcagtggctaatcaaacaaattcagacatttattcaaaaaaatgggaaatataaggaatcaatcatattataccgatcagcttcacaaacgcagcagcttgtccaatctctgctgaaaacgaatattccttttgtactggaagcagatagtccatatgaaggtatctttggtatcaagtctttccaacatttctatcaaaaaattgttcattggcaaacagcactgaatctgcaaaagaaaaatcaggcctaccagcaattgctccggcagctgatggcagactgctacctgaaaaaaagtgaatgcgatcaatacttttctcctaaatatcaaaatatagccgttgcagattatattttgtcgataagccccaatttaaaatcgaaatctgcagaaatccgagagtttgaggaagcgttgcgtaaaacagaccagcatcaagaaatctattcgcttgttcaaagctatcttcatctgccacgtatagctaaggaaatcgaccagagtgatcaagaatggatacgagaagaagtaaagcagcatgctactttcagaagactccaagccttatcgcaagaaacccaagcgacagctaaagaattaaaaacccgcttgattgcttacagacaaggaaaacttgatgcactatgtatccagagcattcacaaaagtaaaggtcttagttaccgaaatgtctttttgattggttgtaacgaaggaagtttgccttataacggagcgacagaaaagaaagtaatcgactttaatgaaataaaagcagaaccagtaacgacgatagaagaagaacgaagactattttatgttgcgatgactagagcaagaaatcgtctgtatctatgtgtacctcaaatgaaaaattcaagaaaattgaaagtatcgagatttatcaaagaaaccgggagtcgtgtgaaaaaaggaaagtga

SEQ ID NO: 1348 - DNA (genomic), 2061 bp, Enterococcus faecium; double-stranded, circular
  misc_feature (B) LOCATION 1...2061
  hypothetical: NO
  anti-sense: NO
atgtgttcaaaaagacgttcaaaacaactaaataaacacgcttgtcgtttagataaggaacggtcgtgttctgaaaaacactacgttaagtttatgatgcgcacgatgctgatcagtttatctgtaggtgtctatatgcatgtacccgttcaggcaacgacacaaaccatcaaggtcgtacgtacctctgtttctgagaccactgattcccctatcactattactcatactttcactgatgcaaatggaaaacagctacttcctgcattgacttcctataataaagtcagttatcctccaacgataaaccactactggttaattcctaacaaaacattatggacatcggaaaccggaagcagtgtgccgctttctatcttttccgatatgactgatcctacaaaaggtgatcagttaaaacagatcactgatattttgaatcatgctttgacagatataaaggacggtggaagcgcacaagtttcttatgtatatgaaaaagattattcacagtttgaaagaaagaaaatcgatgttctggcagggacaaaagtttcgatatctgatctggtagaaaggctgaagaacgcagatggaacacaaggagatatgtccaaagtaatttcaaacaatgggaatatcgtggatacgactaatacaggaacatctactatttccttgtcctattttgatccaattgctttaaaaacaatgactgcatctgctgtgatccatgttcgtgctgatcaaacagctatcaaaggaaaagatcttcacttaagaacaggagagagttacgcccctaaagatcttgttgaatatgtaacaaaaagcgatggaacttcaggaaataaagaagaaatcaaaatgaacgggacagtagatactacaactccgggagaatatcccgttgtattaacttatatagactcgaaaacatcaaatgtggcagaaacaacagctgtagtttatgtagaagcatctgctgcttcatcgactgtcatcactcattttatagatagtcaaacaaataaagaacttcaagcagaaacacatatgagtagtgtaaatcgtattcctgatttgcgcctacctgctgaattttctgatcgagtgccaaatatagatttatcgacttatgaacaaaatgggaaagtcacttctatttctgattggatgcaagcaaacggattagacagaaaaagtcactggtcggagatccttgaagtacttcactcagaactgatgaataataggaagcaatcaggaggggaaattacctttacttatgtttatataccagacaatcgttcattagaaggtcatgatcttattgttcatccaaacgaaaaaataaacaaagaagagttgatccaatcagcaacaaattccttaggtaaacccgtaccgttaaaggatgtatcggttacaatcaatgaagtaccattggaggatggttatttgaccaaacaaacaggtgattttacgattatgtatagttatcatgacccgtattcactccaagaactccatgctcagtcactattacatgttttaccattaaacaaacagatagatcaaaaagaacaaaaaagacaagaagaaagcttgtcagaaaaaaaacaacaaatggctcatgcagtttctccaacagggaaagtaaaacaaacaagaagcctagagttagcaagaatatctagaaaaatctcagaatctaataaaacgataaggcaagaagctcatttggccccacaagtttctggattggaaaatgaaattttagagcctaaaataaaacaacaatcagaaaaagaatttgttgctaaacagtcggaagatcagaaggaatcagatgaccagaaggaaacgaagaaaaaacgcttgtcaactattgattccaccgatgagcatctgcagccgcaagtaccacttcctagtccgggaacacccgcacctggtggaggtattccttcttctgctttaggagatttcatgcgaggtatggcaggaacatgggtatacgctaatcgaaatgaatttgacgcagatgactggttctga

SEQ ID NO: 1349 - DNA (genomic), 462 bp, Enterococcus faecium; double-stranded, circular
  misc_feature (B) LOCATION 1...462
  hypothetical: NO
  anti-sense: NO
atagtatcaaacacaaggtgtttgcgctttcgtgatataatggaatcagtttatagacaggaaagaaaatcaaatagaaagaagggtcaaatgatgatacaaaaaacacgtgtgatgctttatgtcaatgacgtagagatgatttgccgattctttgtagaaaaaattggtgcagaaatttctgaaacaatcgaattgccagaagaatttaagagtattgtactcagcatctcaaaagaattagaattaggcgtattcccaaaagtatttgtgcagaagttttcaccagaggtattaggaccaccgccttctttagtattttttacggatgaatttgaaactatctacgagaacatggaagaaccaggagaaatcacagataacaatggcatcttgactttcaatttttctgaccctgaaggcaattattttgttataggaaaagctgagtcgtctgattga

SEQ ID NO: 1350 - DNA (genomic), 501 bp, Enterococcus faecium; double-stranded, circular
  misc_feature (B) LOCATION 1...501
  hypothetical: NO
  anti-sense: NO
aaagcatcaaaacgaatgaacaaacagataggagtcttacaaatgagaatgaatgtcgaaagttttaatcttgaccatacaaaagtcaaagcaccttatgtacgtgtagctgatcgaaaaacgggtgcgcatggcgatgtcatcattaaatacgacgtccgctttaaacaaccaaataaagaacacatggacatgccaagtctacattcacttgagcacttgactgccgaactaatccgcaatcacgcagattacatcgtagactggtctccaatgggatgccaaacaggcttttacttgactgtattgaatcatgaaagctacgaagacattttagatgttcttgaagcaacaatgaaagatgttcttgaagctactgaagtacctgcaagcaatgaaacacaatgtggctgggctgccagccatacactagaaggtgcacaagctttggctcgtgaatttttagcaaaacgcgatgaatggtctgaagtagaagcatag

SEQ ID NO: 1351 - DNA (genomic), 399 bp, Enterococcus faecium; double-stranded, circular
  misc_feature (B) LOCATION 1...399
  hypothetical: NO
  anti-sense: NO
ccacgatcaaactgcataccttctacaacatctagttctgtttcgatcccttttgattcttcgattgtgatgacaccgtcgtttccaactttttccattgcatcagcaatcaaatgtccaactttatcagaacccgaagaaacagctgctacttgtgcaatggcttcttttgaatcaacaacagttgagatattatgcaattcttcgactgctgcttttgttgccaattcgatcccgcgacgaatgcctagaggattagcacctgcagttacgttttttaaaccttcgcgaacgattgcttgtgtcagaacagttgctgtcgttgtaccgtctcctgcaatatcatttgtttttgatgctacttctgatacaagttttgcacccatgttttcaaaatga

SEQ ID NO: 1352 - DNA (genomic), 264 bp, Enterococcus faecium; double-stranded, circular
  misc_feature (B) LOCATION 1...264
  hypothetical: NO
  anti-sense: NO
atggagtcaaatgcaattgaacaagcacaatttcatgatcgcgcgcataaagaaatcattgatttggcggtaacagctgcagaaaatccaatggcagatgaagcagaggattttgccaatgtcatggctcatccgaaagatccagcttggggattgttgtatgaagagtggatcgagctagctagaaatgtgaaccaagtgatttatgatttaagaaaaaatggcggcatcaaattcgatgcagataatgaggaagatttttaa

SEQ ID NO: 1353 - DNA (genomic), 2871 bp, Enterococcus faecium; double-stranded, circular
  misc_feature (B) LOCATION 1...2871
  hypothetical: NO
  anti-sense: NO
tgggggtcaaatatgaagctagtacaaaacaatgaagtgaaagaaataaaaaacggctttgttaaaaactcgaacaaaattttgggaaagctgaaaaaagtaggtagtttcaaaaaaaataaatatcatactggaaaaattgagggagaagatttaccaaaaagtttacaagataaattgaatgttccgcttgtatttataggtgtttttttaggttcaatagtttttctagcaataacgtacttattgaactttttaaaagctttgttagttgcaatcggacagtcagaaagtgggctacttggtgtagagttcgatcctaagtttagtttggcatatctaaaaccacttggggatacgaaacaatactttatgtgtgctgtggttgcggtaataggagtcgcttatttaatatatgggaaattaaatcatgaaagtgagaaaaatcttgtttacggtcaaaaaggagattcaagactttcaactatcaaagaaattaagagagattaccatgagataccagaaaaaacagaagtgtatgatggtattggtggtgtgccaattagtcactatcaagataaatattatattgatagagacacagtaaataccgttgttttgggagcttcacgatccggtaaaggggaaacatttgttgttcctttattagataatcttagccgagcaaaaatacaaagtaatatggtcgtgaatgatccgaaaggagaattgtttagcgcttcaaaggaaacacttgaaaaacgaggttatcgtgtattagtgctaaatattgatgatccacttgaatcaatgagttttaatcctttacaactagtaattgatagttgggctaacaaggactatcacgaagctagtaagcgagcgaatactttaacttcaatgctctttgcttcaggaatgggtacagataatgagtttttctataaatcagctaaatcagcggtcaatgcgattattttaacgattgtagaacactgttttaacaatgattgcattgaaaaaattacaatgtacaacgtggctcaaatgctgaacgaattaggaagcttattttacactgatccaaagactggaaaagaaaaaaatgctttagatgaatatttcaatactttaccacaagggaatcaggccaagattcagtatggttctacttcatttgccggtgataaagccaaaggttcgattttatctactgcttcacaaggtattgaaatgtttacaagtgatttgttcgggaagttaacaagtaaaatgtctattgatttgaaagagataggctttcctaagtccatacaatttaaagtcaatacgaatttagttggaaagaggattagtatttcatttttgagaaaagaaaatgatgtaattagattaattaagaagtatcgagtgaaagtaaaagctttagggctatgtgttttaaattttaatgaatatcttcaggatggagatatgttggatatacgatatgaagaagagaaatcgagagcatggtatcgtattgaatttcccaaaaaacaagcaaatagtcatgatacttctttagtcactaaaaaattcaagtcaggtaaaaattattctgacttagaaatcagcaccttacgattaaaatacacggatcagccaactgctgtgttcatggttattccagattatgatccgtcaaatcacgtacttgcaagtatttttatcagtcaactttatacagaattagcaagtaattgtaagcaaacaccggataaaaaatgttttaggcgagttcatttcttgttagatgaatttgggaatatgccggctatagacaatatggatgggattatgacggtatgtctaggaagaaatatgctttttgacttagtgattcaatcctatagtcagctagaaacaagatatgataaagcttttaaaacaattaaagaaaattgtcagaatcatattttaatcatgtcgaacgatgaggaaacgatagaagagatttcaaaaaaatgtggtcataagacaacaataaatagaagtgctagttctaaacatttagatactgatagctcggtcactagttcggcagagcaagagcgagtaattacagttgagcgtgctagtcaattgattgaaggggaacaaattattttaagaaaccttcatagacaagatacaaaaagaaataagattagaccatttcctatttttaatactaaagaaacaaatatgccgtatagataccaatttttagcagaagactttgatactcaaagagatattaatgagattgatattgcatgtgaacatatcaatctatctttacaagataaccaaattccatatgcaaggtttatcaaagatttaaaaacacgtttggagtattcaattattaataatattcctattagtgaagaagactatcaggattatctaaatttatcaggatcacaacaaacaattaatgaagaagagctgttaaaactggtaaatacggaagtaaaaagtcaagatatggaaggtcaagttttatcagaacaagaaatgaaaattaatatttatctaaaggaaagtcaaaaggaagcaatagaattagtaaaagtaattaatggaaggttagctgatgaaaattcagcagatatggttataaaaaccattaattcacaaatccttgatacgcctttcattcaatctttaatcaatgattctatagctattcataatgttcaagagagtaaggatcaaattatgatcctagaacaacaattagctaatgcttatgagttagcagtgtttaaaacgaaaaattcaatactgaaaaataaaattatcaagttgaaaaatgctatgactaagctagcaaaagcaatttag

SEQ ID NO: 1354 - DNA (genomic), 966 bp, Enterococcus faecium; double-stranded, circular
  misc_feature (B) LOCATION 1...966
  hypothetical: NO
  anti-sense: NO
aggagcccaaaaatgatactgacaatcacgatgaacccatccattgattccatttattttacaaaacactttgaattaggtacgatgacacgctttgattctccggtacgctatgtaggcggcaagggaatcaattgcggacgagcttctgctctactaggttcatcagttattttaacagggtttttgggcggttattttggcagtatgattcaagatatgctgaaaaatgaaaatttgtttgatttgcattttttacctattgcagaagaatcaagaggtgccgtcacgatcatgcatgatgatgaaacgcagacagagctagtggaagctggtcctgaaatagcagatactactatcaaaaaattaatgaatgatatcaaactaatcagtaaaaataattacctttcagtcattacaataaatggttctgttaacaatccagatccctttttgtatgctaaattattacaatatatcaaagaacaaatagatccttccacctatatattaatggatatatctggacaacatctccgtgaagtcttagcaagtaagtataaaccgatgttcatcaaacctaatatccatgagttttcagatatcatccatcaaaaaattactcaaaaaagcgacataaaacaccatctaaaaacaaatccactatttaaagatatcgatgttatcatgatttcttgcggctcgtatggtgcagtagtcaaagtaaaagaagaattttggaatgttgagatccctaagattcctatcattaatacaacaggctctggggatgccactgttggaggttttgctcattcattagaacagaattatcctttaaaagaatgtgtaaggtacgcaatggcttgcggcatgtcgaatgcacagcaatcagaagtcgggaaagttattccagctgatgtaaaaaatttagcaaaaagcattaaaatcacagaaatgaaataa

SEQ ID NO: 1355 - DNA (genomic), 726 bp, Enterococcus faecium; double-stranded, circular
  misc_feature (B) LOCATION 1...726
  hypothetical: NO
  anti-sense: NO
attataccaaaaaggagagaagaaataatgcaagaattagtaattttgaaaaataaagaagctgtgactacgagcttacaagtggcagaaagcttcgagaaaaaacatcaacatgttttaagagatattgatgcactaaaaaaagatgtgtccaattttggacagatgtttgtagaaggtaatgaaccagattcatatggcagaaatcgacgagttttcttcattagtagagatggatttttcttgctggctatggggtttacaggaaagaaagctatctacttcaaacaaaaatacattgaagcattcaacgaaatggaagatgttattcgcaagaatactgttcctcaaacaattgaagatatgatgatctatcaattagaagaaatgaaagatgttaaaaaagatgtttccatgcttaaagatactatgcgaattagcggacaacaagagtttgaaattaagcaaaaaggaaatatgaaagttatgggagttctagggggaaaagaaagccgagcttatgaagaaatcagcaaaaaagtattctcaaaattttggtctgaatttaaacgtaccttttcaatcccaagatatggcgagttacctcgtaagagattcgatgatgctgtttcatttattgaaatgtggttgccagaaactgcgatccgtatggaaattgatcaactgaacagacaacagagactttttggtgatgacaatgaatag

SEQ ID NO: 1356 - DNA (genomic), 243 bp, Enterococcus faecium; double-stranded, circular
  misc_feature (B) LOCATION 1...243
  hypothetical: NO
  anti-sense: NO
catataccaaattactatttgttgattgtgttaaaggcttgcaaaaacatcttaatgaacttgagcaggtgtaatcagatggacctaaagacatttacagcacagattgaactaatgcatcaagaagctttaagacaaagtgtatcgtacgaagacaagtggctcaacacgttccatggcggacgtgagagcgcacttgatcaagtactcaaattactgaaaggagaatgtcgggatggataa

SEQ ID NO: 1357 - DNA (genomic), 300 bp, Enterococcus faecium; double-stranded, circular
  misc_feature (B) LOCATION 1...300
  hypothetical: NO
  anti-sense: NO
ccgacaccaaataatgctttagtaaaacaatacgtcgcgttgatcggtacagaaaatgtgtcagttacgtttacaaaagaagcaattgaacggatcgctcaaatcgctttcgatgtcaaccgtgacacagataatatcggcgcacgcagactgcataccattttggaaaaactactagaagatctattatttgaagcaccagatatgcaaatgggagaaataacgatcacagaagcatatgtggatgacaaacttggctcaattgcggcaaatgaagatttaagtcgctatattttataa

SEQ ID NO: 1358 - DNA (genomic), 186 bp, Enterococcus faecium; double-stranded, circular
  misc_feature (B) LOCATION 1...186
  hypothetical: NO
  anti-sense: NO
gtccaaccaaatgaaaaatatgagaagctatttttgtttggctgttcttattacttgatgcagaacagctttttcacaacctctccaataaacggtgttctcctgccagctcctcggtcaccagtcacaatatttaataaacatgagaagctattttttgaaattgctccttgtgactcggagtga

SEQ ID NO: 1359 - DNA (genomic), 1512 bp, Enterococcus faecium; double-stranded, circular
  misc_feature (B) LOCATION 1...1512
  hypothetical: NO
  anti-sense: NO
attagaccaaaaagagattattgcaaacgaagatgttctggcaattgtaaaataaggaggaaatcaggatgcaatcacgtttttcagaaaaatttttatggggtggagcaactgctgccaaatcaattagaaggggcttatgatcgagacggaaaaggactatccgttgcagatgctatgcctggaggtaagcagcgctttgcgattatcggcagtgaagaatttgactggacgattgatcaagaaaaatatatttacccgaatcatcgaggaatcgatcattacgatcgtttcaaagaagatcttgccttgtttgcggaaatgggattcaaatgttatcgtttttcgattgcctggacacgaatttttccaaatggagacgaaggtactcctaacgaagcgggattagaattttatgatcagctgattgatgagtgcttaaaatatgatattgaacctgtgatcacgatttctcattacgaaatgcctcttcatttggcaaaagaatacggtggctggaaaaatcgaaaactgatcgacttctatgaacgatttgctcagacagtattagagagatacagcagtaaagtcaaatattggatgactttcaatgaaatcaattcggcctttcactttccagctttaagtcaaggattagtaaaaagcaatggagcaggagagtaccaaaatattttccaagcatggcataatcaattcgttgcaagtagcaaagccgtaaaaatcggccacgaattgcgttcggatatccaaatcggctgcatgattatctatgcaacaacttacagcatcgatgccaatccagtcaatcaggcagcaacaatgatccaaaaccaagaattcaattttttctgcacggatgtccaagtacgtggagaataccctgcatacacagcgcgtacccataaaaaatatggagtcgatccggaaaaattagagcaaacggaaaaagacttccagttgctaaaagaatatccagtggactacatcggatttagttattatatgtctacggcaatcaatgagactgatccacaagcagcaacttcagaagggaacttgctgggaggagtaaaaaatccgtttcttgaggcaagtgaatggggctggcagatcgatccagaagggctgagaatcgcattgaatgaattatacaatcgttaccagaaaccattattcattgttgaaaacggtcttggagccattgatcatatggaagaggatggcacgattattgatgattatcggatcgattatttacgtcgtcatatcgaagcgatggctaatgcagtagcagacggtgtagatttgatgggctatacgccttggggatgtatcgatcttgtcagtgcatcaacaggagaaatgagtaaacgttacggctttatctatgtggatctagacgatgaaggaaatgggacactgaatcgatcaaagaaaaaatcttttgattggtataaagaagtaattgcctcaaatggcgtaaacttgtaa

SEQ ID NO: 1360 - DNA (genomic), 240 bp, Enterococcus faecium; double-stranded, circular
  misc_feature (B) LOCATION 1...240
  hypothetical: NO
  anti-sense: NO
agcttgccaaacccttttagtgagctttactcattgtacctttttaggtacaatggtattgcgaacgatacgtccgtaggacgtactgaaagggtgggacttatgagcgaacaaaatcaaaatttggctagcaattattctaaaaaatatacctatcgatccgagccaaaacaaatcagttttcgagtgagcgaatccgaatttgcaaagctgaagcaatcggctgaagctttgcaatga

SEQ ID NO: 1361 - DNA (genomic), 192 bp, Enterococcus faecium; double-stranded, circular
  misc_feature (B) LOCATION 1...192
  hypothetical: NO
  anti-sense: NO
gctattacaaaatcggcacttattaccatgatcggcccacggtccggtattgatgcaagtctgccagaaatttttgttttgcctaagatcgatgaagagtgggagaaatattcccaaccggagtcgacggactatgaacaaaaaatcaatgagctagacgcagaggtgatcactgctcagacaggaaattga

SEQ ID NO: 1362 - DNA (genomic), 330 bp, Enterococcus faecium; double-stranded, circular
  misc_feature (B) LOCATION 1...330
  hypothetical: NO
  anti-sense: NO
atgattacaaaaacaagaaaacaaggcaattcaatcatgttgacagtacctaaagattttaatgttcctaatggagtcgaagttgaagcaaagttggtagagaatggtattctttatgaatttgttgaaccacaaaaagaattttatgattttagcgaagatattttgtctgatataattgcagaaggctacgataaagatgagattcttgtagaatttaagaatagaaaaaacaaaatgcattcttcctttagagatattgctgaagatacacttactaattctaaagtaatgactaaagaggagttggcaacagaaattggcttatga

SEQ ID NO: 1363 - DNA (genomic), 294 bp, Enterococcus faecium; double-stranded, circular
  misc_feature (B) LOCATION 1...294
  hypothetical: NO
  anti-sense: NO
attataacaaaaaaaacacgtccacaacagacgtgttctttgatttctacacaatcagcttgccaaaaccatccaatcagtcctagcatgcctgtattaaaattgaacgttcatcatctatcatctttcttagtccagcatgtttgcaaccacacctacaattttcagtccaacaatagatttcgactagctaagtcttgcaaaattcaggcagctaacccttcatttactaccttaattatactaaatacccacaacgtttacaagtgtaatcattctaagaaatctgtttag

SEQ ID NO: 1364 - DNA (genomic), 240 bp, Enterococcus faecium; double-stranded, circular
  misc_feature (B) LOCATION 1...240
  hypothetical: NO
  anti-sense: NO
agaaaaacaaagaaaagagggaatgaaatggtaaaagcagaagtaggaagatcttatatatgcaaaccgattggcgtatctcacgaactaattggctgtattgaacgtacatataacaacacggctgtcgtgtatgttgaaagttatgaccaacgagactatccaatcatttatgaaagcaagtaccgcatgctcgtaaaattctgtgatattagtacacctgctgaattggtttcttaa

SEQ ID NO: 1365 - DNA (genomic), 951 bp, Enterococcus faecium; double-stranded, circular
  misc_feature (B) LOCATION 1...951
  hypothetical: NO
  anti-sense: NO
atgaaaacaaaaaaatcactctttttaatcttggcagttagtttcttggtattagccggttgcggaaagcaggcttctgaccaagcggatgaaggaagtaaagaaaagttgtcagtcgtggctaccaattcgatcttggcggacatggcaaaagaggtcggaacagatcaaatagatatccacagtatcgtaccagtcggaacagatccgcatgaatatgaagtactaccagaagacatcaaaaaggcaagcgatgcagatgttattttatacaacggtttgaatcttgaaacaggtaacagctggttcgataacttgatggaaacggctaaaaaagaagaaggaaaagattattttgcagttagcaaaaatgtagaacctctttatttaactagcggtgaagaacatacaaaagcagatccccatgcttggctagacctatctaacggaataaaatatgtggaggaaatcgcacgtatattctctgaaaaagatgcagaaaatgcgacactctataaaaaaaatgcagaagcatatgtggaaaaactaaaagaattagatacacaagcgaaggaaagttttgcttctatcgaagagaacaaaaaattattagtaacaagtgaaggggcattcaagtatttttcacgagcatatgatttgccagcagcttatatatgggagatcaatacagaaagtcaaggtacgcctgatcaaatgaaagcgatcattgatcagataagagcaaaagaagtaccggttttattcgtggaaaccagtgtagactcaagaagcatggaacgggtagcaaaagaaacgggtttgaaaatctatgataaactgttcactgattccatagcaaaagaaggagaacaaggagattcttactatcagatgatgaaatggaatattgaaacgatccatgaaggtttgtcacaaacaaaagaaagctga

SEQ ID NO: 1366 - DNA (genomic), 570 bp, Enterococcus faecium; double-stranded, circular
  misc_feature (B) LOCATION 1...570
  hypothetical: NO
  anti-sense: NO
gaggaaacaaagatggaaaacaaaaacatgaatacaacaaatggatcagttttggcaaatgaaaaaggagaaaaccgcatgatgaatggtgaattgacttatgaagacaaagtcatccaaaaaatcatcggttatgcattgaaagatgtagatggtctattgacattagatggcggatttttctcaaatatggctgaaaaattagtcaacacagataacgtaacagcaggtatcaatacagaagtaggtaagaaacaagtagctgtggatctagatgtgatcgtagaatacggtaaagacatcgaagatatttacaaccaaatcaaagaattgatcagtactgaagtaaacaatatgacacatttagatgttatcgaagtgaatgtgaatgttgcagacatcaaaacacaagaagaataccaaaaagatcaagaaacagtacaagacaaagtaacagaagcagcaaaatccacaggacaatttgcttcacgccaaacagataaagcaaaatctgctgtaggcaaaggtgcacaaaaagtcaaagaaaataacgaaccacgtgtacaataa

SEQ ID NO: 1367 - DNA (genomic), 339 bp, Enterococcus faecium; double-stranded, circular
  misc_feature (B) LOCATION 1...339
  hypothetical: NO
  anti-sense: NO
acccgaacaaaaaggaataatgcattaaaaatcattagattttacaaaaaaataagtaaaccacgttgtcagtttcagaaagtagtgttagactgttttcaatatttgaaacaacattttttattcaaatatggcaaactgccttcacgtgcaaaacagttgcaagaaaatgaatttacactattattagttttacatacctacttatatatcgtcataatatggatgacagtttctagccagtaccgtaaatgctggactataagtaaaagattggctatttcacccttcttttcttatgataaagtggagggtgttttttctttaacagaaacatag

SEQ ID NO: 1368 - DNA (genomic), 1245 bp, Enterococcus faecium; double-stranded, circular
  misc_feature (B) LOCATION 1...1245
  hypothetical: NO
  anti-sense: NO
gaaagaacaaaatacgtgcttttctatgtgacagctatgtcagtcagcatagtgctgatgaaatttttccaattattccaaacggaacaagctacttatatcccgctgttttatcccgctgcttttgcaccacttgttttaagctttttcttgaaccgaagagcagggatcatggctggtattttccaagcagtatctgcacttttcattttttatgattcgattggcacgaactttctaacgattatcttgatgtcttatgttttctctgggctcatggcaacgattgtcagacgcaaacggatctcagaacaaggattatctgctgccatgtgggtcattatttttcctgtgatgatggatgtcattttgatcgtctatcaaggaatgagctttggtgatgcaacgacttggttaatgcttgtctgcgggttcactggtgcactcttctcattcttgctgacgatcggtctacacccatatattgaattgatggtcaatgatgacagtgtaattgtattaaatgaactcagcaatccaaatcatcctttattgaaacagttgctggaagaagcgccaggtacttatcatcatagtatgatggtagctaatctaagtgctaacgctgtagcagaaatcggcggacgttctttgctaactcgagtagcttgctattatcatgatatcggcaagatcaaacatgctagctttttcgttgagaacttgccttcaggagcggaaaacccgcacaatttcttattgccagaagacagtaaacatattatctttggacatgtgacagatggagccaaaatattggaagattataatatgccgcaaatggtgatcgatatttgcaaacagcatcatggaaccacgctaatgcgttatttctacatcaaagcgaaagaacgcaatccggaagtaacagaagagcaattccgttatcctggaccaaaaccgcaaagtcgtgaagcagggatcgtcaatattgctgacagttgtgaggctgcagtacgggcaatggatcatccgacgagcgaaaaaatcgaaagttttgtccataatcttatcgaagagcgtatttccgatggtcaattagacgatagtggactgaccttgaaagaaatccgaaaagtggaaaaatcattgatcagcggtttaagtagcaccttccattctcggatcaaatatcctaaaatgaaaacagaagttgagaagataaaggaagaacaagaagaatag

SEQ ID NO: 1369 - DNA (genomic), 555 bp, Enterococcus faecium; double-stranded, circular
  misc_feature (B) LOCATION 1...555
  hypothetical: NO
  anti-sense: NO
agattgacaaaaaaacaacgctatattaatcgcttctggcttgtattcaaatacttacttgtttctgtattccttgcgttcatgttgcggggatttttattcatcccggtaccagtggaaggcaattcaatggaaaacgtgttgaagcaaggtgatatggttgtgatggaaaaattttcggagatcagacgatttgatattgttgtttttcaattagcagatggcacgatttatatcaaacgagtaatcggtcttccaggagaaaatgtcagctaccaaaatgatcaattgaagatcaatgggaaagtagttaaggaaccttatctaactaaaaacctgaaatcagatcatgcaaatgcatcctatacgacggactttacactacaagagctaacgggacaatccaagcttccggaagataattattttgtacttggagataatcgaagagtttcaaaagatagtcgttcgtttggcacgatcaataaaactgatattctaggtaaagcaagatttgtctattatccacttgatgaaataaaatggatccagtga

SEQ ID NO: 1370 - DNA (genomic), 633 bp, Enterococcus faecium; double-stranded, circular
  misc_feature (B) LOCATION 1...633
  hypothetical: NO
  anti-sense: NO
tcaatgacaaaaagcaagccaattatcattggtgtgacgggtggatccggaagcggaaagacaagtgtcagccgtgcgattttcaacaacttcccggaccattccatcatgatgcttgaacaagattcttattacaaggatcagagccatttgagttttgaagaacgattgaacacaaattacgatcacccatttgcctttgataatgatctgctgattcagcatgtaggcgacttactgaactataaagccattgaaaaacccgtgtatgactatgtagcgcatacaagaagtcaggcaacgatcattcaggaaccaaaagaagtgatcattctagaaggaatcctgattttagaagacgaacgtctgcgtgacttgatggatatcaaagtatacgtagatacagatgatgacattcgtatcattcgtcgtatcaaacgggatatggaagaacggggacgcacattggactccgtgatcgaacaatatttgacagttgttaaaccgatgtatcatcaatttatcgaaccaacgaagcgctatgcggatatcattgttccagaaggcggagaaaaccacgttgctattgatttgattacaacaaaagtagctagtttcttaaaccataaatag

SEQ ID NO: 1371 - DNA (genomic), 420 bp, Enterococcus faecium; double-stranded, circular
  misc_feature (B) LOCATION 1...420
  hypothetical: NO
  anti-sense: NO
atgatgacaaaacacgaagaaatacaaaaaggcgtgatttttccagcaggtgaaaaaaacgaagcttacgctcaagtatttaccgggcaaagctatctgaatatgttagtaaacgatcccgaaatttctgttggtgtaggtaatgtaacttttgaaccaggctgtcgcaatcactggcatgtccatacagacggttatcaaatcttacttgtgaccggaggagaaggctggtatcaggaagaaggaaagccagcaagacgattaatggctggagatgtcgtcgtaacgcacaaagggatcaaacattggcatggtgcgacaaaagacagttggtttgaacatttggcgatcactgctggtaattcagagtttttagaacctgtaacagatgaattatacgaaggattggaaaatcaataa

SEQ ID NO: 1372 - DNA (genomic), 213 bp, Enterococcus faecium; double-stranded, circular
  misc_feature (B) LOCATION 1...213
  hypothetical: NO
  anti-sense: NO
tcgatgacaaacgaagtaactgctggacatgctgccagtgtaggacgagttgatccagaagaaatgtactatctgatgagtagaggattgcataaagaagaagcagagcgcttagtgattcgaggattcctcggttctgtcttaacagcaatccctgtagaacaagttcggaaagaattagtcgaagtaatcgaagggaagttgaatggatga

SEQ ID NO: 1373 - DNA (genomic), 561 bp, Enterococcus faecium; double-stranded, circular
  misc_feature (B) LOCATION 1...561
  hypothetical: NO
  anti-sense: NO
gaggagacaaacatggtcgaatcaccatttcattcaaccactatctgtgccgtcgaaaaagacgggaaatttgctatggctggagatggccaagtaacaatgggtgaatctgttgtcatgaaaggcactgcaaagaaagtacgacgtatctacaatggagaagttgttgtaggtttcgccggaagtgttgcagatgcgtttactttagaagaaaaatttgaaggcaaactaaacgaatataacgggaatctacaacgcgcagctgtcgaattagctcaagaatggcggacacagcaatctatgcaaaaacttgaagcgatgctgatcgtaatgaatgataaagaaatgcttcttgtttcaggtacaggagaagttatcacaccagatgatggtatcttagctatcggatcaggagggaattttgcgttggctgcagcccgagcaatgaaaaactatgctcaaaacgacatgagtgcgaaagaaattgcagaaaatgcgttaaatattgccgcagatatctgtatctttactaatcataatattatcgtagaagaactgtaa

SEQ ID NO: 1374 - DNA (genomic), 210 bp, Enterococcus faecium; double-stranded, circular
  misc_feature (B) LOCATION 1...210
  hypothetical: NO
  anti-sense: NO
tatcacgcaaatccaaaatttagtgatgatttctttgcaatcactttttcgaattccattcttatttattggtgccttcattttagctatgatcacgatgccgcaattatggtggatcatcgtagcgcttatcgttacggtatttctgattacggcactttcatttacaaggatgggcaagcacttcatgatcattcaaaaactgattga

SEQ ID NO: 1375 - DNA (genomic), 636 bp, Enterococcus faecium; double-stranded, circular
  misc_feature (B) LOCATION 1...636
  hypothetical: NO
  anti-sense: NO
atctcagcaaaggataatggaggaaagaacatgatttttgcttataacaaagcacacgtcggagacaccttgatggttattatagccgacgataaaggaacagaaaacactgttgaacgcaaatggaatgttgctcggatcaaagatgaacaaggtcaagttgttgcttggaactttttccatatctccgatcatctaacaatcgaagggaacggccaagtaagcttaacagatgaggaattagcgaaattgaatcgattgatcaaagaagcaggattcgaagaacagcttgaagctgatcatgaaccgaagatcgttgtcgggtacgtaaaaacatgcgtcccacatcctgattctgaccatttatcgattactgagacagaagtagacaatggtacagtattgcaaatcgtttgcggtgcacccaatatcgaagctggacaaaaagttgtcgttgcaaaaccaggagctatgatgccagatggaatgatgatctggccaggaactttgcgaggggtagatagctatggaatgatctgttccgctcgtgaattgcatttgccaaatgctccagcaaaaaaaggaatcttagtattgcctgaggatgccgtagtcggagaagcatttccaaaataa

SEQ ID NO: 1376 - DNA (genomic), 540 bp, Enterococcus faecium; double-stranded, circular
  misc_feature (B) LOCATION 1...540
  hypothetical: NO
  anti-sense: NO
atgcaagcaaaagaagtagtagatcaggtaaccatgaagcgagcattgactcgaattacttatgagattatcgagagaaaccatagtatccaagatatcgtattggtaggtatcaaaacacgaggaatctacattgcatcaagaattgccgaacgcctgaagcagctagaagatatcgatattcctgtaggagaactggatatcactttataccgagatgacaaaaaagaaaatccagaagaaccggaacttcattcttctgacatcccagtttccttagaaggaaaagaagttattttgattgatgatgttttgtatacaggacgaacgattcgagcagcaatggacgcagtaatggattttggcagaccaagaaaaatttcattagcagtcctggtcgatcgtgggcatcgagaattgccaatccgtgcagattatgttgggaagaacattccaacatctcgggcggaagagattttagtagagatgcaagagcttgatggacaagatcgcatcatgattttgaaagaggaagattag

SEQ ID NO: 1377 - DNA (genomic), 285 bp, Enterococcus faecium; double-stranded, circular
  misc_feature (B) LOCATION 1...285
  hypothetical: NO
  anti-sense: NO
gtcaaagcaaagatgactgaaaacagcgaaagcaaaaaggagaaaatattcttcactaaaaacaagctggctgatcgctcaatattgttcacgacgcgccgtccttctgcaacaacttccggcatgcgtgaaaagtcagaatcaatcaagaccacttgtgaggcctgcatggcggcttcattgccagaagccatcgctatactgcagtctgcttctttcatggctagaatgtcattcacgccatcacctgtcatagctactgtattgttacgctttagcaattga

SEQ ID NO: 1378 - DNA (genomic), 504 bp, Enterococcus faecium; double-stranded, circular
  misc_feature (B) LOCATION 1...504
  hypothetical: NO
  anti-sense: NO
tcaagagcaaataaaaaaagccggatcgctccgactgattcaataaatccaacacatttattatatcacataaaggagcggtttgacttgatgcaattgttacgagaggtagatttcaaacagacaagatgtaatgcgagagatgtgctgaagaactttcggcgtttggagcggatggcaggtcgctctttgatagatattaagtcgccgattataacggatatgccgaaggcaccgaagcatggcaataaggcagaagacgcgattattcagatgatggatatagaaacggagagagatgcgattctagcggctttgatggctcttagtctgattagtcgtcagatactctactacagcttctgtgtgccagatagcttctcaaactacagaattagccgtgaagtgggttattcagaaagaagtatacaacggatgaagtcggaagctctaatagagtttgcagaagcatataaacacggaaaaataattgcttataaataa

SEQ ID NO: 1379 - DNA (genomic), 1191 bp, Enterococcus faecium; double-stranded, circular
  misc_feature (B) LOCATION 1...1191
  hypothetical: NO
  anti-sense: NO
attatggcaaaagaacattatgacagaagtaaaccacacgttaacattggtacgattggacacgttgaccatgggaaaactactttaactgctgcgatcactacagtattaggcaaaaaaggcctagcaaatcctcaagactatgctagtattgatgcagctccagaagaacgtgaacgtgggattacgatcaataccgcacacgtagaatatgaaacagaaaaacgccactacgcgcatattgatgcaccaggacacgcggactatgtgaaaaacatgattacaggggcagcacaaatggatggtgcaatcttagttgtttctgcaactgacggtccgatgcctcaaacacgtgaacacattttattgtcacgccaagttggtgtaaaatacctgattgttttcttgaacaaagttgatttagtcgatgatgaagaattgatcgatttggtagaaatggaagttcgcgagttattgagcgaatatggtttcccaggcgatgacactcctgtgatcaaaggttccgcattaaaagcattgcaaggcgatccagatgctgaagctgctattatggaattgatggatacagtagatgaatatatcccaacaccagaacgtgatacagataaaccattactattgccagtggaagacgtcttctcaattacaggtcgaagaactgttgcctcaggtcgtattgatcgtggtgctgttcgtgtcggtgatgaagtaaaaatcggtaggatcaaacctgaaacacaaaaagcaattgtaacaggtgtaaaaatgttccgtaaaacgttaaattacggggaaactggggataacgtaggcgtgttgttacgggggatccaacgtgacgatatcgaacgtggacaagtacttgctaaaccaggttccattactccacatacaaaattcaaagcagaagtgtacgtgttgacaaaagaacaaggtggacgtcatactccattcttcaacaactatcgtccacagttctacttccgcacaactgatgttacaggaacaatcacattgccagaagatacagaaatggtcatgcctggtgacaacgtgacgattgatgttgacttgatccatccaatcgctgttgaaaacggaacgacattctcaattcgtgaaggcggacggacagtaggttcaggtatcgttacagagatcgaagcataa

SEQ ID NO: 1380 - DNA (genomic), 795 bp, Enterococcus faecium; double-stranded, circular
  misc_feature (B) LOCATION 1...795
  hypothetical: NO
  anti-sense: NO
tcaatggcaaagcaaaatattgtcgttgtaggagcaggatatgccggtgtttcagctacaaaatacttggcaaagaaactgaaaaaagaagatgtagcaattactctgatcgatcgtcattcgtaccatactatgatgaccgagttgcatgaagtagctggcggacgtgtagaaccagaagcaatccaatacgatctgcagcatttgtttgctcgtcaaaagaatgtacaacttgtcacagacactgtaatcggtatcgataaagaacgaaaaatcgtcaagaccaaattaggttcctatccttttgatcagctgatccttggaatgggcggagagccgaatgactttggtacacctggtgtcaaagcacacggattcaccctttggtcatttgaagattctgtaaggattcgggaacatattgagaagacagtagcaaaagctgcattggaaccagatgatgaactgcgtaaagccatgctgactttcgttgtctgtggttctggatttaccggtattgaaatgattggggaactgatcgactggaaaaatcgcctagccaaagattataaattagatccaaacgaaatcacactgatggtcgtagaggcaatgccgacgatcttgaatatgttggatcgaaatgatgctgcaaaagctgaacgctatttgcgtaagcacaacgtggaattattattgaatgcaccaatcgtagaagtggctgctgatcatatcaaattgaaagacggacgcaacattccgactcacacactgatttggacagctggtgtctaa

SEQ ID NO: 1381 - DNA (genomic), 864 bp, Enterococcus faecium; double-stranded, circular
  misc_feature (B) LOCATION 1...864
  hypothetical: NO
  anti-sense: NO
ggagtggcaaatatgcattatttagtaacaggagcaactggaggttttggtggttatgcgctggaattcttaaaaaagatggttccacaaaatgaaatctatgtactagtacgtagtgaagaaaaaggagaagcactgaaagaagctggatttaatatacgtattggtgattatgatgatttagactcaatgaaagaagcgttgaaaggaatagatcgattgctttttgtctctggcgttccaggaaatcgtcaagccgaacataagaatgtagtgaaggcagcacaagcagctggggtatcttatatcgcttatacaagttttgcagatgccgatcactcgatcagtgtattagcgccagatcaccaattcactgaaaaaatgattaaggattcaggtatttcccatacatttttacggaataattggtatgtagagaatgaattacctatcattgggcaggctttaaaaactggtcaattcgtttatgctgcaggaaatggaaaaacaggttgggcattgaaacgtgaatatgcagaagctgcagcaaaagtactagtagaaagtgactctccagaaatcttagaattatccggcaatctaactgactatgaagaattagccaaggcattagagcgtgcgacaggtaaagagttagaaattattgaagcaagtgatgcagcgtttgtcgaaaatctaaaagaagccggattccctcaagaagcagctgacatgtttttagcgatccaacatgatattaaaaaggatcagttagctatttcctctgatgatttagaaaaagtattgggaaaaccattaacttctcttgaagcagcattaaaagaaatattggatcaggaataa

SEQ ID NO: 1382 - DNA (genomic), 549 bp, Enterococcus faecium; double-stranded, circular
  misc_feature (B) LOCATION 1...549
  hypothetical: NO
  anti-sense: NO
tatattcaaaaacgatcctacctacaaagacctttatcaaaagatccaagagcaaggagcgtagctgtgatgaaaatgattttaaacaaggtattagagatcctgggagctgttttgcttgttgggatggtcgctgttgttttatggcaagtattttccagaacggttttaggaaatccaaatacggtcacggaagagcttgttcgattcggtcttgtctggtttgccatgttgtcttccgcgtatgttgtgggacaaaaagcacatttagccgtaacggttttaagtgaaaaattaactggcaaaaaaagtaaaattttagaagttgttgttcaaagtttatttctggtatttgctgcgatgatcatggtgtatggcggatggaatgctgtcacattgacaatggggcagatctcgccttctttaagtattcctatgggatatgtttatctgtcagtacctgtatcgggggtactcatcattatctatagcctgatcaatctaatcgatacattaagcaacaagccagcaattcaagaaaaaatataa

SEQ ID NO: 1383 - DNA (genomic), 1497 bp, Enterococcus faecium; double-stranded, circular
  misc_feature (B) LOCATION 1...1497
  hypothetical: NO
  anti-sense: NO
acaaatcaaaatcaaggaagagaggttcgaaagatgggaaaatatcaactaattgcagcaaccggttgtccgacaggaattgcgcacacctacatggcgcaagaggcattagagcaagcagctaggaaaaaaggcatcacgatcaaagtggagacccatggacaaattgggatcgagaatgaattaacggctgaagaaatcaaacaggcagatgctgtcattattgccgcagacaaagatgtccattcagaaagatttgcgggaaaacgagtcattgatgtttctgtcagtacaggaatcaaagatgcaaaacggctgattgacgaggtattggcaggaaaaggggccatcttagcagataatgaagctgttgatactttagaatcagaaacgataagtggtgctaattttggtcgcagcatctataaaaatttaatgaatggcgtctctcatatgttgcctttcgaggtagctggcggagtattgattgctatttcatttgccgtttggggaatctattcttttgatccagaccatgcacaatacaatgctacagcggcgatgttaaaaacggttggcgatgcagcaatggggatgatggttccagttttagcagcttatattgcagaagggatcgcgaaacgtccagggttagtcgttggattcgttggtggaatcgtggccatgaatggcggtactggatttttaggaggtattttagctgggttcttagcaggttattttatcttatttttgcaaaagttactgccaattttacctaaacaactagatggcttgaaggcaatcttcttatatccagttattggtgtagcgtttatcggcatcgtgatgtctttgttggcggatccaatgaaggctataaatgaaggaatgatgagctttttagctggatttgaacattctaatccacttgttcttggagtgattgttggttgcatgtgtgcgtttgatatgggaggaccgattaataaggcggcatatgtaacaggtacagctcttttggcacaaggaaacacgacttttatggctggggtgtcagcagcttgcattgcaccaccgttgattaatggttttgctactttattgtttggtaaatattttgataccaatgatcgtaatgcaggtttggttaattttattttaggatcaactcatattacggagggagctattccgtttgctgcgaaagacccgatccgagtattaccaacgatgatgttaggctcatcaattgctgctgtcttgacttatctgtttggtgtccaagtaccagccccacatggcgtttttttagtgttacctgtagtgacgggaaaaatccaatgggttacagcgattcttattggttcgatcgttggtggagtgatactaggtttgatccaaaagaaaagagtaactgataaagacaagaagagggataataaagcagcaaatcgtacagttatcgaagaaggaagagcaggaggcttatcatga

SEQ ID NO: 1384 - DNA (genomic), 294 bp, Enterococcus faecium; double-stranded, circular
  misc_feature (B) LOCATION 1...294
  hypothetical: NO
  anti-sense: NO
actggtcaaaataacaacattaaaaacttgatgacagggacacgttcgttgaatgctccatacatgcttgctcacgaaaatgatattgcggcatatatcaaagaaacaaatcatcatgtacgctaccgtgtcactcctcattttgaggggaatgaactggtagccaggggagtgcaattggaagcagaaagcattgaagacaaaaaaattgaattcaatgtctttatctacaatgttcaagatggctacacgatcaattatgagacaggacaagcaacaaaaacaaaaaattag

SEQ ID NO: 1385 - DNA (genomic), 216 bp, Enterococcus faecium; double-stranded, circular
  misc_feature (B) LOCATION 1...216
  hypothetical: NO
  anti-sense: NO
tcaggtcaaaacgttgacttcacagtctcttccttaaacggtgttctcctgccaactcctcggtcacaagtcacaatattcaacaaacatgagaagctgttttttgaaattgttccttgtgactcggagctgaacggcaggctcacgacctctttcttaaacggtgttcaaaagcttgcatctgcggtaataagttcaaccaaacgaaaattatga

SEQ ID NO: 1386 - DNA (genomic), 741 bp, Enterococcus faecium; double-stranded, circular
  misc_feature (B) LOCATION 1...741
  hypothetical: NO
  anti-sense: NO
aattaccaaaaaaggaagatcaaaatgatgacaaatgtcctgataatcgaagatgatccaatggttgcagaattgaatcgtacttttgtggaaagcatccctaatatgaacgtaatcgaaagtttcagaaatgtagaagaaggaaaaaaatatttcagacaaaaaaacgcagatctgctgctgcttgatgtatacatgcctggcgaaagtggtatccattttttatcttggcttagacagcaaggaaatgatatcccagtgattttgatcactgctgcagatgatatcgaaaccataaagaatgtgatccgctacggtgccttagattatttgatcaaaccgttcactttgcaacgttttcagctggcgatcgaaaagtatcttgctttctctcagacaatccaaacgactgaaaaagccgatcagaaattgatcgatcaagtattcaaccacaccactcccattcacgaaataccatcattcatcgatttgcctaaaggtctgtcaaaactgactttaaaaaaaataagtgcatttattctaaaagaagatactattttttcaacaaaagaactggctcaaaaaagctcactgtcacgtatatccgtcaagaaatatttgaattttttagtagaacaagatatattgaacgaaagaatcaaatatttggaaatcggccggccgctaacctgttatgaattgacaaagaatgggcggaaaaagctcacagattactgttga

SEQ ID NO: 1387 - DNA (genomic), 1632 bp, Enterococcus faecium; double-stranded, circular
  misc_feature (B) LOCATION 1...1632
  hypothetical: NO
  anti-sense: NO
gtgtaccaaaaattagtagcaaagctgatcgacacaggtatagcaagtggcgaagcctcagttataaaaaaaattggagttgaaatgctgcttgtagcgtttctaggaacaatcgctgcagttgcctctagttacttttcagcattggcttccgctaggtttggattccaaacgcgggagaaatatttccgtaaattccaacagctgtcaatgaaggatatcagtcgttttagttctggatctcttttgacaagaatgacgaatgatgtcgataatgtccagcaaatgattgttttattttgccaaatgatcttaccagcaccggttatttgcgttttcaccattctcatgatgtttcgttattctctattactaacatgggttacattgatctctgttgttttttatgtatggattgtttatcgactgatgaaacgaggggcacctttatctttgagtatccagccaaaaatggatcggatcaccatcacattgagagaattctttactgggattaatatgatccgtgcctttgataatcaatcatatgaagaaaagcgaacgaataagagctttgctgactatgctaatcaaatgatcaaagtgaaccgaatatttgcttgggtcactccaattgcttttttgctcatgggaatcgtttatgcttctattttgtggtttggcggaaatcttgtagcagaaggagcattacaaatcggtgtcgtgactgctgtagtcgaatactctatgctgacacttgcttacttgatgatcgcagctatggtattggtcattatccctaaatcgtttgcctcattacgacggatagaagaaatactgcaagcagagatcgaaattgaggaagagacgatcaaaacagtagctgaaccaacctttgatcagacaaatgcagctgcttttgaacatgtcacatttaaatatactgaaatctctgatccagttctagaagatattgatttcacaatacctaaaggaaaaacaacagcgatcgttggcgggaccggatctggaaaaagtagtttggcgaaacttctcttgagacttagtgaccctacgataggaaaagtaacccttggtggtattcctcttactcaaatgactcaagaacagatccgctcccacatcagttatgtccctcagaaggctttcttattcagcgggacaattttaagcaacttgcagatgggaaatgaatatgcctcaacagaagagttgtctaaagcgatcaagatcgctcaattagaagaactagtggacacccttcctgacggattggacagctttgttgctcaaggcggttctaattattcagggggccagaaacagcggatatgtattgctcgagcgttgatcaaaccagcagagatctatgtattcgatgatagtttctccgctttagactataaaacagatgcagcattaagagcagcccttcataaacacatgtcggagaaaactctcgtgattgttgctcaacgcctcagtacaatccaacaagcagataacatcattgttttagatgaaggaaaaatcgttggacaaggtactcatgaagaactactgtctaattgccaaacttatcaggagtttgcaaaatcacaaggaatatag

SEQ ID NO: 1388 - DNA (genomic), 243 bp, Enterococcus faecium; double-stranded, circular
  misc_feature (B) LOCATION 1...243
  hypothetical: NO
  anti-sense: NO
cttatacaaaattactatttgctgattgcgttaaaggattgcaaaaacatcttagtgaacttgagcaggtgtaatcagatggatctaaaaacatttacagcacagatcgaactaatgcatcaagaagctttaagacaaagcgcctcgtacgaagacaagtggctcaacacgttccatggtggacgtgagagcgcacttgatcaagtgctcaaattattgaaaggagaatgtcgggatgaataa

SEQ ID NO: 1389 - DNA (genomic), 573 bp, Enterococcus faecium; double-stranded, circular
  misc_feature (B) LOCATION 1...573
  hypothetical: NO
  anti-sense: NO
caaccacaaaaaatcgctaaagcaattcaacgtgcaattaccatgagttaccgcctatgtgctcttgcacaagaatcaattaatgttgttttaagtgttctcgtacgagaaatacgagcacttgatgaaaatatcacagaattagataaagccatcgaacaagtaattgttgtcattccagaatatcaatgcttaaccagtattccaggcgttggtaaagtctatgctgccggtttaatcgctgaaattggtcaaatcgaaagatttgaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaggttccaaagcatcaacacaaacgtgcactcgtcctaaccgcaagaaatttacgcgtctggtggatacgctactacgtaaacaccaactctatacgccaccaaggagtgtga

SEQ ID NO: 1390 - DNA (genomic), 1095 bp, Enterococcus faecium; double-stranded, circular
  misc_feature (B) LOCATION 1...1095
  hypothetical: NO
  anti-sense: NO
atggcacaaaagaaacggcctactaaaaaaaggaaaaagacgaaaaaaacgaaaaagcaaaaacagcagcaggaacaaatgctgacgattggtgttgggtttgccttgattttatttgctgtcttcggctttttaaaattaggttttttaggaatattgattgcaaacggctttcggatcattgcaggaaatacttaccaaatcctctgtcttttattagccgtattaggattttggattgtcattaagaatacagagttttcaattggtaaaaaccgacgctggtttggcggcatactcttttatttcggtatcttattattgttacatgcccatttatttggcaaactccatactggggaaccaaatatcatggggacgacatgggatttgttagccagtgatataaaacaaagtcaagtagacaataacgttggtggtgggatgattggagcaatcctttatcattttacttacttcttgattgcacagcctggaagttatttagcagcagtgctattactggcaggaggagcattcctgttcagtaatctggaaggctatcagctgttaaatggtatccaatcaattggagaacgagtacaggaattattggaaggtgatcctgccaagcaagctcgaaagcaagcggcaaaggaagagagaatgaaacagcgcgcagaagcgaaagaagcaaggcgcttagctgcaaaagaagctgcagaaaaagaagctgcagaatatgagaagaaaaaagcggtgagccagcaaagggaaaatactgctgatgaatggcaggaaccagaaaatacagagccggagcagctaagttttgttccaatcgacagttttcaagaaaatatccatcctgcgaatctagagaaaccagtaccagatacaccaaaacagaccaatacagcagaaggtttttcagatgagttgccagaggatgacggtacctcattagaatttgagattgaagcagaacaggaaaatcaagactatgaattaccgacagttgatttgcttgattctataccaactgtggatcaaagtgatgagtgtataaaaattgaaaaaatatcggcgtattag

SEQ ID NO: 1391 - DNA (genomic), 270 bp, Enterococcus faecium; double-stranded, circular
  misc_feature (B) LOCATION 1...270
  hypothetical: NO
  anti-sense: NO
ttcaaacaaaaaggttggcatcttttttgtaaaatcattcgtgtgtttttctataaattttataaaaacaagttgtttttaatcttggaacacgctagacttaaacacgtgattatttttgaaagttggcggaaaatggagaaaaagaaaatgaatggacttacacagcaagaggtagttcagaaaatggcttctggccagcaaaatgactaccaggaagatgcatcaaaaagtacaaaacaaatattcagcgataatatattgacgtaa

SEQ ID NO: 1392 - DNA (genomic), 441 bp, Enterococcus faecium; double-stranded, circular
  misc_feature (B) LOCATION 1...441
  hypothetical: NO
  anti-sense: NO
tttgaacaaaaaggagaatctctttttatgttaaaagtatacattgatgcctctacaaaaggcaaccctggtcctagtggaggtggaatcttgattgtctatcaaggtaaacaagaacagctatctatcccgctttctatagngacaaaccatcaagcagagttcgaattctttttaaaaactttagaatttctaaagaaaaacgacttacagaatganacgattttctgtttttcagacagcaaaacactagtttctacggtcgacaaaaacgcaacgaagaacgagctcttccttccctaccttcaaagaatccaagaacttctatccgaattttctttattgatcctgcaatggttgcccgaaaacaaaaataaaggagcagataatcttgcacgtcaggctctccataaacaattaaaagaaaaaaagactctttaa

SEQ ID NO: 1393 - DNA (genomic), 204 bp, Enterococcus faecium; double-stranded, circular
  misc_feature (B) LOCATION 1...204
  hypothetical: NO
  anti-sense: NO
ggaggacaaaaatactatgaactattgaataaaatcaatgaaaatacatcaaatactgttttaccagccacttattcagatgctacgtcttatttgactaccgctgcatataactattggcaaacaggtgattttgaaaattcatatctaaaagaagcagaaaattttgctcataagtacggcgtaaaattaactggtgattaa

SEQ ID NO: 1394 - DNA (genomic), 1473 bp, Enterococcus faecium; double-stranded, circular
  misc_feature (B) LOCATION 1...1473
  hypothetical: NO
  anti-sense: NO
atgttgcaaaaacttttaaaggccaatgagtttattgagaaaaatgctcaaacagtcaatcaagaataccggaataaatttcatttgatggctccgattggctggatgaatgatccaaatggttttgtttattatcaagaggagtatcacttgttttatcaatattatccttacgacagcatctggggaccaatgcattggggccatgctaaaagcaaggatctaattcactgggagcatttgccagtagcactggcaccaggtgaaagctatgacaaggaaggctgtttttccggcagtgccatagaaaaggatggcaagctgtatttgatttatacaggacacaatgttgtggaagggcaagttcgacaagttcagtgtttggcagtttcagaagatggcattcactttgaaaaatatgccggaaatccaatcatcgcagaagatcacttagcttctgttgcaacgaccgaagatttccgcgatcccaaagtgtttcagcgaaaagaagactattttactgtagtcgctactaaaactgcagatgctcgtggacaaattgtgatgttccattccaaagatttactaacttgggagttttattccgtattgctggagggaactccagaacaaggcattgtatgggaatgcccagacttgtttgaactagatggcaaagaagtcttgattctttctcctattcaaatgactccacaaggcaatgcttaccaaaatacgaactcaactgttgctttcatcggtactgtcgattggcaaacaggcaaatttctagtagagaattttcatgaaatcgatggcggtttagatttttatgcaccccagacctgtgaaaacgaagcaggccaaagaataatgattgcttggatgcaaatgtggcagcgtaaaatacctacgaatgatctgggccatggttggtcaggttccatgaccttgcctagagagctgagggtggctgataatcaattgttgcaacggccagtttcatcaatttatcaagtaattgatccgcagaaaaggattgaatgggcgaagactgaagagaatcgcttcttactgaaggacttagtatatgaccagcactatttacgcttggaaatcaatttaaaacaggcaacgaaactagaacttcactatgcgaagggacccgaccatacattactgcttaactatgatgttgaacgggagtgctttactgcttccagggaacacatgccgtatgatttatcaggagctgaaaaggaagtgttgaaaaagcgcagtgtgacgattcctttggaaaataattgtctaaccatcgaaattttccgtgatacttcagctattgagctttttctaaatgatcgtctgactatgagtacaactttttatgagacagaaaaaggacaggattttcttttgctggcagacagtgaagtaaccttttcattggaaagcggcttaattaatctatag

SEQ ID NO: 1395 - DNA (genomic), 1035 bp, Enterococcus faecium; double-stranded, circular
  misc_feature (B) LOCATION 1...1035
  hypothetical: NO
  anti-sense: NO
agaatgcaaaaaaaaattagcatcatcactatattttttatttgtgtgcttacttcatgggttattcagcatcaagccgctttatatgaagtacctgtcatcgagatagaaaaagtacgaataaaagaggatcatcaattgattacaggaaaactgatgaacacggatcaaaaaggagaatcgatttatttatcggttccttatcaaaaaaatcaaatagaaacagcaaatataaaagcgagacaaatgtatctagtccaaatgcatggagatgaatggcagctagtagcaaaaaaaaatgatggctggcttttcttcttcacaagtatcttcattggcgccatgttgcttattggtggaaaacagggtctatttgctttaggaagtctcatcatcaatatcgttttacttttacttttgttgctcatctttactaaaacagaagggatttctctattaaatatatctatcctgttcgtcgttatagggatgattattagcatattggctttagatggatggaatagaagcagtataatcaaaatttcagctgcagttacgagtgtttttttagcattttttatttgtcttttgacaatgaatcattggaaagaccaaggactgcgctatgaggaactgaattatctgacacgaccgtatcgttctgtttttctttctagcgtactgattggaacagctggaggaacactcgataccgttatcacagtcattgcgacattagaagaattgactaagcgacaaccagaaataacagcgaaacagttatggctttcaggaaggcaagtgggtcgagatgtgattggctcgatgaccaatatccttttgttcgtctatatcagtgggtcagttccatcgcttcttttatatttaggaaatcaatggtcgttcaaagaaacgatagaacagcatttatcattggaatttttacgcgtcattgctggcagcttaggaatagtattatcgatccctatctcggtcctcttttttctgactgtaaggaggctgaaacgatga

SEQ ID NO: 1396 - DNA (genomic), 2343 bp, Enterococcus faecium; double-stranded, circular
  misc_feature (B) LOCATION 1...2343
  hypothetical: NO
  anti-sense: NO
tacgcgcaaaattcctttgtgcagggacgcgcccgtaccagaccgacaatctgtacgccgccctttcgcggcagactgaggaggtatcgacgattgaaaacaaaacagcaggcaaagcaggccaaaaacctgcaagcggcaaaaaaagaactgaaaaaagaaaagtctgacttaaaggccaccctgcgcctgaccccggacgcaaaactcaacagccgggacaagcggcggcttgcggcatcggtcagcaaggcaaagcgggacggcaggcttcccaagaccgcccagcagaccatcccctaccaggaaatgtgccgggacggtatctgtatcgtgggcgaccgctatttcaccaagcaaatccagttttatgatgtgaactaccagcttgcacagaacgaggacaagaacctgatttttgagaactactgcgatttcctcaactattttgacagctccatcaaggtgcagctttctttcctcaaccagcgggccgacatggaggaataccagaagtccatccatatcccggagcagacggacgcatttaacggtatccggcgggagtattcgggaatgctcaaaggccagcttgccagggggaacaacggcctgacaaagaccaagtacatcacctttggcattgaagcagacagcctgaaagaagcaaagccccgcctggaacggattgaagcggatgtgctggcgaatttcaaggtgctgggcgtccgcgcccattcgctggacggctatgaacgtctggcaatcctgcaccggatgtttcacccggcggacaatcagaaatttaagtttgcctgggatgccatctggaaaaccgggctttccagcaaggatttcatcgcgccggacagcttcaccttcaagtccggccagtatttccagattggcaggacttacggcgcggtgtcctttctgcaaatcctcgccccggaactgaccgaccggatgctggcggatttcctcgatctggaaaacagcatggtggtgacactgcatatccagtccatcgaccagagcgcggcaatcaagaacatcaagcgcaagattaccgacctcgaccgcatgaaaattgaggaacagaaaaaagcagtccgggcagggtacgacatggatataatcccctccgaccttgccacattcggcagcgaagcaaagacgcttctggaagatttgcagagccgcaacgagcggatgttccttgtgactttgcttgtgatgaaccatgccaggacgcggcagaagctggaaaacaacatcttccaggcggcgggtatcgcgcagaaatacaactgtgcgctgcgccgtctggactaccagcaggagcagggcctgatgtcctccctgcccctgggcttaaaccagatcgccatccagcgggggcttaccacctccagcactgccattttcgtgccgtttaccacccaggagctttttatgaacggtgaagcgctgtactacggcttaaacgccctctccaacaacctgatcatggctgaccggaaaaagctgaagaaccccaacggcctgattttaggcacccccggcagcggcaagtccttttccgccaagcgggaaatcaccaacgctttcctgattacccaggacgacatcgccattatcgacccggagcaggaatattcgccccttgtgcagcggctgggcgggcaggtgattgacatttcccccgcctccgaccagtacatcaacccgatggacctgaccctcaattacagcgaggacgacaaccccctgaccttaaaaagcgactttatcctctccctgatggagctgattgtgggcggcaaggccggcctggagccggtggaaaagacagtggttgaccgctgcgtccacatggtctaccgggactacctgcaagacccgaagccggagaaaatgccggtgctgggcgacctttaccgccttttgcgggaacagccggaggcggaagcacagcggcttgctaccgcgctggaaatctacgttactggcagcttaaatgtgttcaaccaccagaccaacgtggaaatcaagagccggattgtctgctatgtgattaaaaacctgggcaagcagcttaaaaaattcgggatgcaggtggttcaggatcaggtgtggggacgggtcagcgaaaaccgcgaagcccataaatccacccggctctacattgacgagatgcacctgcttctccgggaggaacagaccgccgcctataccgttgagatttggaaacggttcaaaaaatggggaagaatccccgaccggaattacccaaaatgtcaaggatttgctggcaagccgggaaattgcgaacatttttga

SEQ ID NO: 1397 - DNA (genomic), 915 bp, Enterococcus faecium; double-stranded, circular
  misc_feature (B) LOCATION 1...915
  hypothetical: NO
  anti-sense: NO
aatcttaaaaaaagccgcagccatattctctcggaaaacctaaattcgcttgttcaatttattgaaaaatggtgtaaggattacactgtttctttgttgtgtcggttattagaaatccctagaagtgtctattatttttataagaataaaccgttgacagctacagaaatcagaaataataagttgaaaaagaagatttcaacaattttttttacgaataaacaacgctatggtgccacaaagatccatcaagttttattaaaagaagggatttcagtatctcttaaacatgtccaaaagctaatgaaacaattaaatttaaggtcgattgtagttaaaaaatatagacctcaaaggtctaataaaccgatcatttcaaaagagaatctcttaaatcaggacttttctactgaaacgatctgtgagaaatgggcagctgacattacgtacattcctactaagaaaaatggttggtgttacttatcttcaatcatggatttacacacgaaaaaaattattagttatacattttcaaaacgaatgactgtggattgtgtcattcaaacattgaataaagcaaaaatacattatcacattccagaaggaatgattctacacactgacttgggcagccaatacacagcaagagaagtggaacaatggcttaaaaccaacaaaataaggcattcttatagtagaaaaggaacaccttatgataatgctggaatcgaatctttccatgcctcattgaaaaaagaagaagtctacacgactagctactcagattttgaagaagcaaatcgagcgctatttagctacattgaaggattttataaccgaaatcgaatccatagctcgattcactatctaaccccacaggaatttgaagaattagcaaaagaaaaaatggcttaa

SEQ ID NO: 1398 - DNA (genomic), 321 bp, Enterococcus faecium; double-stranded, circular
  misc_feature (B) LOCATION 1...321
  hypothetical: NO
  anti-sense: NO
attattaaaaaacacattggaggatttttcatgccaagacttcaacgaagaacctattcaaaagaattcaacnaacaaatcgtcgatctctatctcgntggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 1399 - DNA (genomic), 1062 bp, Enterococcus faecium; double-stranded, circular
  misc_feature (B) LOCATION 1...1062
  hypothetical: NO
  anti-sense: NO
agcgttaaaaatgaaaaaaatttcaggagtggtaaaatgaattatagagtagcggttttaggaccaggctcttggggtactgctttggcacaagtcctcgccgaaaacggacatgacgttcggatttggggacatcgtgcttcacaagtagaagaaatcaacacccaacacacgaatcaacgttatttaccagatcattatctacccgattccatccaagcattcaccaatatggaagatgcagtaaaagacgcagatgcggtgctattcgtcattccaacgaaagcaatacgttctgttgcaaaagaactagtgcctaaattgaatacaaagccagtgatcatccatgcaagtaaaggattagaacagggaacacataaaaggatctctgacatcttgttagaggaaatcccagcagaaaaaagaaaagctgttgttgttctttctggaccaagccatgcagaagaagtagcaaaacatgacatcactacgatcacagctgcaagtacagatgcaaaagcagcaaaatatgtacaagagctgttcatgaataattattttcggatctataccaatcctgatgtgatcggtgtagagatgggggcagctttgaaaaatattattgctattggtgctggcgctattcacggcttagggtttggcgataatgcaaaggcagcaatcatgacgcgcggattagctgagatcagccgtttaggtgtagcaatgggtgccaacccgctgacctttatcggattaagcggaataggcgatctagtcgttacttgcacaagtgttcattctaggaactggcgcgcaggcaacttgttaggacaagggcagcccctagaagaggtgctagccaatatgggaatggtcgttgaaggtgtgaatactacccaagcagcgatggaactagcccaaatgatggaaatcgaaatgcccatcactcaaacaatctatgaagtgctgtatgaacaaaaagaaatcaaaacagccgcaaaagaaatcatgttacgtgatggaaaaaaagaaaatgaattctcattaacaattttttga

SEQ ID NO: 1400 - DNA (genomic), 1326 bp, Enterococcus faecium; double-stranded, circular
  misc_feature (B) LOCATION 1...1326
  hypothetical: NO
  anti-sense: NO
aaagttaaaaatgcaggtatgctaggatcacgtaaaggggtaaatgcaccaggcgtttctattagtttgccaggtattactccaaaagatgctgacgatattcgttttggtttagacaacgatatcgactttatcgctgcaagttttgtacgtaaagcacaagacgttctagatatccgcgaaatcttagaagaaaaagacatgactcatgttcaaatcttccctaaaatcgaatctcaagaaggtatcgacaacattgacgaaatcatcaaagtttctgacggtgttatgattgcccgcggagatatgggtgttgaaatcccagctgaactagtaccaatggttcaaaaacgcattatcaaaaaatgtaatgctgctggtatcccagttatcactgctacacaaatgttagaatcaatgcaagaaaacccacgtccaacacgtgcggaagcttctgacgttgctaacgctgtatttgatggcacagatgcaacaatgctatctggtgaatctgcaaacggggactacccagttgaagctgtttcaacaatggcacgtatcgaccaagaagctgaaaatgcattatcagaattaggtacattccaattgaacgaattcgataaaacagatgtaactgaaacaatcggtttatctgtagctcgtgctgcaaaaaatctaggcgtgaaaacaatcgttgctgcaactgaatcaggatacactgcaaaaatgatttcaaaatatcgtccagatgcagatatcttggctgttacttttgacgaacgcacaaaacgtggtttgatgttaaactggggcgtttacccaacagttgctgaaaaaccatcaacaactgatgaaatgtttgaactagcagctaaaaaagctgttgaattaggtttcgcatcagaaggcgatttaatcttgatcactgctggtgtaccagttggtgaacgcggaacaactaacgtgatgaaaattcaaatgattggttctaaattattagaagctcaaggcgttggacaaaaatctgtcgttgcaaatgcagttattgcttcatctgctgaagaagctgtaaaaaaagcaaaagacggaatggttctagttgtaccatcaactgacaaagaatatatgcctgcaatcgaaaaagcagctgctgttatcgttgaagaaggcggattgacttctcacgctgcagttgtaggaattgcacaagatattcctgtaatcgttggtgctaaaggcgcaacaacaacaattacagaaggtgaattgattaccgttgattcacgtcgcggcatcgtttaccgtggcgaaacaacagctatctaa

SEQ ID NO: 1401 - DNA (genomic), 603 bp, Enterococcus faecium; double-stranded, circular
  misc_feature (B) LOCATION 1...603
  hypothetical: NO
  anti-sense: NO
atgtctaaaaaaggatcagttttacaaaaatgtcttcagatcatgcccattattggtctgttttttttctttgtgttgattctttatgcttatcatcatgggatttttcgatcgagcacgtctttgcaagcgtttatccagcaatttggcaagtatgcagtgatgatatttgttctgttgcaagtgatccaagtgatcattcctattttgccgggagggatctcctcagtagcgggcatgctgatgtttggcaatggatttgggcttttatatagttgtattggcctagtgattggggaagcaatcggatttttgcttgtccgttactatggcgtagcctttgtccagcttattttatcgccaaaaaagtatcagaaatttgatgaattgctgacaagaaaaacgaaagatattaaaaaagtactagttgttaccttgctgcttccctttgcgccagacgacttgatctgtctagtagctggtttgacgaaattatcttttagggaatttatgcagattgtgattttcttgaaaccatggtcggtgggtgtgtatagcatgatcatgctctttttattccatcaagcgcaaggtcatttataa

SEQ ID NO: 1402 - DNA (genomic), 885 bp, Enterococcus faecium; double-stranded, circular
  misc_feature (B) LOCATION 1...885
  hypothetical: NO
  anti-sense: NO
ggagctaaaaaaatgtttttatcgattgaagaattagtagatcaagcaaaagcttatccaagtgtagcagaattgatgattgcagttgaaatggaaatgagtggccgttcccgtagtcacatcatcgagatcatggaaaaaaacctctcagtaatggaacaatcaatcaacgagggaaaagaaggtgttacctccgtcacaggaattaccggtggtgatgcaaaaaaattagatgattatttaaatgaggcagactttttaagtggagaaacaatcttaaaagctgtacgcaatgctgtagctgttaatgaagtcaatgcaaaaatggggttgatttgtgctacaccgactgccggaagcgcgggtgttgttcctggtgtgctgatggctgtccgagatcggcttgatttgacacatgaacagcaattggaattcttatttaccgctggcgctttcgggttagtcatcgcaaacaacgcttctatcagtggtgcagaagggggatgtcaagcagaagttggttctgcaagtgcaatggcagcagcagctttggtttgtgcaaaaaatgggactcctcatcaagcagcacaagcagtagccattacattgaaaaatatgatgggactgatttgcgatcccgttgcaggcttagttgaagtcccgtgtgtcaaacgtaatgctttaggctcttctcaagcttttatctctgctgatatggcattagcgggtatcgaaagtgtcattccgccggatgaagtcgttgctgcaatgtaccaagtcggacgtcaaatgccgtcgattttcaaagaaacagcagaaggtggcttagctgttacgccaactgctaaacgacttgcggaagagattttaaataagagggcgtga

SEQ ID NO: 1403 - DNA (genomic), 321 bp, Enterococcus faecium; double-stranded, circular
  misc_feature (B) LOCATION 1...321
  hypothetical: NO
  anti-sense: NO
aataataaaaaacacactggaggatttttcatgccaagacgtcaacgaagaacctattcaaaagaattcaaacaacaaatcgtcgatctctatctcgctggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 1404 - DNA (genomic), 321 bp, Enterococcus faecium; double-stranded, circular; identical to SEQ ID NO: 1403
  misc_feature (B) LOCATION 1...321
  hypothetical: NO
  anti-sense: NO

SEQ ID NO: 1405 - DNA (genomic), 321 bp, Enterococcus faecium; double-stranded, circular
  misc_feature (B) LOCATION 1...321
  hypothetical: NO
  anti-sense: NO
aataataaaaaacacactggaggatttttcatgtcaagacgtcaacgaagaacctattcaaaagaattcaaacaacaaatcgtcaatctctatctcgctggtaagcctcgcgcagaaattattcgagagtatgagcttacgccttcttctttcgataaatggatgaagcaagcacaatcaacgggctcattcaaaaaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 1406 - DNA (genomic), 384 bp, Enterococcus faecium; double-stranded, circular
  misc_feature (B) LOCATION 1...384
  hypothetical: NO
  anti-sense: NO
tacaataaaaataaagaggtgacaattgtgattacaaaaccagataagaacaaaacacgtcaaaagagacatcgtcgtgtacgtaacaatatctctggtactgctgagcgcccacgcttgaacgtttttcgttctaacaaaaacatctacgctcaaattattgatgacgtagcgggtgtaacgctagcaagtgcctctaccttggataaagaaatttcaggtggaacaaaaacagaagcagcacaagctgtcggtaaactagttgctgaacgtgcagctgaaaaaggcattaaagtagtagtctttgaccgtggtggatacctttaccatggccgtgtgcaagctttagctgaagctgctcgcgaaaatggactagaattttag

SEQ ID NO: 1407 - DNA (genomic), 1155 bp, Enterococcus faecium; double-stranded, circular
  misc_feature (B) LOCATION 1...1155
  hypothetical: NO
  anti-sense: NO
gaaaataaaaaggagctgttgtttgtggtacattacaaaacgtttgaccctgatctttgggctgcgatcgccaaagaagaagaaagacaagaacataatttggagctgattgcctctgaaaactttgtctccgaagcagtgatggctgcacaaggaagtatcttgacaaataaatacgcagaaggttatccagtgcatcgctattatggtgggtgtgaatttgtcgatatcgttgaaaatttagcgattgaccgtgcaaaagaattattcggagcgaaatttgcgaacgtccagcctcactccggctctcaagccaacacggctgcttatctcgctttggtagaaccaggggacacgatcttaggaatggatctttccgcaggcggacatctaacacatggatcaccagtcaacttcagtggcaaaacctatcactttgttgcttacggtgttgatccgacaacagaagttattgattataatgtggtacgtattttagctagaaaacatcaaccaaaattgatcgtagcaggtgccagtgcttacggacgaacgatcgactttgcgaaattcagagaaatcgcagatgaagtaggcgcaaaactgatggtagatatggcacatatcgcaggattagtagcagcaggacttcatcctaatccagttccttatgcagatatcacaacgactaccactcataaaacattgcgtggccctcgaggcggcatgattttgacaaacgatgaagcattagcaaaaaaaataaatagtgcggtatttcctggtattcaaggcggccctctagagcatgtgattgcgggtaaagcagtagcattcaaagaagcattagatcctgcatttaaagaatatagtgaacaaatcatcgccaatgcaaaagcaatggtcaaagttttcaatcaagcaattggaaccagagtcatttcaggggcgacagataatcatctgatgttgatcgatgttcgcgagttaggtataaatggaaaagaagcagagagcattttggacagtgtgaatatcaccgtaaataaaaactcgattcccttggaaacactaagttccatcaaaacaaccggtattccaatcggcacgccagcaatcactactcccggggttcaaaaaaaaaaaatgctgtnn

SEQ ID NO: 1408 - DNA (genomic), 465 bp, Enterococcus faecium; double-stranded, circular
  misc_feature (B) LOCATION 1...465
  hypothetical: NO
  anti-sense: NO
atgaataaaaaattgatgcaaggcacattttggctaacctttgctaatcttctatgtaaagttttaggggtagtttatttgattccctggctaagtatgatggggaacaatcaagatggtatgcttgctacgacattgtataatgttggctatcttccttatggattgttcctgatgcttggtacagtcggatttccaaatgcgattgcaaaaaaagtagctgtagccacaaaagaaggagataacgctgcttgtcggctgatttttagaagtacgatcaatatcatgtttgtcatcggtatcgcctctgctgcactgatgtatttatttgctcctttactagccggaatcagtccgattgctaacgttaataatgggatactagctatcagaagtttatgcccatctttgattgctatcccaattcttagtgcaatcgagaggatatttccaaggaaaaaatga

SEQ ID NO: 1409 - DNA (genomic), 876 bp, Enterococcus faecium; double-stranded, circular
  misc_feature (B) LOCATION 1...876
  hypothetical: NO
  anti-sense: NO
acgaataaaaaaggagctgaaagtatgaattcattaacaagcacttatcgtctatcaaatggttacgaaatcccggtagtaggattcggcacatggcaaacacctgatggggatgtcgctgtttcctctgttaaagaagcgctggctgcaggttatcgccatatcgatactgcccaaggatacaagaatgaagaaagcgtcggccaagcgattaaggaaagtggaattcctagagaagagatattcttgacaacaaaattatggaatgcaaaccacagctatgaacttgtgatgtcttcttttgaagaatcattgaagaagctccaaacagattatttagatctgtttttgatccactggccaaaccctgttgcttttcgtgataattgggaacaagcaaatgcagatacatggcgagcatttgaagaactgtatgaagcaggtaaaatcaaagcaatcggtgtgagcaatttcttaccccaccatctagatacactagcaaaaacagcaaaaattatgccgatggtcaatcaagttttccttgcaccaggcgaattacagacaactgtagttgagtatgcaaaaaaacatgatatgatcctcgaagcatatagtccattaggcactggtaaaatcttcgatgtgcctgaaatgaaacaaatcgctgaagcacatgacaagacgattgcacaagttgctttgcgttggtcgctgcaacacgaattccttcctcttcctaagtcagtgacaccaagcagaatcaaagaaaatactgaattatttgattttgaattaacagaagaagaaatgaaacaaatcgatcagttagatggtgtagtcggcaaagcaaaagacccagatactacccaattttaa

SEQ ID NO: 1410 - DNA (genomic), 1101 bp, Enterococcus faecium; double-stranded, circular
  misc_feature (B) LOCATION 1...1101
  hypothetical: NO
  anti-sense: NO
aaggataaaaagaaaagaaagaggaaagaaaagatgaaaaaattagttgcattagaaccaagaatagccggattcaaagattacgaagaccgtgagatcgaaaagaacgaagtacgtatccgagtaattttcgctactccaaaaccaggaacagaaattgtcgactttagaggattaagtccatttatcgatgaagaattttcagaagaatggcgcctattcttgccaagagaagaaggaagccaacgcggtgtggtatttggcgaatttcaattaggaaatatgattgtcggtacgatcgaagaaacgggcagtttggtgacagagtatcaaaaaggagagttagtctgcacttatggacccattcgtgaaacgctgattacaaacggtgttgataattataaactacgtaaacttgatcggttggatcaatggaaaaatgcagtatgttacgatcctgctcaattcgctttaggtggtatccgggaagcacatgttcgagcaggtgatgctgtagcaatcttcggtttaggcgctatcgggcaaattgcgattcaattagctaaaaaagcaggtgctactaccatcgttgggatcgatcccatagcgcagcgtagagaattagcagaaaaatacggtgccgattacacgctagatcctatgaaagcagatgtcggttttcgtctaaaggaattgacagataaacgtggagtagattcagttattgaaacgagtggcagtgctgccgcattacaagcttctttaagagggatcggctatggcgggatcatttcttatgttgcctttgctaaaccttttccagctgggtttaatcttggtcgcgaagcacatttcaataatgcaaaaatcgtctttgctcgagcatctagtgaaccaaacccagattacccaagatggaaccgtaaacgaatcgaggacacatgttgggaattattgatgaacggttacttggattgtgaagaaatcattgatccagttgtgccatttgcagaaagcgcagaagcttacatgcgttatgtagaccagcacccagaagaaagtatcaaaatgggcgttcaagtccgaggaggagaacaatga

SEQ ID NO: 1411 - DNA (genomic), 285 bp, Enterococcus faecium; double-stranded, circular
  misc_feature (B) LOCATION 1...285
  hypothetical: NO
  anti-sense: NO
aaatgtaaaaaattgttatccgatactttagaaaaagtacaacacttatttagaccaggctttgaaaaggtatatattgttagtttcgaagattgtcctataattcctgagcttgaagctaccccgttgctaaaatgtggtaaatggtatgtttcaactggaaaagagtggatttgccattctgatttagagttatcagcatttgaatgggaatttttacaatcactcgatgtagaaatacgtgagactattcacttcgaggtaaattatttgcctttccaataa

SEQ ID NO: 1412 - DNA (genomic), 348 bp, Enterococcus faecium; double-stranded, circular
  misc_feature (B) LOCATION 1...348
  hypothetical: NO
  anti-sense: NO
aagtgtaaaaaaataaaaggagtgttaaaaatggcaaaaaaaacaatcatgttagtttgttcagcagggatgagtacgagtttattggtcacaaaaatgcaaaaagcagcagaagaaaaagggatggaagccgatatttttgcggtctctgcctcagatgcagataataatttagaatctaagaatgtcgatgtattattattaggtcctcaagtacgtttcatgaaagctcaatttgaacaaaaacttgcgcctaaaggtattccattagatgtcatcaatatgcaagactatggcatgatgaacggagaaaaagttcttgcacaagcagaaaatctaatgaaataa

SEQ ID NO: 1413 - DNA (genomic), 2133 bp, Enterococcus faecium; double-stranded, circular
  misc_feature (B) LOCATION 1...2133
  hypothetical: NO
  anti-sense: NO
gaaagtaaaaaagtaggagtaaaaagtagtcgatactttttactccttttttatgaaaggagaatactcatgtactttacgattgcaggcaataccaaaacagataaagagttaataaaaaaagcaacgaaggaagtaggaaagcgtacttcttttttaccgaaaacaattaaatattctgtcattgaaacggaagaacagctacatgtgttagggaaagtactggaacacgaaagtcgatcttctgttaagttgactctcacgttacatgacacagaaggaaaaatagagaaagctggtacagaatacgtttttggcccactggattatcaaatttcagaaggtttctatcctacattgatggatttaatccgccttgatgtgtttaaagaaacggatgaaactatgagtgtggaagagtcttatcgaaacgaaaaacttttacaagttttagaagaagagttagagagcgaccaaagaaaagtgaatcaagggagtgaagtcgaagtaaatgaagaagtaccatgggaacgaccaatatttccaaagaaggagtcaaaagaaaaagagacagtctatgttgacgaacaagctgatattccgactcagaaatcgatatttaagaaagagaacgatgtgatgggtcagttggaggtagatccctttgaagaaacaatggaggatgaagagacggccgaagtagaagttgatccagttgaagctaatgaagagtcaatatggactgaaggggattctcaggaatatattgaaccacttatcagtgaagaagtagagaaaaacgaaacagagatacaaaaggcaactgtatttgattatattttggatcaatatccgccagagcatgaatggatgaaagaaaaaaacaaattatttttaaatgggctttattcgaaatatcaattaccccaaacctatcaagcatttttagagagtaaagaagaattaatctcacagggtaaaggcacacttttagaacagttagagtctgtccaatcaacaaattggcatgagcttgcacaagaagatttattagccacctttgaagaacgtcaacaagaaacagatcaagaaattaatgagtatgcgacggaacagtcgtctaattgggagaaagcaaaagaggaactaaataaagaagaacagcgagtgattgaagaagaagtacaaaaaattaaagagcgatacgaaaagaaacgcgacaatgcgtattccttgtgtgtagcaaagatcaataattttactcagacgaatcaagaagcgttatcgaaagaaaaagaaaacttgttaaaagaacgtattaaagaacgaaaagaagaattttaccgaggtttgcgtacagataagctaaagattagcaaagaattaaatgaacaactgaataagctatatcaaacaacgactgaagttcttatggaaaaatacgaaaagatccagcaagaattacaagtgcaaattccaaaatggaaaaaagagtatgaaattcaacaacaagaattgaaagaacaagaagaaaaacaacggcaaaaagaaaaagagcgcgaacaattagaactaaaaaaacgtgaacaggatcttgcggaacaacaaatggcaatagaaaaacaacggttaaaccaagaaaaggaaaaagaagcagctgctcgtaaggaacgtcaagaacaaatggatacattgcgacaagctcagttaaattatctagcacaacctcaaccaacgccttcagtagctgctgttcaaaccccaatgaacaaccaaacaaatctaactccttcaccacagcgttcctttaacggatggatggtgggatgtattgcaagtttaagcttgcttctaggtggaggaacagtatttgcttttaatcatatcaatcaatcttcacaggctgattctgtggccacaacgacgtcaatcaaggaagaagcccaagaacaagcaagaaaagagtatgaacaacaattagaagaattattgaatcgtaccaatcagtcaacaacagaatcaagtatggaaaatagcaaagagagtgatcctagtaaggctaaagaaggatcaagcgattcaactgtacaatcaaacacttccgaaagttcagaatcaaatgaggtgaaataa

SEQ ID NO: 1414 - DNA (genomic), 552 bp, Enterococcus faecium; double-stranded, circular
  misc_feature (B) LOCATION 1...552
  hypothetical: NO
  anti-sense: NO
tttggtaaaaatcaatgggagctgtactttatgtttttatggtccatagcgttgcaatatttgatttacacaatttgtatcttattgattgaccatcacatccgatacaaatatctgtttgcgggagtcattctgatttcttgtattttgattggatgggtctattcgattttagggatttttactgctctaattgctataggaatgctgatgcttacttttttcttcttttcgacttcgcgtcaacaattggtttacgcgcttccttttgggttattgacgtcgcttttaggagatcacttaacaagcatcggcgatttttttgttttgaaatcttcggttattgaaccaggagattcattgcagtattttcacattgtcttatccgcttttttatctgctttattagctttttgtttaaaaaaatcgttagagacttggtttcacactgtggaccgccgtatgatcggtacgatcgggacattgatattatttacatactatatcatacccgtggtgctagttaattttttcctacaggaaaatgtctaa

SEQ ID NO: 1415 - DNA (genomic), 294 bp, Enterococcus faecium; double-stranded, circular
  misc_feature (B) LOCATION 1...294
  hypothetical: NO
  anti-sense: NO
agtatcaaaaattgtggaagaatttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagaatgcgaccgtgaaaatatcggcttccatgattcaaagtggcgaaagcgaagagacctggacaacattttttga

SEQ ID NO: 1416 - DNA (genomic), 315 bp, Enterococcus faecium; double-stranded, circular
  misc_feature (B) LOCATION 1...315
  hypothetical: NO
  anti-sense: NO
atcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcgtcctagtcctcaatttgtttnt

SEQ ID NO: 1417 - DNA (genomic), 816 bp, Enterococcus faecium; double-stranded, circular
  misc_feature (B) LOCATION 1...816
  hypothetical: NO
  anti-sense: NO
atcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaattaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaaaggtgtgacggaattagcgatttatcaaaaaggaaagcgaattatggttccattaccagtccaaaaaaacgtcctcagcatcaaaagtgaggacgtttttttagatttctttttctaa

SEQ ID NO: 1418 - DNA (genomic), 762 bp, Enterococcus faecium; double-stranded, circular
  misc_feature (B) LOCATION 1...762
  hypothetical: NO
  anti-sense: NO
atcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcaaaatcggttacatcgcttctgaaaaggatcggatcatcgactatttagccgataaagattacgatttaaaattactcagtgtgcatcataatgggcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaatcaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaatggtgtgacggaattagcgatttatcaaaaaggaaagcgaattatggttccattaccagtctaa

SEQ ID NO: 1419 - DNA (genomic), 324 bp, Enterococcus faecium; double-stranded, circular
  misc_feature (B) LOCATION 1...324
  hypothetical: NO
  anti-sense: NO
ttaaacaaaaagaaaggagacgagtacatggctaagctgattgtattaggtggtttaatttacggtggatattggttatataaatatatgcttgcgcatccgaatatagataaaggaaaagtaattaagacagttggggtaatcatagttggactcatagctctaactaagaaaaataatactaatagcccaaaaataatgagaacttatcgctgtagaggatgtggaagggaaatttctactagttttaatccatctgagagtcctcaaggaagagaccgctgccatacgggctatcgacattattgggaaagaatcgattaa

SEQ ID NO: 1420 - DNA (genomic), 528 bp, Enterococcus faecium; double-stranded, circular
  misc_feature (B) LOCATION 1...528
  hypothetical: NO
  anti-sense: NO
acgttaaaaaaaggattaaggtcgttttttggaaaggaaggattttggaacatcttaagaggggtgataccgatttgttgggcattccaccataaaagtgccgtcagcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 1421 - DNA (genomic), 315 bp, Enterococcus faecium; double-stranded, circular
  misc_feature (B) LOCATION 1...315
  hypothetical: NO
  anti-sense: NO
atcgtaaaaaaaatacgaggaagaaattcaagaattagaggaagaagaagcaagtgctatctaaatgaaaaattaggctggcttccttatattgagacgcctgaaacaatccagcagcaaaaagaagcattgaagcaagaagcaagagcagaccagcttcgtgcagccatcgtagaaaaagaacaaaggcaaatcagacgctatttcggtagcaaagagggattcggtcaagcaatccatgaattcttgatgaattatcttggcaatgagaatcctaataatcaatctaatgaaggaggttccgagtatgaatga

SEQ ID NO: 1422 - DNA (genomic), 1431 bp, Enterococcus faecium; double-stranded, circular
  misc_feature (B) LOCATION 1...1431
  hypothetical: NO
  anti-sense: NO
ttcacaaaaaatattgaaagattactttactcacgaggaggcttagctatgaaacctaatctatcgttaactagtgaacgtattagaaaaattatcgaatccaaaggtctgacattagaacgattcggtgatttaattggcgacacaccaataagttctgttaataattggcttagaggcgtgtctttacccaataaaaataggcttttaacaattgcaaatattggaaacactagtgtagactggattaaatggggaactttggaagaatacatagcttcataccttatagattcaggttatgagctatatattaaagactttccagagataccttacaaagtctttaaagacattcaagaaaaatatagtgatacgttttcactagataaagactatgagttattgaatcctataataaaatttactatagggggcgttactttgaatagaataaaattttatattgattccagtaaaaagaccattaaacaaattagtacagaaactggtattaactatacaactcttacgaactattaccgtggtgagcgaaatcctagaaatactgaaacatggaatatccttgctgattatttccatgttcctgtaagttatttgatgggattagacgaaacaaatgttgaactcaaaaaccttaatattggaaacaacatcaaaaatattagaaaaagtaaaaatatgacacaaactgattttgctgagttaatgggtctatcacgatcatatataggggatttagaaaacaacaggagtaatcccagtataaaaacactggaagctattgcaagagcattggacgttccgatagtagcattaatcaacgattcttctactgataatatagtagagccgtatgaaagtttgacagccgaaaatatccttcttaaacaagaaaatgaggaattaaaatatgaggtagaaagcttacgaaaaagattgtatgaaatccaacaagtagtaaatcaaggagctgaaaaaatgattcccaatctaaaagacgtaagtaaaagaatcaaatatatcagaaaaaaattaggtatgactatggagcaatttggttctcatttaagcaactcacctaaaagtacaattgctacttgggaaagtggtagaaatataccttctcagaaaaagttacagctgattgctatagtaggagaaaccaccactgactggattaaatggggaactttagaagagtatataacttcataccttatcggtataggatatgagctatatattaaagactttccagagatacctcacaaagtctttaaagacattcaagaaaaatatagtgatacgttttcgttagataaagactatgaattattggattctataataaaaaatatatttacaaaatattactcaaaagaatttgaagtaacccaaattccataa

SEQ ID NO: 1423 - DNA (genomic), 765 bp, Enterococcus faecium; double-stranded, circular
  misc_feature (B) LOCATION 1...765
  hypothetical: NO
  anti-sense: NO
cagaaaaaaaattacagagatatgacctggaaactggagggaacgataatgaatattttaatgattgaagataatcaatctgtttctgaaatgatgcagatgtttttcttaaatgaaggctgggaagcaaccttcaaatatgatggaaaagaagggctcgacgcctttttagaaaacccccaacattgggacatgattacattggacttgaatttgcctacaatggacggcatgctagtaggaagagagatccgcaaagtttcaagcacagtgccgattatcatgctgacagctagagattctgaaagtgatcaggtgatcggcttagagatgggggcagatgattatgtgacgaaacctttcagtccgctgacgcttattgctcgaatgaaagctttacatcgccgtagcgagttggcagaagcaagagaagaagcagcggtttcagatgaccattttgatattgagaccagtcatttcaagatgaatacgaaaacacgagaagcatatctggacaatcggcccatcgaaggcttgacgcctaaagaattcgatctattgtttactttagcaaaaaaaccacgacaagtattttctcgggaacagttgcttgaactagtctgggattaccagtattttggtgatgaacggacagtagatgcccatatcaagaaattgcgtcaaaaaattgaaaaggtcggaccacaagttatccaaactgtttggggagtcggctacaaatttgatgattctggtgttgcctaa

SEQ ID NO: 1424 - DNA (genomic), 1179 bp, Enterococcus faecium; double-stranded, circular
  misc_feature (B) LOCATION 1...1179
  hypothetical: NO
  anti-sense: NO
tacgaaaaaaattcttcacgtagaaaagggaaaaacgattcacattcaaaggagaaaaagatgagtatactaaaaaatattacccaatttaaaaaaatccagagtcgagcaatcactcccgaaaatccaacaggcgagaaaggtaaagctgcgatgttgccaagcgagctaggaccaagccgcaaaggtcgtggcgcaattccgctgacttctggtgaagaaactgtgattgcggatattactggaacgggaataattcgtcatatgtggatgacgattcgtgatcgaacagaatttggcagttttgttttacgtgatttaatcttaagaatttattgggatgggtcggatagccctgctgttgaaagtcctttaggggatttcttttgtaatgggtttggagagcgttgcgaggtgaactcgttgccgatagtggttaatcctacagggggctttaattcctatttcgaaatgcctttccaaacatccgctaaaattacgatcgagaatttacatccgaaggatatgtcctcatttttttatacgataaattacgctttggtggacgaattggaagaaaatagcctatattttcacgcaaattggcatcgggaacgcattaccaaattacaggaggattataagttaattgatcgattaaagggtcaaggctattacgtgggtacttaccttgcgcttacctgcctagaacgttattggtggggcgaaggcgagtttaaattctacattgatggggatagtgagtatccgaccgtaacctcaacaggttcagaagattattttggcggggcgtgggcctttcatgagtacgatgagttcggacgtccacatgcgaaaaactattcaacagcctttttagggtatccttaccaatcaaatagagatgccacaagagatcgttttgaaacgggaaaattgaatgccgttcatgcctttggtgacgacgcaatgccacgacatggtctttatcgttggcatcttcaagaccccatctgttttaccgaagatttatcggtcactttacaacaaatcggcaacgatgatgttcgcttatttgagcggcaagacgatgttgctagtgtcgcttactggtattcaacagaagcttcaggaaatactaaacgtcatttcactgatcgagaacgcttgccgcgttaa

SEQ ID NO: 1425 - DNA (genomic), 1560 bp, Enterococcus faecium; double-stranded, circular
  misc_feature (B) LOCATION 1...1560
  hypothetical: NO
  anti-sense: NO
atggaaaaaaaaggaaaaatcaagaaattagataagactcagatatattttattctaaaaggaatatttgttggactgctgacaggaatcgtcgttagcctgtttcgattatctatcgaaaagctaagcgatttagttcgaagtatctatgaaatgagtcgggaacagccgatttacttaattggcctagctatttgctgcatccttgcagcatttttcgtgggttatctggtcaaaaatgaaccggatatcaagggaagcgggattccacaagtagagggacagcttcgcggggaattatcaatgaactggttctctgttttatggaaaaagttcattggcggtgtactttcagttggtgcgggcctttttctaggtagagaaggaccttctatacagcttggcgcatccattggacaaggagctggacaattgtttcggagtccatcttcagaagaaaagattttaatttctagcggtgcaagtagcggacttgcagcagcattcaatgctcctatcgcaggattactctttgttttagaagaaatccatcactccttttctccacttgtttggctgacatcatttgcttcagcaatcactgctaacttcgtctctctttactttttcggcttgagacctgttttatatctaggtgaccttccttctttgccgttgaaatattatggttccttagtgatcttaggagtacttctaggcatcttaggttttatttatcagaatgtcttgctggctttgccaaaattttacaaccgattgcctttaccagcttattttcacgggttcgttcctttcttgctgattttgccaattggttatttatggcctagtactctaggcggaggcaatcaaatcgttttagcttttggacatgcttccttgccaatcattatgattatcggtttgtttgttcttcgattcgttttttccatgatttcttacggtgggggtcttccaggggggattttccttccgatattgacattgggggctttaatcggtagcttttatggaaacattatggttgatttcgggatggatccaatctacatcaaggattttgtcgttattgccatggctggttatttcacagcgattggaaaagcaccgctgacagcaattattttagtgacagaaatggttggctctcttaatcatctgatgcctttaggattggctgctcttgttgcttatatcgtcaatgaccttctcggcggtaatccaatttacgaatcattattggaacgtctacttggaaatactcagaccgcctcactaaaaggtgcaaggacaacttttgattttccagtaacggcagagagttctttagacggattaatggtacgagacttcaattggcctaaaaatatgctgctaatctctatacgcagaggaaatcaggaaatcttgactcacggtgatacgatcatgaatgtaggagatattttggttatcttgactgatgaagcaaacttgccaagaatcaagcaggaaatcgaggctaaatcttctatcacaaatttgaagcaatcattttaa

SEQ ID NO: 1426 - DNA (genomic), 1005 bp, Enterococcus faecium; double-stranded, circular
  misc_feature (B) LOCATION 1...1005
  hypothetical: NO
  anti-sense: NO
acggaaaaaaaggaggagagacaaatggcaacaattaaagacattgctcagttggcaggagtttctcctgctactgtttcaagagtgctcaactacgatcctgaactttccgtcggcttagccacaaagcaaaaaatttttgaagcagcggaacgcttgaattatacgaagcaccgcaaaaatgcagcaaatgctaagcaaacccttcgtctgatccaatggtacgacgatacagaagaacttgaagatctttattatttgtctattcgtttaggaatcgaaaaaaaggcagaagaagcaaacgttactttgttgaaagaaacgtgggattccattagtgagcttccagcggatggaacgattgcattagggaaattcgatgaagctcagctgttggatttgaaacaatcccaacaagccttgcttctggtagattctgatggcacttctcaaggaatcgattctatagttgtcgattttaagtcgagtgttcaaaaagtcattgagcactttgtttcccagaatgcacaacatatagcgatgcttgctggaacagaatatacaaagaaaaaccatcagcgactaagagatcctagaatcatggcattccaacaagttttagcagaaaaaggctacgacgaaggttcaattatcgaagcagatttttctgtcgagtcaggctatcaagcggttaaaaaatatttaaaaacaaatgagcagattcctgatgcactttttgcggctaatgatgcattagcgattggcgcgctgaaagcgattcaagaaacaggtttagcggtgccagaagatatttccgtgatgggtttcaacgatgtcagtgtagcgaaatatgtgacaccctctctttctactgtgaaagtttatacggaatggatgggagagctagcagtggagacaatccttcaactaagtaattccaaagcacccgtttcaagaaaaatcattgttgaaacagagttgattgttcgagagtcgacgaaataa

SEQ ID NO: 1427 - DNA (genomic), 612 bp, Enterococcus faecium; double-stranded, circular
  misc_feature (B) LOCATION 1...612
  hypothetical: NO
  anti-sense: NO
aggagaaaaaacatgttagaacgttatacacgccctgaaatggggaatatctggacggaagagaacaaataccgtgcgtggctcgaagtcgagattttagcagatgaagcttgggcagaacttggtgaaatcccgcaagaagatgtgaaaaaaattcgtgagcatgcatcatttgatatcgatcggatcttggaaatcgaaaaattaacacgccatgatgtcgttgcgtttacacgagcggtttctgaaacattgggagaagaaagaaaatgggtccattatggtctaacaagtacggatgtcgtaaatactgcttatggctatctcatcaagcaagcaaatgatattttacgggaagacttgaaacgttttacggaaatcattggcgaaaaagcaaaagaacacaaatatacagtgatgatgggtcggacacacggtgtccatgctgaaccaactacttttggattgaaacttgccacatggtattcaaaaatgaaacggaacatcgaacgatttgaacatgcgggcaaagggattaaacccggaantatctcaggagcagtgggaacgttcgcaaatatcccgccatttattgaaagaatatgtctgtaa

SEQ ID NO: 1428 - DNA (genomic), 1497 bp, Enterococcus faecium; double-stranded, circular
  misc_feature (B) LOCATION 1...1497
  hypothetical: NO
  anti-sense: NO
aggagaaaaaagatgggggaatttttgttaagcatttggacgtattttgcaacaaatatcttgacgcagccagcatacctgattggttttatcgtgttattaggctatattttgctgaaacgcccgcttcatgaatgcatcgctggattcttaaaggcaacggtcggttactttattttgactgttggctctggtggtttggtcaataattttcggccaatcttggttggactaaaggaacggttcaatttggatgccatggttacagatccttattttggacaaaatgctgtggatgctggattaatggagacatttggccgtacctttggagatgtgatgattttattactgattgcatttgttttaaatatcttattagtccgttttcagaaatatacgaaactgcgttccgttttcactaccggaaacgttcaggttcaacaagcagctaccgctttttggattttactgttttgctttcctgatctaggtaggatacaagtattgatttttatgggactgattttaggttgttattgggcagtagcttctaacttaacagtaggaatcacgcaggaattgacagaaggtgccggatttgcagtggcacatcagcaaatgttcggaatctttatatttgcaaaattagctgagtggatgaaaaagcgggatgaaaagaaaaatagatcaatcaagcaagacaaaaaaattgaagatatcaaattaccaggattcttgtcgattttcaatgagaatatggttgctacttcgttactcatgctatttttctttgggatcattctgattgtactaggcaaagattatttgattcaagcgcaattcatgcaagaagggcagagtttcttattctacattatgacgacttctttaaattttgcggtatatctggcgatcttgcaattaggtgttcggacattcgtcgatgaactaactcaatctttccaaggaatctcaaacacgattttaccaggagctgttccaggaattgacgtagctgctacttttggctttggttcgccaaatgcggtaacgattgggttcttgtttggtgctttgggacagtttttgatgattggtttactgattttattgaaatcaccaacgatcgtcatagccggtttcattccgttgttctttgataatgccgttatagcagtttatgccaataaccgaggtggattcaaagccgcttgcctgttcccgtttctttcaggaatcatacaagtaggcggttcagcattattcgctacatggattgggatgtcaacatacggtggttatatcgggatgttcgactgggcaacagcttggccattgtttacagtaatcatgaaagtcctaggttatgctggaattgccgtagttgtcattggtttattggctattccgcagttacaatatcggaaaaatcctgatggttattttttgattgtagaagactatgacacatatgcagaaaagcagagagtataa

SEQ ID NO: 1429 - DNA (genomic), 1971 bp, Enterococcus faecium; double-stranded, circular
  misc_feature (B) LOCATION 1...1971
  hypothetical: NO
  anti-sense: NO
ggaggaaaaaaattgaaagcatatctacaacgaatgggacgttcccttcaacttccagttgcggtcttacctgctgctgctttactagtagggatcggaaactggtgggcatcttatagtaacgacattgtcgctcattttttacaagctggcggtaacgcagttttaggtcaattacctttgctgtttgccgttgggttagcactagggatgtcagtggacaaatcaggtgctgctgccttggcaggtttggtcgcatttgaagttccagtaaatgttttaaaaactgattcagtagctactttattgaatatcaaaccagaatcagttgatccatcttttgctcagatcagtaacgtatttattggtattattgccggattgattgcggcagctctttataatcgtttccacgaagcaaaattaccgatggctttatctttctttagcggcaagcgtctagtgccaatcttggctgcctttgtcatgttgctgatcagtgcagtgctactgctcgtatggcctccggtttactctgctttagtttcttttgctaaattcattttgagtttaggctggggtggtgcaggtctttatggcttcttcaaccgtttactgatccctacaggattgcatcaagcaatgaactccgtgttctggtttgacgtagcaggaatcaatgatattggtaaatttttggcttctgaaggaacaaaaggcgtaacaggaatgtatcaagctggatttttcccaatcatgatgttcgggcttccagcaggagcatatgctatttacagaaatgcacgtccagaaaacaaagcaaaaacagcttccttgatgctagcagcagcttttgcttcattctttactggtgtgacagaaccacttgaattttcatttatgttcgttgcttggccattatatgtcttgcatgcaattttcactgggatttctttagcagtgagtgcattcttccattggacagcaggatttgcctttagtgccggatttgtcgattacttcctatctttgaaaaatccgattgcgaatcagccattgatgttgatcgtccaaggattagtaacagcagtgatttactactttggctttaactttgctatcaaaaaattccatctgatgactcctggccgcgaggaagcagatctttcagatgacgatactgcaacgactaattcagacaataaatatgcggcacaagcaagcaaaatctacgctgcattaggcggagccgacaatgtaacttcgatcgataactgtactacacgccttcgtttgcaagtcaaagatacaggcctgatcgatcaaaataaaatcaaagccactggcgtacctggtatgaagatcatcgacggaaaaaatgcgcaagtcatcgtaggtacagaagtacaattcgttgcagatgagatggcaaaactacatggtggtgctgcagcacgacctgcacaaacaaacaccgtggttaaaacagaaacatttgccggtgaaacgatcgaacaagatatttacgctatcgcaaatgggaaactgattccaatcactgaagtttcagatgatgtattcgcggaaaaaatgatgggtgacggctatgctgtattaccagaaaatggagaaatcttctctccaatcgctggtacgatcacaaacattttcccaacgaaacatgctgtcggaatccaaacagatgctggtatcgaagtcttgcttcatatgggcatcaacactgttgacttaaaaggcgaaccattcactttatatgtagaagaaggtcaaaaagtcgcaagaggtcaattgattgctttagttgatcttgccgctattcaatctgcaggcaaaaacacggatatggtcgttgtattcacaaatggcgacaaagtccaaagcttagaaatcgaacccgcacgtgatgtaaaagcaaatgataaaatcggctctgtttccaacaaagcctga

SEQ ID NO: 1430 - DNA (genomic), 1125 bp, Enterococcus faecium; double-stranded, circular
  misc_feature (B) LOCATION 1...1125
  hypothetical: NO
  anti-sense: NO
ctgttgaaaaataaaacaattattttaggaggctttacagaaatgaaaaaagcaaaattatttggtttaggtgctgtcgcactagcagcagggttatttttaggtgcatgcggcaacaacggctctactgattcatccggtggcaaaagctcatcagacacaacaactgcagcattgatcacagacacaggtggtgtagacgaccgttcattcaaccagtcagcttgggaaggactagaaaaatgggggaaagatcaaggactttcacgaggaaatgatggcttccaatatttccaatcttcaaatgaatcagattacatcccaaatattgaccaagcattgaatgctggattcaaaacgatttttggtattggttataaactaaaaccagcgatccaagaacaagcaacaaacaatacaggtacgaactttgttattatcgatgatgtcatcgatggattagataacgttgtatctgcaactttcaaagacaacgaagcttcttatcttgcaggtgttgcagcagcttatacgactgaaacaaacgtagtcggctttatcggcggtgtaaaaggtgaagtaatcgatcgttttgatgctggattcaaagccggtgttgatgcaggtgcgaaagaattaggaaaagaaatcaaagtattgaatcaatatgctggtgacttctctgctccagataaaggacgttcaattgctcaaggtatgtatgcacaaaacgcagatatcatcttccatgcttcaggcggtacaggtaacggtgtattccaagaagcaaaatcattgaacgaatcaggcgacaaaaaagtttgggttatcggtgttgaccgcgaccaatcagacgaaggcgaatacacattaaacggcgaaaagaaaaacttcacattgacatctacactgaaagcagttggaacagtagtagaagatttggcacaaaaatcagcggacggtaaattccctggcggcgaacacactgtttatggattgaaagaagacggtgttggtctaacagaaggacaactttctgacgaagcgaaaaaagcagttgatgaagcaaaagaaaaaatcatttcaggtgacgtaaaagttccagaaactcctgaagaaaactaa

SEQ ID NO: 1431 - DNA (genomic), 318 bp, Enterococcus faecium; double-stranded, circular
  misc_feature (B) LOCATION 1...318
  hypothetical: NO
  anti-sense: NO
tttatgaaaaaagcattgattatttgtgcggcaggaatgtcatcctcgatgatggcctcaaagacaacggatttctttaagcaaaaaagagaagaggtactcgtagatgcagtttcagctacagaaggcgataatatgattaagaatagtgattttgatttatttctgatcagcccgcaaacgacgatgtttttggataaattcaaaaaattaggagaatctgttggaaagcctgttgttagtatccctttccaagcgtatgtcccaatccctacaggcatccagaagttagcagaggtgatcgaagagaacatatga

SEQ ID NO: 1432 - DNA (genomic), 390 bp, Enterococcus faecium; double-stranded, circular
  misc_feature (B) LOCATION 1...390
  hypothetical: NO
  anti-sense: NO
gttatgaaaaaatttttatgtctttctgctttaatgggtgtcttattaactagtggaggaatagttagtgctacagaagctttaaatctagatgtacccgaagaccataccgccatttacggaggaggaatggaagctacagaagaaggattttcttctagtaaattgagatatgctgctggcggcggagatttcaactgtggggttaatggatttaaagtttatgcaaattactaccatgctagagctaaacatagtgcaacagctaaaaatggacgaggcggtcaagtacgatcagttcagaaagctggagtaagagcttatgcaacatgcaatgccacacttactggaaatactggttggtggaatggttctgttgcaaagttttaa

SEQ ID NO: 1433 - DNA (genomic), 1338 bp, Enterococcus faecium; double-stranded, circular
  misc_feature (B) LOCATION 1...1338
  hypothetical: NO
  anti-sense: NO
aatatgaaaaaattattgtttacagggttgctggcaagttcagcattgtttttattaggaggatgcggatcaagtaatgcaagcgatgccagttcaagtgcagcaaattcttctgaaaaaacaagtgatggaagaaaaaatattgatttctggtccttttggggatccggtgcacgaaaagaagctatcgaagaaatcattgaggatttcaatcaatcacaaaacgagatccatgtaaattataagtatcagccatggggtgacatctggactaaatctttatctgcaataacagctggaaatgcacccgatgttattgtacaggacataaattccgttgcccaaagagcagaagcacagcaagcaactaatctctccaaatatgtagaaaaagacacttctaaggatttttatccgcagctttgggatacagtagaatatgaaggtgatccttatgcgatcccattcaatacagatacacaagtcattttttataataaaaagttatttaaagaagctggaatcagtgaacaagatctaccgacaacttgggatgaattagaagaaacagcacgtaaactagataaaaaagaaggaaaagaatttacacgcatcggtttttatccattatggaatttaggggctgatgtatgggcgctaaacgcagataacgggactagttggtttgacaaagatgaaaaagtcaagattgatactaaaaataaagtggaagccttggagtggatccaagactggcaagattattatgggaaaaatacgatcaataaattagaagccgaatttgggtctggtgtatctgatccatttatttccggattagtagccatgcgtgcccaaaatatcaattattactctagtttgatggaaaatgcaccggatgattttgattttggcgtgatgcagctcccagaaaaagaagaaggttcaggccattggtcgtggggtggcggattcgtcttggaagtaccatacggagcaaaagatcctgaggcctcttatgaattcatcaaatatctttcttctccagaagtacaagaaaaattcggcgaaaaaagttttgatatcatggcgagcaagacagccaatgagaatttagtgaataatgacaacctaacggataaaggaaaaatgatctatcaaatggcggacgaaaactttaaaaatacggtgatcacaccagttcctttagatgctccggattacacgacattagtgaatgaacagattgaccagattcttttaggaacaaaatcaccaaaagaaggattggcagatgcacaaaaagcagtagaaaacttagtcaagcaaaatcaataa

SEQ ID NO: 1434 - DNA (genomic), 534 bp, Enterococcus faecium; double-stranded, circular
  misc_feature (B) LOCATION 1...534
  hypothetical: NO
  anti-sense: NO
accatgaaaaaacagctgttgattgtagacggctacaacatgattggttcgtggccggaacttgtccagcttaaaaagcaggacaaaatggcggatgcaagagaagctcttttacatcgtttatcaaattatgcgaaatatgaaggaatggaagtcatcgttgtcttcgatgcccaactagttccgggcatccaacaaaattataagaaataccagttggatgttgtttttacgaaagaagacgaaacggctgacagttatatcgagagaatcgctggtcagctgaatgaccgtttgacacaagtgacagtggcgacaagcgatttagcagaacagtggatgatcttttcccaaggagcattacgaacttctgcttatgaattatataagacgataaaaaaaacggaaaaaacaatagcccaagaaaataaagatatgcattttattgatttccgacgtaattctccatggaatgaagagcagttaaaaaaattgtcccaaaaattggacgatttaatgagaaaaaataaataa

SEQ ID NO: 1435 - DNA (genomic), 1128 bp, Enterococcus faecium; double-stranded, circular
  misc_feature (B) LOCATION 1...1128
  hypothetical: NO
  anti-sense: NO
acaatgaaaaaattaaaagtgatgacagtagtaggaacgcggccagaaatcattcgtttgtctgctgttatcaatcgtttggatcaatcagaagcaatcgaacatattttagtacacactggacaaaactatgactatgaattaaatgaagtattcttcgaagacttcaagctaaagaaacccgattattttctaaatgcagcaactggaacagccattgaaacagttggaaatattttgatcaagatcgatccaattttggaagaagtaaaaccagatgcattcttagtattaggagatacaaatagctgtttatgtgcaattgcagccaaacgtcgccatattcctattttccatatggaggcaggaaatcgctgtttcgaccaacgagtaccggaagaaacaaatcgtaaaattgttgatcatacagctgatattaatctaacctatagcgatatcgcgagagaatatctcttacgtgaaggattaccagctgaccgtgtaatcaaaacaggaagtccgatgtttgaagttctcaattcaagaaaagatgatatccaacattccgatatccttaatcgtttagtgttaaaagaaggacaatattttgtcgtttctgctcaccgcgaagaaaatattagctcagaaacaaatttcttgaacttggtagatagcttgaatacaatcgctgaaacttaccaattgccaattatcattagtacgcatccgcgaacaatgaagatgatcgaagcaaaagggatcaaattccacgagctgatccaaacaatgaaaccgatgggattcaatgattacaataaattgcaaatcaatgcaaaagctgtactaagcgacagcggaacgatcagcgaagaatcttccattttgaacttcaaagcattgaatatccgtcaagcacatgaacgaccagaagcaatggaagaagcaagtgtcatgatggtaggactagaaaaagaaagaattatgcaaggactggaagtattggaaacacagcaaaaagatactttgggacacgtcgcagattattcaatgccaaatgtttcagaaaaagtattgcgtatcatcctttcttatacagactatgtgaatagagtggtgtggggaagatga

SEQ ID NO: 1436 - DNA (genomic), 345 bp, Enterococcus faecium; double-stranded, circular
  misc_feature (B) LOCATION 1...345
  hypothetical: NO
  anti-sense: NO
caaatgaaaaattatgatccgaatatacgattgggcacacatactattaaggtttctttccaacgttgggattacaaaggttttgtgacgtttagaagaggcggaaattgtaaaggattagatgttttagcattaaacgaggatgatttatacgatcaaacattgactgataatccaattggattcggcttgctacctgaagatgatgaaggtaatgaatggtttaaaatgacgcttatgaatgataatggagacgaattatctgttgaagatacttggtcatatttgagtgattatattgtcagcgttgaaatcattgaatttgtagcggataaagaagaataa

SEQ ID NO: 1437 - DNA (genomic), 1092 bp, Enterococcus faecium; double-stranded, circular
  misc_feature (B) LOCATION 1...1092
  hypothetical: NO
  anti-sense: NO
aaaatgaaaaacaaatttagaaagattgttgggactatcgctattttgaccgcaagcattctattaagtgcgtgtggcaattcaggatctgcagatgatagtacggggtatgtaggaatcgctatgccgaccaaatcagcagaaagatggatcgctgatgggaacaacatggtctcggaattagaaaaactgggttataaaacagatcttcaatatggagaagataaagtagaaaatcaagtagcacaaatagaaaatatgattacaaaaggggtagatacacttgtgattgcttctatcgatggttcggctttaactgatgtgttagctaaagcaaaagaagcagatatcaaggtgatcgcctatgatcgtttactgatgaattcagaaaatgtcgattattacgcgacttttgataattttggagtaggtgtatcgcaagcagcttatattgaagagcacttaggattgaaagaaggaaaaggaccattcacgattgaattatttggtggctcgcctgacgacaacaacgcactaatcaattacaacggagtgatgtctgttttacaaccatatatggacaacggtcagttggtcgtgccatctggacagacgagtttcagtcaaatcgctacgcttcgctgggatggttctacggcgcaagcaaggatggataatctgttaagcgcaaattatactgaccaaacattggatgctgttttgtcgccatatgatccaataagtttaggaatcatttcgtcattaaaaggcgtggggtatgggagtgaaagtaaacctttacctgtgattactggacaagatgcgacagttgctggcgttaaatcgatcattgccggggaacaaacacaaacgatctttaaagacacacgtatcttagcaaaaaatacgatagaaatgatcaaagcaatcagtgatggagaagaggttccggtcaatgatactgaaacttatgataatggggtgaaaactgtccctacgtatttagcaaatacagtatctgtcgataaagataattatcaagcagagctgatcgacaccgattattataaagaatccgatctgaaaaattaa

SEQ ID NO: 1438 - DNA (genomic), 513 bp, Enterococcus faecium; double-stranded, circular
  misc_feature (B) LOCATION 1...513
  hypothetical: NO
  anti-sense: NO
agaatgaaaaaaatgatgtttggtgttgctgccctcatcgtaatagggattaccggtatgacgggactgctcaatgccgcttttcacatggatgatattagtgaccaggaatatcggatctcattgaaaaaagcagcagcaatcgtaaaaaacgaaacaaaagaacataacatatctgctattcattttgcagttgaaaaagatttggagaatcctacgaatgcaacatatgaataccagtttttttgtgaaggacaagtcatagcagtcaatccatccactgggaaaacaaccgtacgaaatgacacggaaaaggccgcagaacatctttttgatatagaaaaaacggaagagttcaaacaaccgcaagcagcgatgaaggaagcagtcagctactacgggaaaaaagcaaaagtgaaagagtggacacttctagtcaaagatgaacgtccttattataaagtccgattaatagatggagaacaggaccgtcaggtatggatatctgcatag

SEQ ID NO: 1439 - DNA (genomic), 435 bp, Enterococcus faecium; double-stranded, circular
  misc_feature (B) LOCATION 1...435
  hypothetical: NO
  anti-sense: NO
agaatgaaaaaaaatattcgatggcagcctgaactggcacatacgatcatctattggtcattgaccttgatcattctgttttttagtctgattctttctttagaaaacacaggtccttattggaaaagcaattttgttttaggtatttttcttgtttttctatttctaggtttgcggcgttcttttattttaaaatcaaactctgtgattatacgttatgctgctttttggaaagaccgagaaatatctgtcggacagattcgatctttgacgccaactaatactggggtgcaaatgatgttgcaagatgagaaagccccatctgttttcatgatgcgaaaaaaagatcaagtagtcctttttgatcattttgaaaaaaacggacccaaatcagaatcaattccttatccttatacgaaaaaaagaaaaagctaa

SEQ ID NO: 1440 - DNA (genomic), 2103 bp, Enterococcus faecium; double-stranded, circular
  misc_feature (B) LOCATION 1...2103
  hypothetical: NO
  anti-sense: NO
gtgatgaaaaaatgtccaaattgcggatcgaaaaaaatggagcagaatactatctgtccagactgcggtcatcaaataactgcagaagatcagcaaataaaagaatcaattgaagaaacaaatacagatgcagctatgcaggataaatcaactgaagatgcagtctttcctgatacagaattaaacgatccaatcgaatggtcggaattgaaagatttacctctagaatctgtaatggaattattcgaaaaagcagaaccagaagacgaagaaccacctgctcacgatcaagtaactaatatagagaaaaatgaacagaagaaagcaactgttcatgagacttcggaagaatcaggaaagaatcaagaagaaacgcttgaatcaaaacaaaaaagaagagtagctgaactgaaagaaatcgtcgataatgaggaagaaaattcgatactatccgcttatatcaaagcacatcgtgaagatacaaaagaagagcacgcgaaagagctgctcaaaatgatcagtgaaaaaattgcacaggaaaacaaagtagagccagaaaaggaacaagaaactgaaaaagactctgatagagaaaacgccacaggtaaagaaacagtaaaaataaaagacgtaaaaacggatatcacagaaaaaactgaagtatttactgaaaaacaattagaaaaggaaaaaacgaataaactgccggaagcagagaaaaaagaaatactcgaaaacacagacaaaaagtcaacagagcccgatgaaataaatagtgaatccgatgctgaaaatcaatctgtaagcaaagagggtactgatcttgaagcaaaaatagaaaaagaagagaaccagcctaagctgtttgaagcagaagcgaaatcaataacaatcgtgccagatactgaaaaaacacatcaagaatcaaacttagaaaaaacagatccagataaagcgcaaaagaaaaaatcaaaaaaagtaccttatctcgttttagcagcagtacttctactcggtggaggaagctgggcttattatgaccatcatcaaaaagtagaagccgaagtagcagcagaagcaaaaagacagcaacaaatggaagaacttcatgagaaacttgctgccttttatacagatgatcaccatcaatttattcgtgcagatatgattcatcaagatttatcaaaactaaaaaatgatttatccagtcttaagaatgaaaaaggatattcagagttagaaacaacttaccaagatatccaatctaagatccgagatatccaaaaagtgaatgagtggttcatagcacctgccatcgtcgatgatcatctagcagatgacatcaagttgaaagcagataaagagatccaagcaatcgaaacggataacacagattttggaaaattgattcaacaagcacaaacagaagctaaaaatcaatatgctgaattgcaaacagctaaagaaaaaacagctatagtctttaaagacggaaaagtagtggattcagcaacacgcgaccaatacaagacggcaaaagaagcagtagaaaaagtgaaaaatacagatctatctgctcagttgaatgaacaattgaaacaagtagataagatgctcactgataaagagaaaaaagaagaagaggaaaagaaaaaagcagaagaagcgaaaaaagcagctgaagaacaagcaaaacaagccgctcaagcagcagctgcagctcaagccgctcaacaagctgcggtcgcacaagcagcacagcaagaagcggcatcctcgaccccttcctcttcaaactcagcgaatcagccaatcaaatctgccagagcaagtgatattgccgatgcatctaatccagcatggacgtgggcaccaggtgtccaaagcaaagtgattgctacatgtatccaacgtggatatatcgttgaaggaggttacagattagaaaaagccagaatcgaaaatggggaaggctattataatctatatgccacttcaacaaaatctgcattgatgaaaggcattggagaaagtgctttgccattttacatcgtaaccatcaactgtaaaactggatggttcggaggaaatgggagcaattaa

SEQ ID NO: 1441 - DNA (genomic), 1578 bp, Enterococcus faecium; double-stranded, circular
  misc_feature (B) LOCATION 1...1578
  hypothetical: NO
  anti-sense: NO
agagtgaaaaagagtttaatatcagcagtaatggtatgttcaatgaccttgactgccgtagcatcaccgatcgctgccgcggcggacgattttgattctcagatacaacagcaagatcaaaagattgcagacttgaaaaatcaacaagcagatgcacaatcacaaatcgatgccttagaaagccaagtttctgaaatcaacacacaagcacaagacctattagcaaaacaagatacattgcgtcaagaatctgcacaattagtaaaagacattgcagatttacaagaacgtattgaaaaacgtgaagatacaatccaaaaacaagcacgcgaagcacaagtaagcaacacaagctcaaactacatcgatgctgtattgaatgctgattcattagcagatgctattggacgcgttcaagcaatgacaacgatggtaaaagcaaacaacgacttgatggaacaacaaaaacaagataaaaaagctgtagaagacaaaaaagctgaaaacgatgctaaactaaaagaattagctgaaaaccaagctgctttggaatctcaaaaaggcgatcttttatctaaacaagctgatttgaacgtactgaaaacttcattagctgctgaacaagcaactgctgaagacaagaaagctgacttgaaccgtcaaaaagcagaagctgaagcagagcaagctcgtattcgtgaacaacaacgtctagcagaacaagctcgtcaacaagctgcacaagaaaaagctgaaaaagaagcacgcgaacaagcagaggctgaagcacaagctactcaagcttcatctactgcacaaagctcagcaacagaagaatcatcagctacacaatcttcaatgactgaagaatcatcatcagctacacaatcttcagcaacagaagaatcaacaacacctgaatcttcaacagaagaatcaacagcgcctgaatcttcagcaacagaagaatcaacaacagcgcctgaatcttcagcaacagaagaatcaacaacagtgcctgaatcttcagcaacagaagaatcaacaacagtgcctgaatcttcaacaacagaagaatcaacaacacctgcgcctacaacaccatcaacagatcaaagtgttgatacaggaaacggcacaggaagtagtactccggctccaacgccaacaccaacacctgaacaaccaaaacctgtaacacctgctccagctccttctggaagtgtgaatggtgcagcaatcgtagcagaagcttacaaatatattggtactccatatgtttggggcggtaaagatccaagtggctttgactgctcagggttcacacgctatgtttacatgcaagtaactggtcgtgacatcggtggttggacagttcctcaagaatcagctggaacaaaaatttcagtttctcaagcaaaagctggagacttgttattctgggggtcacaaggcggaacttaccacgtagcgattgctttaggcggaggacaatatatccatgctcctcaaccaggcgaaagcgtaaaagttggttcagttcaatggtttgcccctgactttgctgtcagcatgtaa

SEQ ID NO: 1442 - DNA (genomic), 2217 bp, Enterococcus faecium; double-stranded, circular
  misc_feature (B) LOCATION 1...2217
  hypothetical: NO
  anti-sense: NO
tacaagaaaaagacaaggtatgttcactgtcaggaggtgaatggattgacgattaaatgggaaaaatacctgcgtggcgtttattcctttatgatgctaagtgtaggtgctccgatatttgtagcagctaatcaattgcaaaatagctatcctcttatcctgactattggtatcctatgtcttattgtctgctgtattcctaaaaaatgggtacgattgctactttctttgccagtaatgattggctgtttgtttacctattttccttcaaagacaatttctttattatgggtcgtacagtttttttcgtcagttacagaggaattcttccatctatcccaaggtaaacttcattatttaccagaaaagacagctttttttctcatattgttgttgatctatttatttattactttgaccgtggattacgactattggtatgcaccctttcttgcattgatgggttacttcatgatgcttaccgtttttcgggaaaaagaactattgtacgaaatgattgcggtagtagctgttttatgcgtatatttggcagcaaggcaatttttctccctccgattgttgtcgggaaacgctcgattccagtcgttaactacgatcctgcttatttgtttgttcactttcagcgccatcttgcctttatatctcccaaaagtataccaatctcttgaggaaacgagtgaaccgatccgagaatatcttaatgatgaagggctttatgacagactccatgagtatcaattaaccggaagtgccagaacgggtttcagtgaaaatgatgaacaacttggtggtccattgtatgataatggcgaagttgtttttacagcgaaccagaaagtaaacggctattggaaaatagaaaataagaatcattacaccggttctggatgggtagaagatccggatgcacccatccaaccaatccaagaatttcctgttgatatcacaagctaccaaacagttatggaagaaaaagaaaacattacattgacgctaaaaaaccaagctttcttaccttatccttatggaaatactaccttgactgatttttcattagccagtggacaaacactttactatttgcctgaaagccaacgattcatccctgtcccgaatgaatcgacgcgattggcgtccttacaaacagaaagattagcttttacgagagaagaattaaaaagcagtcagttagaggccgatgatttagaaaaacaacagacaaatcttcagttgccgaaagggttgcctcaacgtattgaggacttagcgatcgaattgaccaaaaatgaagcaactttaattcgtaaagttgaagctgtcgaacagtatttgaaaacaagcgggaattttcgctattccaaaacggataccggacatacgcctaaagaacgcgattatgtagattatttcctcttcgattcaaaagtcggctactgtgacaacttttcaacttctatggtcgtccttcttcgcacactaggcatcccagctcggtggacaaaagggtttacggatgggattagaacaggaacagatgagcaaggaaatgaggaatacagcattctcaatagtcatgctcattcttggccagaggtgtactttcctgggtttggctggcttccatttgaaccaaccccttcatttgccaatccaactgtttcacaaccagccgctgaaacaacagaaaccgtccaatctgctgaagaacagccaaaagaaagcgaaaatatagtagaaactatttccagtgagaaacctgagactatttcgtcagataacacgacactcacaccgtcttataaaatcgtcttattcagccttggggtgtgtttatccgtcttgttgttctttctattgttatttagaaaatctctgcgctggacaagttatcttatctatcttcatttttttgcttctactaatgcggttgcgtatcaaaaacttctccaccatctggaaacactggtaccgcgcacccccgcagaatctttgcaggcatacagccaacgaatagaacaaacattcaatctagatcaacgtttcactcgattaactgctcaatatgaagcagaaatatatgggagacaagcagatccggtaaaattcgataaaaaaacctatttagaactaacgcatataataagaaaaacggtatccaaaaaggttatgacaaaagggagcagcttcaaaaaataa

SEQ ID NO: 1443 - DNA (genomic), 240 bp, Enterococcus faecium; double-stranded, circular
  misc_feature (B) LOCATION 1...240
  hypothetical: NO
  anti-sense: NO
ataaagaaaaaattcaagcaacaattcaaaaaaatcttaactgctgagattgatgtagcaatatctcaatcatcaacaaagtacgatcctgcctttcaaaagcttattgataaatgtttattcattataaaaataaaagaaaaatttatgtcagcttttttcatcaaagtggtaatgataattcgtctattaattgtattttttaggaaatatggtataattgttttaacgaaaaggtaa

SEQ ID NO: 1444 - DNA (genomic), 1293 bp, Enterococcus faecium; double-stranded, circular
  misc_feature (B) LOCATION 1...1293
  hypothetical: NO
  anti-sense: NO
atgaagaaaaaatatgtacaagtcggacttggtgggagagcgcgttttttttatgaggcaattgcctctacgtatcatcaaacttgtgaactagtcggtttttgtgatgtatctcaaacaaggatggattatgcaaatcggatacttgtgaacaagtatggacagaaaaaagtaaagacatgtatgccatcacaatttgagcaactactggatgacgtacggccggctgaagtcattattacgtcagtagatcgaacgcatcatgattatatcattcgtgcaatgaaaaaaggatatgatgttatttgcgaaaaacctctgactatcgatgaggaaaaagctcaagaaataataacggtccaaaaacagacgggaagaagcctgcgagtcacttttaattatcgttatgcaccgtatcacacgaagataaaggaactgatagaaagtgatgtgattggtgatgtgttttctatccacttcgaatggctgttaaatacgcaacacggggcagattatttcagaagatggcatcgaaataagcacaatagcggcgggcttcttgttcataaatctacccatcattttgatctagtgaatttttggttgaacagccgtccccaaaaggtatttgcattcggtggattaaacttttatgggatgcataatgcggagaaacgcggagtagaaatattttacagtcgatgctatggaagcgaactagctaaagctgatccatttgctatagacctgtcagccaatgaggaattgcgagaaatgtatttagaagcagaaaaagacagtggatatattcgtgaccgcagtgtattttccgatgatatctctattgaagatacactaggcgtaacggtcaaatatgaaactggtgcgattttgacgtattcgctaaacgcgtatatgccgtgggaaggattcaatgtttctttcaatggcagcaaaggacggatcgaaatgaaagtgatcgaaaagtcttacatcaatgcaggtggagataaaaaggatgaaggagcagccgttcttcagtccatccatgtctatccgatgttcggtgagccatatgaggtaatcgtcgaacaagaagcgggcggacatggcggaggagatccgcgtttattagatgatctatttggtgaagaaaaagaagaagatccgtggaatcgggcagcaactcacgtagatggtattttgtcgattttgacaggaatcgcagcaaatcattctattgcttcaggaaaagcagtagtgattgacgagcttgtcagcttaaaagaataa

SEQ ID NO: 1445 - DNA (genomic), 363 bp, Enterococcus faecium; double-stranded, circular
  misc_feature (B) LOCATION 1...363
  hypothetical: NO
  anti-sense: NO
agggagaaaaaaatgaacgatttattagcaactatatttacaggtattattattgatgaaaatgaaaaaaactactttgtccaaaaaaacggacaaacctttggcttaagcaaatcagaaggtgaacacaaaatcggtgaagcagttgaaggattcggttaccaaaatcaaaaacatgaaaatcggatcactacacaaattcctaaaagccgtatcggtcattacgcttttggaatcgttactgctacacgaaaagatttaggtgcgtttgtcgatatcggtcttccagataaagactttgtcgtatctcttgatgaattgccgacaatgacagagctatggcctaaaaaagggatcgcttga

SEQ ID NO: 1446 - DNA (genomic), 495 bp, Enterococcus faecium; double-stranded, circular
  misc_feature (B) LOCATION 1...495
  hypothetical: NO
  anti-sense: NO
ggctggaaaaaagtatccatcttattgaatgatgtcagtaactacaagaccattctgcggattaacaaacagcgcttcaaatgtaaacactgtggaaagacttttttagcagaagattcagttagtgatcgtcgctgctccattgctcgcagagtcaaacaagccattcttgagctattaagcgaacctctttctatgtctttgatcgcacgtatgaagcacatttctccgaccactgtcattcgaatacttcgcagccttcggcctaaaaccatttctttgagccagctgttaccagaagtggtgtgtttcgatgaattcaaatcagtgaaaaatgtctcgggagccatgagctttgtcatgatggacggcaagacccatcaactgattgatattgtggaaaatcggcaactcaatcctttacgccactatttcttgcgctaccctataaaagtccgtgacgatgatatgtcaaatggacgtaaagataagtga

SEQ ID NO: 1447 - DNA (genomic), 1293 bp, Enterococcus faecium; double-stranded, circular
  misc_feature (B) LOCATION 1...1293
  hypothetical: NO
  anti-sense: NO
aaacggaaaaaaagtgaaaagaggaatgaaaaaatgacagaattgataattggcggagtcacagcaagcacattggcagaaaagtataagacacctctgtatgtgtatgatgaagaaaagatgagacaaacgatgctgtcattcaagcgaggctttgtatcgaaacgttttgatacaaaagtgctttacgcctctaaagcattccaaacgattgagatgctgcatttagttcgtgaatatggattcgggctagatgttgtcagtggtggggaaatctataccgctttgcaagctgattttcctagagatactatctacttccatggtaacaacaagacgccagaggaactgatctatgcacttgaaaatgatttgttgcatattgttgccgataatttgatggaagttgaattattagcagaattaagccaacgctatttaaaaaaaatctgtatcatgcttcggttgaatgtcggagtagaagcacatactcatgaatatatcgtcactgcgcatattgattcaaaattcggcatgagctatgaaagtaaagagtgccaacaagcccttcagttgataaaagaaagcagctatctagagttagaaggatttcatgctcatatcgggtcacaaatttttgatgttactgcttggttagctgaaatcgacaaattgacgaattacttaaccgattttgaccaacctctttccttgaatcttggcggagggtttgggattcgttatacacaaaatgatcagccgatcccagtcgaagaggcactaaaaaaactgattgaatatacggaagaagctttggaaaaacgaaaactgaccattcgtcaattactgatcgaaccgggtagaagtattgttggagaagctggtacaacactatacacgattggtttcatcaaaaagacaccacataaaaaatattactttgtagatggcgggatgacagataatatccgtccagctctgtatcaggcagaatacgattgtgatttagcagcaaaactgtcggaagaaaaaacagagaaagtgacgattgcaggaaaaatgtgtgaatcaggcgatgtggtaattaaagaagcttatttgccgaaagcagaatcgggtgatcttttagctgtttattccacgggagcttatggatactcgatgagcagcaactacaatcgagcgacacgaccagcagttgtttttgtcaataatggccaatcaagactgattgttcgcagacaagcattttctgatctactaaggggggaagtttcctatgatccttcataa

SEQ ID NO: 1448 - DNA (genomic), 741 bp, Enterococcus faecium; double-stranded, circular
  misc_feature (B) LOCATION 1...741
  hypothetical: NO
  anti-sense: NO
gtaaggaaaaaccactgggagagcattatgaataaaatcaagctcttcatctttgatatggatggccttttattagaaactggacgtttagcttatcgtgctaatgtaaaatcagcacaaaaatatgattatgaaatgcgtaaggaagtctattatttactaactggccaaacagaaatggcgataagagaacaaatgggcattttgtacggagaagatgttccatatatcaaatggcgagaagcaatcaatcaatataaagaaaaaatcgtgaaagaagataagagagtatatacgaaaaaaggagcagaagaaattttatcttttgcaaaagaaagaggaatccatacaatcgtggcttcgtctaatacacgggtaaaagtagaaatgtatttaaaaatggaaaatctatatgccttgtttgatcaaatcatttcaggggatgatgtaaaaaaaggaaagccggaaccagagatctttttgaaagcttgttcaaaaatgaatattcctccaagtgaagcacttgtatttgaagactcgattgcagggatcgaagcagcaaggcgagcgggcattttgtcttttctcatcaaagatcatttgatagggttgcccgatcataatgggaagcataagttgaaagtagatgtaagtttatatgaatccaataaagcagactatgaattttatgacctgcatcaagcaaaacgatttttagaaagtaaagggttgtatctctaa

SEQ ID NO: 1449 - DNA (genomic), 570 bp, Enterococcus faecium; double-stranded, circular
  misc_feature (B) LOCATION 1...570
  hypothetical: NO
  anti-sense: NO
aggaggaaaaatcgtatgacaaaaaaaattggattttttattggtagtttaagaaaagattcttacaacaaaaaagtagcagaagcttttgcaaaattgcttcctgaagggtacgaaagtgtatttgtaaaattcgatgatctgccattttacaatgaggatcttgaaaccccagaaaaagcgcctgctgaatggactcgttttcgtgaggaagtgagtggattagacggtgtcgttttcgttactcctgaatacaaccgctctgtgccagcagtattgaaaaatgctttagatgtaggctcaagaccttatggacacagtgtttgggatcataaaccaggtttagtcgttactgcatcaccaggtgggatcggcggttttggcgcaaaccaccatctacgccaatcacttgtctttttgaatgtgcctaccttgcaacaaccggaagcatatatcggaaacgttacgaatctaattgatgaaaacggcaatatcgttgaaggaacattaagtttcttccaaacgattttagatgcatatctagatttttctaacaaattagcagaataa

SEQ ID NO: 1450 - DNA (genomic), 2658 bp, Enterococcus faecium; double-stranded, circular
  misc_feature (B) LOCATION 1...2658
  hypothetical: NO
  anti-sense: NO
aggaggaaaaacatgcctcaaaaaactaaaaatactcctatgatggaacaatatctaagcatcaaggcccaataccaagatgcttttttgttctatcgtttaggagacttttatgaactattttacgaagatgcgatcaaagcgtcacagcttttggaattaacgttgacgagcagaaatcgaaatgcagaagaacctattcctatgtgcggtgtacctcaccatgcagcacaaggatatatcgatgccttgattgaaaaaggctataaagtagcgatttgcgagcaggtagaagatccaaagacgactaaagggatggtcaagcgcgaagtgatccagctagtcactcctggtacagtcatggacagcaaaggattgtcggcaaaagacaacaattttttaacagctgtagttagtcaaggaaatgaatttggctttgcttatgccgatttaagtacgggagaattgaagacggctcggttgcatgatgaagaagctgttttaaatgaagcctctgcattgcagacaaaagaactcgtattaggcagtgagatcactgatacccttcgtgaacagctaagcgggcgtttagggctagtcttttctcaacaaaatgagatggaagaaaacgcggaatttagctttttgacaagcgaactagtcgatccgctggaaaaagaagcaaccggcaaactattgacttatttatcggtgacacaaaagcggagtttagctcatatccaaaaagcagtagaataccaaccagatcattttttgaaaatggattattattcaaaattcaacctagaattaagccaatctattcggactgggaaaaagcacggcactcttctatggttgttagatgaaacaaaaacagcaatgggtggccgtttactaaaacaatggctagaccgtccgcttatccaggcaaaacaaattaaagcaagacaagaaatggtcgcttctttgctagacagctattttgaacgtatcgatttgcagtcagcattaacgaaagtctatgatctggaacgcctagcaggtcgagtagctttcggtaatgtcaatgggcgagacttgatccagctgaaaacttctttagaacaagtgccaatgatcagagggttgattgaaggaatcgatcaaggtcaatggcaaagtctgctttcagaaatgcagccgatggaccatctcgtccaattgatcgaccaagctatccaagatgatccgccgttacaaataacggaaggaaacatcatcaaagatggattcaatgagcagctcgatatgtaccgttctgctatgagaaacggaaagaaatggttggcagaacttgaagcaaaagagcgtcaagaaacaggaatcaagaacttaaaaatcggatttaaccgcgttttcggttattatatagaaattacaaaagcaaatcttggaaatgcagaactggagaagtatgaacgaaaacaaactttagcaaatgcagagcgtttcatcacaccagaactaaaagaattggagacacaaatcctcgaagcagaagaaaaatctgttgatttagaatatcagttgtttttagctgtgagagaagaagtcaaaaaggctatccagccgctacaagtacttgcaaaagcaatcagtgcagtagatgtgctacaaagttttgcaacgatcagcgaacgctatcagtatgttcggccagaacttgtcagtgacaagcatcagcttctgatcaaagacggacgacatcctgtagtagaaaaagtattaggacatcaggaatatatccctaacagcgtagaaatggcagaagacgaaatgatcttgctgattacaggaccgaatatgtctggtaaaagtacgtatatgcgacagttggcattaactgttctgatggcgcaaatgggctgtttcgttccggcaaaacaagcagttttacctatttttgatcggatttttacccgaattggtgcaagtgacgacttaattgctggacaaagtacttttatggtagagatgatggaagccaatcaagccctgcgttatgctacgccaaacagtttgattttgtttgacgaactagggcgaggaacagcaacctatgacggaatggcgttggcccaagcaatcatcgaatatatccatcgtcatgtacaagcaaaaacactcttttctactcattatcatgaactgacggtacttgagaaagaacttccgcagcttaaaaatgtccatgttggagccgttgaaaaagacggagaagttgtcttcttgcataaaatgatggatggacctgcggataaaagctacggcatacatgtggcaaagatcgcaggattgccttccaatctactagaacgagcagcagatatcctgcatacgctagaaaatggcgataacggacaccatactgttccagctgaagtagaagagaaaactaaaacagccaaacaggagcaaataaaaccacctgcagaaaaagtaaatcaagaccatatacaagaccgtgtaaaagaagaaaaccaacagctttctttattcagtgaattatccgaaaatgaaacagaagtcattgaatcactgaagcaaataaatttactagaaatgacgccaatggatgcactaaacacattatatgaattacaaaaacaactgtag

SEQ ID NO: 1451 - DNA (genomic), 1152 bp, Enterococcus faecium; double-stranded, circular
  misc_feature (B) LOCATION 1...1152
  hypothetical: NO
  anti-sense: NO
gaacttgaaaagaaagaagggatagacatgaaaaaaagatacaaattggtgatagctttgctaaacattaccctattattcagcttaagtgcatgtggaaaaactaacgaagaagtaacagcaaacatcgcagatccaatgataaaaaaagccactacattagaagtatatgtcgcaaacggcaaactgacaaactatgttgaaaatgctgcaaaaatctataaccgcaaaactggagcaaatattgacttaaaaattgtgaatgtagcttcgggaacagcaacagtacaaatgatcaccccaaaattggtaacacacgaagatatgccggatattatctccatggcagacacttcagcagcaggtgtgctggaaaaatttcaagatgctttttatagtgctgatgaatatggattttatgacaaatatggcgatcagttttatgatcaaaaattgaatattttgcgtcaacaaacgagtaatgaaacgattattccttgggctagtgattttaccccagcactttgttattatcaaccaaaaaaatttgctgaaataggtgtagattttgaagaaatcagttcttgggaagaatatatccaggtggcaaaagcattaaaagaaaaaactggtagttttggaattgccttgccagaatctggggaccaagaattgtttatcaacatgctagcccagcagaatcaatctttgcttgatgaagaaggaaatatccgtctgaatactaaagaagcgaaacatgctgcaaagttaatcaaagaaatgatcgactcagatattgtacatttctacggtgcacaagatgctgagaaagcatttcaagaatctgcaatgtttgttgctggcggctggtatgctacgaatatgtctttgaattttcctgatgcatctgacaaatggcgcatggctccactgattcctttttcaaaagaaaatccaggaaaaggtgcagtatcaggaggatcaagtttttatgtccctaaagatgccaaaaatccacaagtggcacaacaatttcttacatttatgctgacagatgaagaatgcttagccaacgcactggagctgggcgtggctacatctaactcattggcctatcaaacagaagcagctgagaaaaagtttgactactaa

SEQ ID NO: 1452 - DNA (genomic), 306 bp, Enterococcus faecium; double-stranded, circular
  misc_feature (B) LOCATION 1...306
  hypothetical: NO
  anti-sense: NO
ggttatgaaaagccgctagttttgaataacaaaaaagctttacaaagattttatgacaaagaaaaagccgagctctcgataagctcggctttcttgtacctcggaaggattcaaataaacagaaatgattgtaactttccatcatacatgcaaagcacggtgttgaatttcttcatgttaaacaaaaattttgttttcgttacatcttcaacatttgaaacatctcttgttcctattcaattttcagacgtttacgttattcaattgttacgtatcgcattacttcttgtttcggatacttcgtga

SEQ ID NO: 1453 - DNA (genomic), 1293 bp, Enterococcus faecium; double-stranded, circular
  misc_feature (B) LOCATION 1...1293
  hypothetical: NO
  anti-sense: NO
gaggatgaaaaaatgaaaacactcattaaaaacggtcagatcaatacacgaaaaaatatgacgacaccagcagaaatttggatagaagatgggcgaatcaaagcaatcggtacaggattctcagaagccgaatttgatgaagtgtttgatgcaaagggacaattgatcacacctggtttagtggacgtccatgttcatttgagagagccaggatttacatacaaggagacgatcgaagctgggactcgctcagctgctcgtggcggtttcactactgtatgcgcgatgccgaatttaaatcctgtacctgatacggcagaaaagctgagacaagtatatgacatcattagaaaagatgcagttgtgaaggtattgcagtatgcgccaatcacagaaaatctgcgaagtgagaaattagttgatcaagaagcactgattgaagaaggtgcttttgctttcacaaatgacggtgtaggtgtccaaacagctgggacgatgtatctggctatgaaagaagctgcaaaaaacaataaagccctagtagcccatacagaagatgaatctttattatttggcggcgttatgcacgctggcaagaaggcagaagaacttggtcttcccgggatcttaagcgtaaccgagtcttctcaaattgctagagatctgttgctagctgaagcaactggtgttcattaccatgtttgccatgtttctactaaagaaagtgtccgtgtaatcagagacgcaaaaaaagcaggaatccacgtaacagcagaagtttcaccccatcatcttattttgatcgacgaagatattcccgaagatttcggcttttggaaaatgaacccgccgctaagaggacgggaggacagagaagctttgatcgaaggcttgcttgacggtacgatcgattgcatcgctacagaccatgccccccatggattagaagaaaaaagccaaagtttcatgaaatcaccatttggtatcgtaggaagcgaaacagcgtttcaactgatctatactcattttgtagaaactggtcgattcacgttggaacaagtgatcaattggttggcagttaaaccggctgagatttttggtttgaatgcaggaacgctaacggttggtgcccccgctgatgtagcagtttttgatattacacaaacttgcacgatcgataaagaagactttttatcaaaaggggagaatacaccttttatcggctggaaagtaaaaggcgaaacacaaatgacttttgtcaacggaaaacttgtgtggcagaagggagaataa

SEQ ID NO: 1454 - DNA (genomic), 1053 bp, Enterococcus faecium; double-stranded, circular
  misc_feature (B) LOCATION 1...1053
  hypothetical: NO
  anti-sense: NO
acaggtgaaaaaattgttataatatatctagaaatgaggtgcaccatgttaccagaaaaaatggaacaagggtttaatcaaaacctggaagctattcagcttttacagaatgcattgggaacttcctttttagaagcctatgtcgaaaatgcagaaaatttaatagatgattatcaagtacgtgtggtggatggagtgccgacaaaagagacaacgcaacggatcacagctctttatgaagagttgaagaaactttctttcgagccagaagaatggcgcagactgtctcaattacttttattgaagggcagccagacagaacatttgcaggcgaaccatcaactcactcctgatagtatcggttttttatttgtttttcttattgaacaactatacacaaataaaaaagcaccggttaagattctggatattgcggcaggaatgggcaacttgttattaacagttcttttaaacctatcgaatgcggggtaccaaacagaaggaattggtgtggatattgatgatacattgttggctgtcgcagcttctacaagtgatttgacacaagcaaatgttcaatactttcatcaagacgggttgcaggaattattaatagatcctgtcgattttgcaatcagcgatttgccaatcggttattatccgaatgacgaaaaagcaaaagagtttttaacaagtaccgaagaaggccatagttatgcacatcatttattgctagagcaatcaatgaaatatgtgaagccggatggttttggtttgtttttgatgccgagtggatttttagaaacggatcaaagtgaagaaatcaaaaaatggtttaaagaagaaggttatcttcaaggaatgattcaattgccagatgaattgttccgtaataaacaatcgcaaaaaagtattttgatcttacagaaaaaaggaccacaagcacaacaagtaaaagaagtcttgcttgtgaaacttgcttcattaaaagaaccagagaaggtgacggaatttttcaacgagtttaaaaactggaaatcatctgctctgtaa

SEQ ID NO: 1455 - DNA (genomic), 900 bp, Enterococcus faecium; double-stranded, circular
  misc_feature (B) LOCATION 1...900
  hypothetical: NO
  anti-sense: NO
gaggtcgaaaaaatgaaacttggttttatcggaacaggcgtcatgggaagtgctgtcgcacgccatctactagaagcaggacacgaagtagctgtctataatcggacaaaagcaaaagctgatcctttagtaacagaaggagctatctgggcagatacaccaaaagcggtagcagaacaaagtaatattctctttacaatggtaggttaccccaaagatgtagaagaaatctactatggacagtcggggattttttctgcagatatctcaggacatattttagttgatttgactacaagtacaccaagcctggcagaaaaaattgcaaaaacagcaaaagaaaaaggcgcagatgcgttagatgcaccggtatccggtggtgacttaggagcaaagaatggtacactgacgatcatggtcggtggagaagaagccgtttatgatcaagtactgcctttattcaaagaatttggtacgacatttacattgcatggttctgctgggaaaggtcagcatacaaaaatggctaatcagatcatgattgcaggtacgatgacaggaatgacggaaatgcttgtctatgcacaaaaaaacggacttgatttaaagaaagtgattgagacgctttcaggtggaagtgcagctaactggtctttaagcaattattctcctcgtattttaaaagaagattacacacctggtttttttgtcaaacattttatcaaagatttaaagattgcattagaagaagcagaaaaaatggatcttgtattgccagcaactacccaagcattgaaactatatgaagagttggcagataaaggttttgagaatgacggaacccaagctttgatcaaactttggtggcctgaaggaaaaataccagaaaaaaaatcataa

SEQ ID NO: 1456 - DNA (genomic), 1830 bp, Enterococcus faecium; double-stranded, circular
  misc_feature (B) LOCATION 1...1830
  hypothetical: NO
  anti-sense: NO
aaaaacgaaaagtttcacaagcaagtggcaaaacgtgattggaaggacgaaaagatgctgaacactttaaaacccttgatcaaccaactaaaaaagaaacatacatactttattcttggcatagccctattatttacaattattcgtttgtatttatatagtaaagcaatctatggaacagacatgtcggcaacctatgatgaccagctgctgattcgctatgctcaaaatattttggacggtaaatggctaggggagtatacgactacaacactttccaaaggaatctcctacagcttatttttagtacttgcacataaactgcatctttcttatgcagttttgttcggcatgttcagtatttttgccagtatattggttgcactcgcgtttaaaccgattgtgaagaacaagtatcttcttttaagtatctatttttattttttgttttctccgattagttttacacatgaatattccactcgaacatatcgtaatgccctcgtgattccggctgttgagatcattatcgcttgtttattagctatttattaccgcaaatacggttctagcagaaaattgctgccatggtttttagggctttctgtcgcttttcctttcttttggttcattcgcgaagattctatctggcttcttccttttactgtagtagctttgggtatcagtttcgtccagatcttgctagggcaagacttttctttcaaagaagtaaagaagttaaaaaaacgactctttcttctctcgaaacgggaatggctgaaactttcattgtttttacttcctatagttggcttttccatcgtctatcaatggatcgaatataaaaatgagacaacatacggtattgcaaccatcaatgaccgttccagtggagaatttggacgtttgatgaaacaactgatccgaatagatgatgaaacgaacttgaataaagaaaacagtgagatatgggtctcacatgctgcactaaataaagcattagccgcatctcctacattccatactgtttctacccgtattgacgaattatatacgactcacgcgtggactcaaggtggaaaagtaaaagaattacccggagatatcatcttttgggcattgcgagatgtggtaagcgaatctggttattaccaaaacaatgcaaaagaaaccaatgatttttggaaaaaagtcaaccaagaattagaagaagcctatcacaagggaacaatcaaaaagaaaaaagagttctatctgatgggatcaggagatggaaagacgatgagtgatctgccaatcgtattcgatttccttcaatcaggatacgcttatgcatggcgatataaagatttccatcaaggaggaaattatagtttcggaacgcaagaacaagtcaaacaggctcaagaattattaaaccttccgctaatggagaattggatcgatagtaatgaaccgagaacacctaatttccaattaacaaaatcagcaaaagtcgcgaatgtcatcataaaaatttaccaagttctggctattcccgtgctgattgcttcaatagcagggatattacttatgatactaggaaccgtatttgcaaaagctgatcgtgcctattatagttcctctttgattgtggtcaccggattaatactgacacaattggtttttcttttcggtgtctcatggttttgttcttatgcgccagaaaaaaaggactattttttaagtgtctacactggtgcaggcgtgccattaacgcaattcatcgtagtaacaagcatgctagttttcagtaaattaaatctgaaaaaagctttatcttctaaataa

SEQ ID NO: 1457 - DNA (genomic), 483 bp, Enterococcus faecium; double-stranded, circular
  misc_feature (B) LOCATION 1...483
  hypothetical: NO
  anti-sense: NO
aatagcgaaaaagagtcttccccagatttgaaattaaaaaaagcttatgcggatcaaagcgatggaagaaatgtgattaaggcgaatcttcaaaatccaaatgcttcttatatgttcggcttgactacatcggttgaaatctacaaaaaagaaacaaaagagccttacctttcaataaaaaaagaaaaaatagatgtagcacccaatacaaattttgatttacttgtcccattagaaggaaaaaaattagctccgggacattatcaagcggttgtgaagggtgcttggaaagaaaaacgctggaatctccataccgattttgaaataactgatgatgcagcggaccaattgaatgaaaaggatattgatttaaaaaatcagccagaaacatttgactggcgatggctgatacttgttggagtcattcttattggcttatttgctggattatttattttaaaagaaagaaggaaaaagaaatga

SEQ ID NO: 1458 - DNA (genomic), 213 bp, Enterococcus faecium; double-stranded, circular
  misc_feature (B) LOCATION 1...213
  hypothetical: NO
  anti-sense: NO
agaagcgaaaagcctgatcgaaaagaacaaagaaaatttggaagaaaagtacccgatcgcacaagaatttatagaattaaaacaaggaacgatccttcaccgattcaaacatttttttggtataacagaatagaaaaaacgattaaagatcggcagaaatttgctgcatctttaatcgttttctttttaaacatgcgagggattcaattctga

SEQ ID NO: 1459 - DNA (genomic), 849 bp, Enterococcus faecium; double-stranded, circular
  misc_feature (B) LOCATION 1...849
  hypothetical: NO
  anti-sense: NO
agaggcgaaaatcaacgaaacgaaagtgtaggaacgaaaatgatcaaattagtagcaatcgatttggacggtacattattaaatgaacaaaagctgatttcagatgagaataaacaagcattagcacaagcaaaacagcaaggggtcaagatcgttctatgtacaggacgccccttagctgcgatggcgcattatctgcaagaattaggactggtagatgaaggtgactacagcatcactttcaacggcggtttggtacaaaaaaatgatactggtgaaatcatggaaaagaaagtgatggaagtatcagatatccaacgcttatacaaactggctcagcaattggatctgccactagatgttttgtctgacaatgtggttttacagctgcctagtgccccaaggaagcaatccttgtacaatgtgttgaataagctgctgcaattccaaccagcggatataagcgatattacagatgaatttgtgcttaataaggcagtaatcgcttatgaccaagaagaattagatcctaaaatcaaagaaataccagcagaattccatgaaatgtatgagatcatcaaaacaagaagtatgcttttggaatttatgccaaaaggtgttacaaaagcttatggtatttctttattggcaaaagatcttggtttgaaacaagaagaaatcatggcgatcggtgatgaggaaaatgatttaccgatgatccaatatgctggactaggcgtagcgatggagaatgctgtgcctttcgtcaaagaagcagcagatttcgtgacagccagcaatgaagaaaatggcgtagccaaagtgatccaaaaatttgtattagagtag

SEQ ID NO: 1460 - DNA (genomic), 837 bp, Enterococcus faecium; double-stranded, circular
  misc_feature (B) LOCATION 1...837
  hypothetical: NO
  anti-sense: NO
tttttagaaaaaggaaggagaaaaattatgtatgatgcatttgtagtcgctttggccgtttttattggagttgctggacatgaaatgttcgggatgtccatgctgagtcgtccgattgttgttgctccgttagcaggagcgttgatgggggatttgcagacggggttgattgtcggggcgtcactagaagccatctttatgggtgtcgtcaatatcggaatctctagtacggcggagccttctttggctgctgggctggctacagcgttcgcaatcaaaatgggaggaaacgtggatgcgattattcccattgtctttccactagcagtattaggattacagttaatgaatatgattttttcttttgtatgtggaccgatggctgctaaatttttcaaatttgcaaaatctggtgatcaaaaaggaatcatcaatctgcacttctttatgtggtttgtccactatgcgctttatgctcttattccattctttgccgttttatttggagcagatgttgtcaaaagcgtcttggataatattccagaggtcatcatgaacggattaacagtcgctggaaatctgctgccggcagttgggatggcgatgctgttacggatgctttggagtaaaaatattgctgtgtggtttttctttggggccgttgttatggcgtatctcgagttaccattgattgcaattgccgcagttggaacgattattgcaattgttatagcccaaagagatctacaactaaaaaatatatctgttcatgcagttcaaagcgatgctgctgtaaatgcaacgcttgaccaagaagaggaggatttctttcaatga

SEQ ID NO: 1461 - DNA (genomic), 189 bp, Enterococcus faecium; double-stranded, circular
  misc_feature (B) LOCATION 1...189
  hypothetical: NO
  anti-sense: NO
gatttagaaaaacttactaaacaaagagatatgaaaaactttaataattgtgtagttttgataattataactgaattaactttatttacaaatatatattatatccatgaagcccaatcttctttaatagaagattgggctatttttatggcaaaggagggaaaagaaatgtttcaaaataaaggataa

SEQ ID NO: 1462 - DNA (genomic), 321 bp, Enterococcus faecium; double-stranded, circular
  misc_feature (B) LOCATION 1...321
  hypothetical: NO
  anti-sense: NO
ttcttagaaaatttgttcaagcaatcacgaagaggagggggaaatatgtctctacaaatcattgatagcattgtttctatacaagttgaacaacaagtgaaagagataattacagtgctaaagcctatgctagaagacattatttctggagtcactctagagtatatggactatcagcaggcaagtgaatatctaggtgtatcagtaggaacgattagaaaatatgtttctcaatacgggttacctgttataaaaattgatacggtcattagatttaaaaaatctgatattgatagtttcatggaacggtataaaggttga

SEQ ID NO: 1463 - DNA (genomic), 1068 bp, Enterococcus faecium; double-stranded, circular
  misc_feature (B) LOCATION 1...1068
  hypothetical: NO
  anti-sense: NO
aatatagaaaatgaacactattggagggaatttgtaatggacagcaaaactagaaaacaactgcaagaaaagttaaagcaacgtacacacttgctcccttccgtctttcaacagtttttagaagaaaatcgttcttccctttcattaggcagtcgctatgaatacgcaaaagattttcatctgtttactgattatttgagaaaagtattttctgaagaagtggatgatcagctgattatccatttagaaaaacaagattatcagaatttcttagctaaaatctatcgacatactcgttcgttccaaactacagcgaaccaagaaacggagcaattgtttgaaaatagctattacgggatttcaaggaagcaatattcattaaatcattttttacgatttttgtatcaaaaaggactgattgaagaagagatttctcttttgggtacaagtttaccggaaacaaccaaagcagctccgcgatatatcgatgcagaacttttcaaagattttgagcatttgtttatcccgattgaaggctttcaaacaagcagagaagctagctttgaagaaaagaatagaccgaggaaccttgcaattactgccattcttctgtattgcggattaaagatccatgaagtagtagaacttaaacgtaaagatgtatctttgaccaagcagattcttaatctgaatagaaaagaaaacagactgaataaagtaccaataccaaaagaagcgatgccatttctggagaactattttaagttaacagcacaaaatacggacgaaaattcttttgtttttcgttcctcacatgatcagcaaatttctcctcggactattcgccaaattttgagcaaaattacagtatataaaaacgtatcgccagaactatgcagaaaaacatatcgttattatgcagaactatatttagatgatgctgacgcggtaaattatttatgtggtaatcgatacctctcatcccattcttttcaagatatctgggaaaagatggttgatttttcttatcacgaattagcggcattcgttcgggtttcttccatataa

SEQ ID NO: 1464 - DNA (genomic), 2061 bp, Enterococcus faecium; double-stranded, circular
  misc_feature (B) LOCATION 1...2061
  hypothetical: NO
  anti-sense: NO
aatatagaaaaatatagaaggaagctggacatttattgttcccagcttcttttttgtatagacctatttctatttttttattatattggatatatatattcattgaaaatagagcataacaactttataatgttgagtataccaatttttggaggcgttttaatggaccgctatttagatttactttcagagaagttccctacaacggaagatgtcatcacggaaatcatcaatctcgaagcaattttgcagcttccaaaaggaacagagttatttttgagcgatatacatggcgaatttcctgcttttgatcatattctgcgtatcggttcaggaaatcttaaagaaaagatcaaagaccttttctctgaacaaatgacggaaacggagatcagccaattcactatttttacggcttatccagaatatgtgttgacgactgattggtacaaaaaacaagataaatcccagctgatccatcgtttgatcgatcttttacggtttacgacagtcaaatacactcgatcaaaagttcgaaaaggattgccgaaagaatatagctatatcattgaggaactcttgtatatcgatgatcgtatcaacgggaaaaaagactatgtaaaaaaaatcattgaacaacttgtcttgatgaaggaagaagaaaaatttttaacaaaacttgcgcagacgatccaaaaatctgtcatcgatcatttgcatatcgtgggtgatatttttgatcgaggaactcaagcagccaaagtaatggatcgaatcatggatttttcctctgtagatatccagtgggggaatcatgatattttgtggattggtgcgtattgcggctctgaggcatgtttattgacgcttttacggattgccgcacgctacaactatttatttgaattagagaaagaatatggattaaatttacgtccattattttcttttgcccatcaaacctatcagaagaatccagtatttacccctaaaaacaggaaagatctatctgaaagagagcaagaagaattagaaaagatccatcaagcactttctatcctccaattcaaatcagaacatcagttgttgaatcgacgacctgaatttaaaatggacgatcgtaaattgttggaaaaaatcaactatgaggaatcaacgatcgttttagaaggtcagctctatgagttgaaagggacttgttttcaaacgatccagccagatgatcctaaaaaattcttggaagaggaacaaaaagtgatcgatagtttgatgtattcattccagcactcgttaagaatgcaaaaacacatgacgtttttgatcgaaaaagggggaatgtatctcacgaacaatcagcatgtactgttccatggctgtatacctgtagatgaaaaggggcagctcttagcatttgaattagaccaatcttatcgcggaaaagaactgctgggattttttgaaaaacagataactgaaagcgcaaaagatttgactgcaaatgaagatttggcgaccgatttgatttggtatgcgtggagcgggccattttcgcctttattcggcaagagtaaaatggcaacttttgagcgctattttctcacagagcctcatacgcacgtcgaaaaaagcaatccctattatcacttgcgagatgaagagtggttcagtgaaaaaattttggcagaattcgatgcaaaagaagaaggttcagcaatcatcaatggacacacgccagtaaaagtaaaaaaaggagagtcaccgatcaaagcaaacggaaaagcatttgttattgacggaggtctatccaaagcttatcaaaaaacaaccgggattgctggctactcattactatgcaattcttacggtttccaaatcgtgacacattatccgttcttgcctattgaacaacaatttgcaaaaaaatctgatcaaacgaatgtaaaaaaagtgatcgagcagcagctcccacgcaaacttaatcggaatacgacaaaaggaatggaattacagcaacagattactcaactccaaaggctgttggattatcgaaaggacgattga

SEQ ID NO: 1465 - DNA (genomic), 1413 bp, Enterococcus faecium; double-stranded, circular
  misc_feature (B) LOCATION 1...1413
  hypothetical: NO
  anti-sense: NO
accacagaaaaaagaaaaagggagatacttatggcagaaacaattgtcaaaactggacaaacggttcctttgaaaatcaagcgtttaggcataaatggtgaaggaatcggttatttcaaacggttgatcatatttgttccatatgcactaccaaaagaagaagtactagtgaaaatcacgaaagcaactcctcgctatgcagaaggagaattaataaaagtcaaaaaaacaagcaaagatcgcgtagtggcaccatgtcctgtttactatgaatgcggtggctgtcaattacaacacttagcttatcaagctcaattggattttaaaaaggatctgcttttgcaagcattggaaaaattcaaaccagcaggctttcgatcttatcaacttttgccgacgatcgggatggatgagccttggcattatagaaacaaagcacaatttcagttacgaaaaaataagcagactcaaaaaattgaagctggtttatacgaagcaaactctcatcagttagtccctataacagactgcttggttcaagaacctcgaacacaaaaagtaatgaatactgttgttcaactattgaataaatttgatgcacccatctatgatgaacggacaaacagtggaatcttccgcacaatcatggttagaatcggtgttaaaactggggagttacaagttgtttttattactcgcagtaaaaaattcccgcaaaaaaacgcaatgatccgtgagatcaatgaacgactgcccgaagttgtttcaatcatgcaaaatgtccaggcacaaaaaacgtctctcgtgatgggggatgaaacgatccacttatggggaaaagaagccattgaagaacaaatcaatgaagtgactttcgatctttctcctcgtgccttctttcaactcaatcctcagcagaccgaattgctttatggcgaaggaatcaaagcattagatgtccagcctaatgaaacgatcgtggatgcttattgcggagttgggacgatcggcttaagtgtagcaaaacaagccaaagaagtacggggaatggataccgttcctcaagcaatcgctgatgcaaaaaaaaatgcggaaagattaggatatcacaacactcgatatgaagtcgggacagcagagcaagttctgcctaaatggttgaatgaaggttttcagcctgatggtatcatcgtagatccaccacgtacgggtttggataacgcattgatccaatcattattgaaataccctccaaaaaaacttgtttatatctcctgtaatgtttctacacttgccagagatctggttaatttaagtaaaaagttcaagattgaatatttacagtccgtcgacatgtttcctcagactgcacgttgtgaagttgtcgtgaagatgacgagactcgctgactaa

SEQ ID NO: 1466 - DNA (genomic), 198 bp, Enterococcus faecium; double-stranded, circular
  misc_feature (B) LOCATION 1...198
  hypothetical: NO
  anti-sense: NO
ggaacagaaaaaggtgcttattcaacgatcattggattttcttgcccccttatgttgcttagtcctgacactgttcgcattttggttagtatggggaggctaaaatggcattttatttaccctatctactcatttttgttagtatttcaggaagtatttggctcatctataaaatttttcaaacaagatattcattaa

SEQ ID NO: 1467 - DNA (genomic), 255 bp, Enterococcus faecium; double-stranded, circular
  misc_feature (B) LOCATION 1...255
  hypothetical: NO
  anti-sense: NO
atagcagaaaattctttttttacgctgattttatttgccagaaaatcacagatataccctgctagcacgccaccaatcattccgccaagaaaacctgaaccacctgtagaggccagtaatccggcaacaattcctggggcaaaacctgcttttccagcaatcgatgtagcaatccccgcgcctaacgcaggaaccatcatggcaaacgctgtatctcctccgatccttgaaaatgcagctgctaacacattatag

SEQ ID NO: 1468 - DNA (genomic), 960 bp, Enterococcus faecium; double-stranded, circular
  misc_feature (B) LOCATION 1...960
  hypothetical: NO
  anti-sense: NO
aataaagaaaatgtgaggaaatttgttatgatgaagacactttataataatcctatcgttcggcaacgggcagatccttgggtatataaacatacagatggttattattattttacaggatcggttccaggctaccaagtgattgaattaagaagggcaaagtcactgaatgaattagaacatgctgcaagcctgattgtatggcaggctcatgaagaaggaccgatgagtgaattgatctgggcacctgaagtccattatatcaatggaaaatggtatatttactttgctgcaagcaatcataaaactatacgtgatgaatctcatcatcaccgcatgttcgtacttgaaaatcagcatatagatccaatgaatacagattggatagaaaagggacaaataaaaacgaaaagggaaactttcagtttagacggaacaactttctcttctcaaggaaagctatattatgtgtgggcccaacaagatcctgaaattactgggaattctaatctttatctatccgaaatggataatccttggacgttaaaggggaagcagatcctcctttctatacctgagtatgaatgggaaaaacggggtttttcagtaaatgaaggtccagcagtccttactcgcaatgggaaaatattcattacgtattctggtagtgcaacagatgaaaactatgccatgggcctgctgtgggctgatgagcacaagaatcttttattaaaagaatcatggcataaattatcggagccagtattcgtttcttctgaaaaaaataagcaatttggtcctggtcacaactcgtttacggtttcagaagacgggtgctttgatattttgatctatcatgctcgaccagagaagaaccaaaaaggggatccgttagacaatcctaatcggcacgcgaaagcgcaatgctttaagtggaatgagcaaggatttccaaaatna

SEQ ID NO: 1469 - DNA (genomic), 1002 bp, Enterococcus faecium; double-stranded, circular
  misc_feature (B) LOCATION 1...1002
  hypothetical: NO
  anti-sense: NO
ataaaagaaaaggaattgaaaactaaaatgtgcagaataagtataatagttccagtttataatgttgaaaaatatttaaaaaagtgtgtcgattcaattctaggccaaacatttaccgattttgaattattattaattgatgatggttctacagataattcaggaagtatatgcgatgaacttgcgaaaacagacaaccgaataaaagtgatacataaggaaaatgggggtctaagtgatgccagaaatattggtattgaggtagcaaagggagattttattgggtttatagatagtgatgattacattgatgaagatatgtatgcatttttatataacaatatattgaaatatgatgcagagttatcaatgtgtggtatttatgacgtccataagaataaagaaattaaaaagttaactcctttttctcaattggttactaaatctgaagcaattgaattagtattagatggtaagctagttgttgctaatgcagtaagcaagctatataaaaaagaattatttgagaatgtgagatatccaaaaggaaaaattgctgaagacgcagcagtaatactgaaaattatcaatcagtgtaataaaatccatgttgatacttctcaaaaatattattattatcatcgtggagatagtattactagtaaaaaatttacaaaaaaagattttgatataattgatgtatggaatgagaatgaaaaatggattattaaaaattatcctcaaatgtacgataaagtacatactagagtttgttgggcttactttgttgtgttagataaattagttttaactgaagaaaaaggactgtatcaagaaaaaaaacaagtaagagagtatttaattgataatttcttttttattataaaaaataaacgattaacttttcaaagaaaaatatctatgttattgcttacttttggaattgctgcgtataaaataccggttaaatatcagtataagaaagtaaaggctgttaattaa

SEQ ID NO: 1470 - DNA (genomic), 246 bp, Enterococcus faecium; double-stranded, circular
  misc_feature (B) LOCATION 1...246
  hypothetical: NO
  anti-sense: NO
acgaaagaaaagggagaaatgatggaaatacgaagggcagtaaaagaagatctccctcaaatcaatcagctgattactgatcatccagaatcattcgtaaaagtaaaaacggcagctgaactacatgataggaataaactattgattgttgctgtaacaaaagaaaaccggatcatcggttttgcgcaagcagatgaacagcaatcagaagaacgggtggatcagcgaccagcaggattttcacca

SEQ ID NO: 1471 - DNA (genomic), 312 bp, Enterococcus faecium; double-stranded, circular
  misc_feature (B) LOCATION 1...312
  hypothetical: NO
  anti-sense: NO
gaggaagaaaaaatgaaaaatcggttaattgtcgcatgtggaagtggagtagcaacgagtcagacaatcgctagtaagatccaaagtatgttagaagatgacggcatcgcatttcctgtagaagcagttgattacaaatcgattcaaaatgagcttctaactgctggaatctatgtgtatgtcgcacaacctgatgaggaagtacttgaacaagcaaaagatttgggtattgaagtatttccaggaattccatttttaactggaatgggtgtagaacctatttatgacagtatcaaagagttagtacagtaa

SEQ ID NO: 1472 - DNA (genomic), 222 bp, Enterococcus faecium; double-stranded, circular
  misc_feature (B) LOCATION 1...222
  hypothetical: NO
  anti-sense: NO
gaggaagaaaaaatgaaacaacaattttcaatcgaaggtatgagctgcaatcattgtgctgcaagagtcgaagaagcggtaagcgcacttgacggcgtacagaaagtaaaagtgaacttgaaaaaagcaaacggtacagtcaagtttgatgaaacaaaagtccaatccgaaaagatctgtcaagcaatcaatggattgggatataaagcagtggtgatttga

SEQ ID NO: 1473 - DNA (genomic), 207 bp, Enterococcus faecium; double-stranded, circular
  misc_feature (B) LOCATION 1...207
  hypothetical: NO
  anti-sense: NO
atcagagaaaataggatacctacgacgccacccactaaaatagcgatccatggtgtcatagaaccaagtgatggactcatcgtcaagttgaaaacgatggaactaaaagcacccatgaccatgattccctctagccctacgtttacgatcccgcttcgttcagaaaaagttccgcctagtgacgttagaattagcggtgttgaataa

SEQ ID NO: 1474 - DNA (genomic), 453 bp, Enterococcus faecium; double-stranded, circular
  misc_feature (B) LOCATION 1...453
  hypothetical: NO
  anti-sense: NO
aaaggagaaaaaaatatggctcaaaattactatgacgaatttgtcaaattacctttggataaaatggcacaaaaaatggaggatatgacgttcctatacaacgaaacacgtgttccaaaaaaacattataaagaaaaattgtcggtagctgtggaagaaatgattgaatcaggtgtcgaaatgaatcttattgcgacgtactatcgaacactggaagaactgaaaaagcaaaatgcaaaatggtttttccaagccttactatgcttggaaataggtgtcaaaccaagcactattaaaccttctgaataccaggctttagaactaacgtatgcgaaatttatcgaaacgaaaaaagccaagactgtttcaagtgaatggttagattattttgaaaatatcaataagtatggcgcatattacaccatgaaaaaggaagacaacgaaaatgaataa

SEQ ID NO: 1475 - DNA (genomic), 486 bp, Enterococcus faecium; double-stranded, circular
  misc_feature (B) LOCATION 1...486
  hypothetical: NO
  anti-sense: NO
aaaggagaaaactttatgtctatttataattttgaaactactttagaagacggcactgtctattcattgaaaaaatatgcaggcaaaccgataatcattgttaacactgcaacaaaatgcggtctagcacctcaatttaaacaattagaagaactttaccaagcttatcagacacaaggtctggttatcttaggctttccttccaatcaatttaaacaagagctagattcagcgactgaagcagcagaagcttgtaaaaccacttatggcgttaccttccctatgcatcaattgattgacgtaaatggagaaaatacagatcctctttttacttatcttaaaaatgaagctcctggtactgtcactaaagcaataaaatggaattttactaaatttttgattgatagaaatggcaaagtaatcgaacgatttgcaccacaaacttctccattgaaaatgaccgctgcaattgaatccgttctttaa

SEQ ID NO: 1476 - DNA (genomic), 345 bp, Enterococcus faecium; double-stranded, circular
  misc_feature (B) LOCATION 1...345
  hypothetical: NO
  anti-sense: NO
catatggaaaaagaactttccactctagatcaatatttgattgatcctgattggggcaagccgaaaattgaggaaacaagtggtcgaaaaatcagacgaaatcttttgacgaatgaagaactagcttgggatcaagatgatttaggcaaccatgtaactatttgggatcatgtttatcttatccatctatcgaagcattcgaataaacctgaatatatttacgtcatcgaagatggcttgattgatgcgctagaagagtacgacagagataacttgattgatatctcttattacggaccaggtaagaaatacattgctgaaatggaggcagaatttgatgagtga

SEQ ID NO: 1477 - DNA (genomic), 921 bp, Enterococcus faecium; double-stranded, circular
  misc_feature (B) LOCATION 1...921
  hypothetical: NO
  anti-sense: NO
aatatggaaaaagtattagtgatcgtcggtccgacagcagtcggtaaaacagcgctaagtgtggaactcgcacaactatttggaggagagatcatcagtggtgattcattgcaaatctataaaaatctggatatcggtacagcaaaaatcaaagaagaagagatgaataatgttccgcatcatttgattgatgtgatcgaacctactcaacgttactcagccgctgattttcagcattcaggtcgacaattgattaccgagattgcgaaccgagggcacctacctatcatagctggtggtacgggtctctatatccaatcccttctatatgattatcagttaggagcgacagaagaagcgaatcctgagattagaaaaaagtatgaaacgttagctgaaacaattggttcccaagcattatggaatcagttgaaagaaaaagacccggcagctgctgagaaaatccactggaacaatcaacgcaaagtgataagagctctggaagttttagagacgacaggacatagtatcacggcacctaaagaagagccaaagcaattgtatgattacctcatgattggattagatacgaagcgtagtattctttatgaacgaatcaatcaaagagtcgatttgatgctagcagaaggtttagtagcagaagcgcgtaaggtgtatgagcttggagaagtccaggccagtcaaggtattggatataaagaatttttcccttattttgaagggaaagaaacattggaagaagcaacagaacaagtcaaactacattcgagaagatacgcgaaacgtcagttgacgtggtttcgtaaccgtttggatgcacagtggtttgatcttataagtgagccaaatcaaaaaagtcagattgagcaaacaatcaaaaaatggctggaggcggaataa

SEQ ID NO: 1478 - DNA (genomic), 1074 bp, Enterococcus faecium; double-stranded, circular
  misc_feature (B) LOCATION 1...1074
  hypothetical: NO
  anti-sense: NO
ataatggaaaaagccaaagattatttcattaattttgtgttatttctgatatatttcgtcattgtcttttttgctcttgtattcaacaattctttagggtggttcttattggctttttttactctttatgtatcatggagtgtgttttcattaagcacctttctaaagaaactttctgttacttgcacagtccagccagtcgtttatcgtaaaaaaagtatacaggttattttttctatagccaaaaaaggagctttttctttccctctccctcgtttacagatcgtctttccagagatctttgcagaaaaaaaacaagaaatattgatccttacaaataaaccgcaagaagtccaagtactttggcaaccaaaagagagagggttccatgaagcattaaccgtcatttttacagcctatgatagtctaggactttttagaaaaaggacaagaagagagctttcttttcctgtgactgttcttcctgcttttcataaaactcaagcagaaacattgcaaagagttctggaaaaaaaacaacagctgaacgcgtatcaaaaaggtcttgattttcgagaacatcgctcttatcgccccggcgattcttttaaccgaatcgattggaaattgtctgctcatagtcaagagtggttataccgcgaatacgagtatcaagaagaatattctccgcttctttgcttttggggttcacctagcttgaaatttgaccatctgctagatttgtatttttctttatggcatctgagaaaagaaaagcagccggaacttctgatattaggcgaccgtacctttcatggcaaagatcctggatatacctattttgcttctttgaacgctggcgatgagaaaacttttttggcacacttgaaaaaacaggcaaaaaaacaaatcgtcctctttattcctgagcattctcctgaagtctcagaagctgtcgaaacattgtcgaaagatcgaacggtctatcttgtttatttcgcagaaaaacaaatcatgatacaagaaaaagacaaggtatgttcactgtcaggaggtgaatggattgacgattaa

SEQ ID NO: 1479 - DNA (genomic), 912 bp, Enterococcus faecium; double-stranded, circular
  misc_feature (B) LOCATION 1...912
  hypothetical: NO
  anti-sense: NO
agaatggaaaagctgctagttttttataacaaaagttcagggaaagatgagggtgagaaattagcacgctggtttcaagattatgtaaaagaaaagcagccagaattatatgtagaactagctgaaactggcccatcgattgatgatgcggaattagtcaagaaagcagaagccatagaagctgatactttagtaattataggtggagacggcacgattcatcatatcgtccaagcgttccaaaaaacattatctcaataccatgtcggattacttccaggtggaactgtcaacaaccttgcacgtgttcttgagattcccctcaaaaaagaagaagctgctgacgtgatcctggaaggcaatgtacggaaaatagactatggtcaagtcaatgatgaagtcattatctctacactgacaatcggaatcttagcagatacagcagtttggatcagtcaagaagaaaaacagcgttacggctcgtggatctttatcaagaagttttttaagttattgctgaagaagaaaaaatatcatttggatttagaaacagacgaggagcattggaaaggaaaatcccaactgttgacagtcacgatgtctaactccgtgggcggttttacaaattttgacgactcagcgaccctagatgatggaaaatttcatgtaacgatcgtaccttccttagatattttccgatttattttttatttgcctagaatcatgagaggcaaattctatacgatccccggcattacttatttcacagccaaacgcatgaaaatccaagcgcaggaaaaatctgtgggcactcgaacggatggagacacgacagatgatcttccagttgaattatctgttgtatcaaaaggattaacagtttattcaccaaagaaagaagaaaaagcttag

SEQ ID NO: 1480 - DNA (genomic), 2022 bp, Enterococcus faecium; double-stranded, circular
  misc_feature (B) LOCATION 1...2022
  hypothetical: NO
  anti-sense: NO
aagatggaaaacattgcaagaaaagaacggagacgtttagaacagaccaaacgttttcgaaaagcaaaacgaggggcagcaatcgtgggaactgcgatggtaggctgttctgtcgctgccccattagtacagccggttcctgttcaagcggatgaaacacctgttcagttcagcgcaagaatcaatacagcggcatttatcacagaaattgctacttatgctcaaccaatcgctcaagccaacgatctatatgcatcagtgatgatcgcacaagcagttgtagaaagcggttggggcagtagtgcgttatctcaagcaccttattataatctttttgggataaaaggcagctatcaaggacaaaccgtctacatggatacgcttgaatttttaaataatcaatgggtaaataaaaaggagcctttccgacaatatccttcttttgctgaatctttcaatgacaatgcctatgtacttagaaatacttcatttggcaacggttattactatgccggtacttggaagagcaacacgaaatcctatacagatgcgacagcttgtttgacagggcgttatgcgactgatcctggttacgcaggcaaattaaataatatcatcgcaacttacggattgacccaatatgatacaccagctagcggaaacgcaggcggtggagcgactacaggtggcaataatactggaagtgcaggtagtactggcggttcaagcaattctggtaatacaaactcaggttcagcaacttcgaccacttatactgtccaatctggtgattctgtttggggaatctcaaataaattcggtatcacaatggatcaattgatccaatggaacaacatccaaaacaatttcatttatccaggacaaaaactgacaatcaaaggtagccaggaaaatggctcttcgacgaataattccggtaacaataccaattcttcaggaaatgctggtacatcaaacggaggacaaacaactggtgcgaaatacactgttcaatctggtgattctgtttggaagatctcaaatgatcacggaattacgatggctcaattgattgaatggaacaatatcaagaacaatttcgtttatccaggacaacagctaatcgtatcaaatggcggttcttctaatgctggagcaaatactggctcaaatactgggaatacaagtggctctagttcgtccagctcaagttcttctaatacagcttcaggaacgaaatatacagttaaagccggagactctgtttggagcgtctcaaataaatacggaattacgatggctcagctaatccaatggaacaatatccaaaataactttatctacccaggacaacaactgactgtttcaaacagtggatcaacaaacagcacgtcaggtaatacaggttcgtcaaccaatacaaataacagcagttcagttaatactggcagcagttcgtctcaaggcacttataccgtgaaagcaggtgaatctgtttggagcgtggcaaataaaaacggcatcacgatggatcagttaatcgaatggaataatatcaaaaacaacttcatttatccaggacagcaattgatcgttaaaggtggaacttcggcaaatacaaatacaggttcaactacttctgcagcgaaaccaaatacaccgaatacgtctgctacgacaagtacatcatccactggtaatacgatgtataccgtgaaagcgggcgagtcagtttggagcgtagcgaacaaacatcatatcacgatggatcagttaatcgaatggaataatatcaaaaataatttcatctatccaggacagcaagtgattgtgaagaaaggttcatctcaatcaacaaaccaacaatcagttactggttcgaaaacctatactgtgaaatctggagaatctgtttggagtgttgctgacagtcatggaattacaatggctcaactaatcgaatggaacaatattaagaacaactttatttatccaggtcaaacgttgattgtagctaaataa

SEQ ID NO: 1481 - DNA (genomic), 1311 bp, Enterococcus faecium; double-stranded, circular
  misc_feature (B) LOCATION 1...1311
  hypothetical: NO
  anti-sense: NO
tggatggaaaaggagcggataaaaatgaacatcagaaagttaattgctggagtcgtttgtttagcggcagcatcaggtttcttaacaggatgcggaagtgctagtagtacagcagacaaagaagaaaaagtcactgtctgggcgtgggatgagacattcaatatcaaagcagtgaatgaagcaaaaaaagtttatgagaacgaagaaacagagatagaagttgttacgatgtctcaggatgatatcgttcagaaactgaacaccgctttagcgagcgggaatacagaaggattgcccaatatcgtcttgattgaagattataggatacaaggctatttgacttcttatccagatgcattcgctaatttgtctgctattgtaaaggaagatcattttgcaccgtataaatttgcggtaaacaaagtaggagataaaatatacggtgttcctttcgattcgggcgtaacagcaaacttctatcgtacggatctgatggcagaagcaggttatacagaagaggatatggagaatctgaagtgggacgagtatattcaagtagcgcgagatgtcaaagaaaagacgggaaagaaaatcgctgaagtcaatccttctgaccttggtcgagtaaggatgattatgcaacaggcaggagaatggtatacatctgaagatggggagacagtcacgatccaagacaatgcatctttaaagtatggtcttgaattgtttgccactcttttgaaagaagatctagtcgaacaaacctctgactggaatgctggagtaactgcgatacaatcaggagcagtagcttctagcccaactggcgcttggtattcttcaacgatccaaggagcagaaaaccaatgtggaaaatggaagattgcaccaatacctgcacttccagaaaatctgcaaaaagcgcaagcttctaacattggcggcgctggctggtatgtgatcaaaggagtagctggagaagattcagcgaaagatttcctagaagcaacgtttgcttcgaatgaagaactgatgggcactcttgcgaaagaaatcggactagtatctacgatgcttagcgcgaatgaacaagaagcttatcaagaagcttctgaattttacagtggtcaaaagatctttgacgatttttcaacatggacatctgaaataccagaagtgaattacggacatgagacctatgcaattgaagcagtcgtagctgaagctcttcatcgaatcatcaatggagaagagacagacaaggtactagcagatacacaaaaacaagtagaagcacaattggctaattga

SEQ ID NO: 1482 - DNA (genomic), 591 bp, Enterococcus faecium; double-stranded, circular
  misc_feature (B) LOCATION 1...591
  hypothetical: NO
  anti-sense: NO
tgtacggaaaaaggtgagcgtctgatgttgcaaactgctttgcatttcagccatacattactgcaagaaatcttgcaaccaggggatcacgtcgtagatgcaacgatgggcaatggccacgatacggtttttctagcagaacacatcggaaaaactggtcatgtctatagttttgatatccagcaacaagcaatcgatgctactcgtgaaaggctagaacagcgtcagttagaagaacgtgtctcattgtttctacaaggccacgaaacgttaggagaagtgatagctgaacaacaaaatctcaaagcagggattttcaatctagggtatctcccaaaaagtgataaagcaatcatcactatgccagagactacacgcacagctatggaagaaatattgaaacgacttgtgcctcgcggacgattgatccttgtcgtctactatggtcatgaaggtggagaaaaagaactggatatggttgattctttttgttccaaactgccacaggaaacatataatgtgctgaattatcggtttatcaaccaaaagaaccagccgcctattttatattgtattgagaaaaaaagataa

SEQ ID NO: 1483 - DNA (genomic), 186 bp, Enterococcus faecium; double-stranded, circular
  misc_feature (B) LOCATION 1...186
  hypothetical: NO
  anti-sense: NO
aaagcggaaaaccagttccaaaattttatatggcttgtggggaatctgattttctttatcaggcaaatcaggaaatggtatctgctatgcaggaacaaggcttggcggtcacctttgaacaaggacctggcgatcataactggatcttctgggaccaatggattcaacgtgcattggcgtggctaa

SEQ ID NO: 1484 - DNA (genomic), 579 bp, Enterococcus faecium; double-stranded, circular
  misc_feature (B) LOCATION 1...579
  hypothetical: NO
  anti-sense: NO
aagaaggaaaaaatcagtatggaagcagagacaccttttcaaaaagtagaaacattccacaaaacttttgatccaagaagaccagagatacccacggcttttacagaaaatgaagctcatacacgtgctgcgttcaaaatagaagaacttgttgaatttgttgcagctacttcacctaataaagaacaactgcatgaagctgttatgctgctgcacgaagcattagataaagcagaagaaaaaatacttggtaaaacacagtggggaagtgatccgctggttgaacaagtagatgcactgacagatatcctttactttacttatggttctttttcattactaggaatagtgcctgatcgaatattcgaaatcgtccatcaggcaaatatggggaaattatttccagatggaaaacctcattatgaccctgtaacaaataaagtgttgaaacctgaaaactggcagatggaatatgctccagaacctaaaatcgcggcagaaatccaacgtcagattcaagaagcgattgctaagaagaaatccgctgatataggcatgtgcacaaatgaaaaagagtga

SEQ ID NO: 1485 - DNA (genomic), 330 bp, Enterococcus faecium; double-stranded, circular
  misc_feature (B) LOCATION 1...330
  hypothetical: NO
  anti-sense: NO
aaagaggaaaagaagatggaattgaaatttgtcgtgccagatatggctgaaacctttggaaagttaagttatgccggagaaggcgaagttttaacagaaggatatggacggaatactacggtgattggtcgcagttatcatttgtattccagtaagcaacgggccgatgatattgaggtggtagtagctgcggaagccggtgaaaaggattttgatcaagaccaaccgctaaaagccgtgaatccccatttggttgccaaaggctatgagattgagaatcgtgggtttactgattacgtgttgtatgttgatgatttagtgaaagcatag

SEQ ID NO: 1486 - DNA (genomic), 2145 bp, Enterococcus faecium; double-stranded, circular
  misc_feature (B) LOCATION 1...2145
  hypothetical: NO
  anti-sense: NO
atggaggaaaagaaaatgaaacgttttgtgcgaatgggaattgatgttggcggtacacatacgaaagcagtcgcaatcgataatgcgacgcacgaaatcatcggaaaatcttcagtgaaaacaacccacgatgatgtccgtggagtagccgcaggtgtcgttcagtcttttcaaaattgtttgcgggaaaataatatcagtccagaagatgttgtgtttgttgcacattctaccacacaagcgactaatgcactgattgaaggagacgtagcaaaagtcggcgtaatcgggatggcaaaaggtggattagaaggttttttagcaaaacgacaaactagattgaacgatatcgatttagggaataagaaaaaaatagagattgtcaatgcattcttacctgtcaaacacttaaatgtagaccgtgtttcagaaacgatttcttctttagaaagagaaagagcggaggtcttggtttcttctatggcatttggagtagataatggggaaccagaacgagttgtttatgaagcagcatcggtaaaatcgatccctacaacgatggcttctgacatcacaaaattatatggattgacaagaagaactcggacagcagcaatcaatgcatctattttaccaaaaatgctagatacggcaacctctacagaagattccgtacgagaagcaggggtcaatgtttctttgatgattatgcgcggagacggcggagtaatggaaatcaatgaaatgaaaaaacgacctgttttaaccatgctttccggtccagcagcatcagtcatgggctctttgatgtacttgagagcgtctaatggtgtttattttgaagtaggcggaacaacaaccaatatcggggtcattaaaaatggacgtccagcaatcgattattcaattgtaggtggccacccaacatatatctcttcattagatgttcgggttctaggtgtggcaggcggttcgatggtacgggctaatcagtcaggaatcatcgatgtcggtccacgttctgcacatattgccggtctagattatgcagtatttacggagacagaaaaaatcaaaggtcctaaggttgaatttttctctcctaaagaaggagaccctgctgattacgtcaaggtagtgatggaagacggagaagaagtgactattacaaatacatgtgcagccaatgtccttggattagtgcaagaagaacatttttcttatggaaatgtcccatctgcacgaaaagccatccaagcattagctgattattgtcatacgacggttgaagacatcgcagaacagatcatggaaaaatcctatgctaagattgaaccggtgattttagaattggcagacaagtatcacttggagaaagatcagatttctcttgtaggtgtagggggcggcgctgcctcattgattacttactttagtaataaaatgggtgtgaaatattcgattcctgaaaacgccgaagtgatttcttctattggtgtagcacttgcaatggtccgagatgttgtagaacgtatcatcccttcgccaagtaaagaagatatacgatcgttgaaaaatgaagcgatgaataaagcgattgaatcaggcgctacaccagaatcgatcgaagtccacgtagaaatcgatccacagacttcaaaagtaacggctatcgctactggttctacggaagtgaaagcaaccgatctaaccaaggagatcacaacagaagaagcactagagcttgctgcagaggatatgcgattaaataaaaatgaagtttgcttattggaaaatacacctttcttttatgtatgcggcgaacagaatcgttcaaaaaatgctggaagtcttcggatcatcgatcaaaaaggatttatcaaggtccaacgtggacatgcttcatgtatgaaaacaactgcagccaattatatgacagctgtcgaacaactttgggaagatatggcagtttatcaaactgaattgattgcccgaccagaattttatctctgcttaggagcaagagtctctgattttacagcgacggatctggaacaactacagcttttgatggatctggaagtatctactatggaaccggaggaagaagtgatcgtcgttgccggaaatatcaaacaaacataa

SEQ ID NO: 1487 - DNA (genomic), 2379 bp, Enterococcus faecium; double-stranded, circular
  misc_feature (B) LOCATION 1...2379
  hypothetical: NO
  anti-sense: NO
gaatgggaaaatgtgaaaaataaacgatacttgatgctgcaatggataaaggaacatagtctgattttaaaactgatttttttcggctccgtgttagtctttgtggcaaatcaagtcgcaaatattgctaatggcatgagttggcaagatatttggcaaaggatgggacaacaaagccgcatgacgatcctgctcatgattctggctggactgctgggtgtcactccgatgttgttgtatgattgggtgacgatcagagtcttagaaaaacaaggaaaaccaaaaatggaaagaaaagagtttcttcttgctgcgtgggtaacaaacacgatcaacaatctcgccggttttggtggtgtggtaggagcaagtctgcgggctagtttttatggaaagcagacaaatagaaaaatggttttagccactgtatcaaaagtcgcactatttatgctgactggtttgtctgtatggtcgtttcttacatttattgatgtcttttttattcagtcagaaagtatttttcgaagctattggatctggcttttcggcggtagttttttagcaccagtcattttcttttttgcttatctaaagagaaagacattgttcttcgagttttatccaaaaggcttgcttggtctgctactggcatcctttggacaatggacgggagcccttgcggtatttttgatcatcggcaagttgatgagaatagatatttcgatgctttcgatctatcctatgttcatgattgctacattgataggaatgctgacgatggtcccaggtggaatggggacttttgacgttttgatgatcttaggaatgagtcaattgtctgttcggcaagatgtagcagtagtttggctattatattatcggttgttttattatgttctaccttttatgacgggacttctattgttcatcacacatacaggagtcaaaatcaatcgatttttagataacattccgcgactgtttttccaaaaggttgcgcatatcgtgctcgtaagtgctgtctattttgcggggatcatgatggtacttctatcaacaatcactaatctgtctgcaatcagtcggctatttcaagtattattgccgttctcattcaattttttagatcagacagtgaatctattggttggctttttattactcggccttgctagagcactttcagtaaaagtcaaaaaggcatttctgcctacgattgctttactatcttttggtattttaaatacaatcacacgtacgttatcttggcagttgatattggtatatgtcttgattctgttagctgtgtggttatccagaacagaattttatcgaacaaaattcgtttattcttggggagctataatctttgatgctagcttgttcggctttttgtttatcgtttacgcaattgcaggctatcacagcggacgctttttagtcggtcgaataacaggaaatcattttattttgtttccttcagatgatgtgtggttctcagggcttattggtttgggcatctcattgctagctttagtggcgctttatcaatatttagctgaagatactacgaagcttggcagtgagtacgaaaaagaccgttttgaccgtttattggaaacatacggaggcacagctacaagccatcagcttcgcttgtcaggttacagttatttttattaccaagaagacgaccaagatcaagtcgtttttggttatcagatcaaaggaaacaaatgctttgttttaggagatccagttggcaatcctaaaatgatgcgggcagcaacgaatcagtttatgaaacaagcagattgtttaggctatcagcttgcgttttataagatatcagaaagctacgtagtgatgcttcatgaattgggttttcacttcacgaaagtaggtgaagcagggattgttgatctagcaacagaagacttgtctcggctgagtcagcaacttgaatatcaacgtttgatgaaagaaggataccattttacttggtacgatcaactgccggaagaattacatcaagctgtaaatgaagtttcacaaaaatggcttcaaggtgcacgagaaaaatacttctctgtgggacgatttgataaatcatatgtattatctagcggtgtcggtattgtccgtaaagatcaaaaagtcgttggcttcatcaccgctcagccgatgacgaagaagcaggcgggatatgatttgttgcgggtcttacctaaagaatctgaggaattagctgactatctgttagccaatctgtttattgtatacgagaaaatgggctactcggaagccaatctaggcttagctccattagctaatgttggagaaacagattttctttctttcgagcaaaggtcatgcatt

SEQ ID NO: 1488 - DNA (genomic), 741 bp, Enterococcus faecium; double-stranded, circular
  misc_feature (B) LOCATION 1...741
  hypothetical: NO
  anti-sense: NO
accagggaaaatcagtttgacttatacgcacaacgatcgaatgatctttggtggagtgaccctactgaaaaagaattagaaatcacattagacaaagaactaggtgttgattacttcttagagcgtcgtgaactaggtgtgatcaatatcggtggaccaggattcatcgagatcgatgggcaaaaagaagaaatgaaaaaacaagacggatactatatcggaaaagaaacacgacatgttgtattttcttctcaagatgctgaaaacccagctaaattctatattagttctgttccagctcatcataaatatccaaatgtaaaaatcagtatcgaccaagtaaaaccaatggagactggtgaaggcctgacactgaatgaacgtaaaatctaccaatacatccatccaaatgtatgcgaaagctgtcaattacaaatgggttatacgattttagaaccaggaagcgcttggaatacgatgccttgtcatacacatgaacgtcgtatggaagcttatgtgtactttgattatgccaatgaagatacacgtgtgttccacatgatgggcaaaccagatgaaacaaaacatttagttgtagacaatgaacaagccattatttcgccaagctggtcgatccattcaggtgtaggtacaagcaattactcattcatctgggcaatgtgcggagaaaatatcacctatacagacatggatatggtgcaaatggatcaattaaaataa

SEQ ID NO: 1489 - DNA (genomic), 834 bp, Enterococcus faecium; double-stranded, circular
  misc_feature (B) LOCATION 1...834
  hypothetical: NO
  anti-sense: NO
gggagggaaaaaattatgttgatgcacgcaaccatggccgcgttagccgtctttatctgtttcgcaggtaattacctaacaggccaaagtatgatggaacgcccgctagtcgtcggtctagtgaccgggatcttgatgggcgatatgaaaaccgggatcctgatgggggcctccctagaagcgatcttcttaggaaacgtcaatatcggcggtgttatcgctgccgaaccagtaactgctacgacgatggcaacgacctttgcaattatttccaatgttgaaaccaaagctgccatgaccttggccgtgccgatcggtatgttagctgccgttgttgttatgttcttgaaaaacgtctttatgaatatcttcgcaccttctttggataaagctgcccgtgaaggcaatgaaaaaatggtggttgccctccattatgggacttgggtgatctattacgtgatcatcgcttccatctccttcatcggcatcctggccggtagtggcccagtcaacaccttcgttgagaatattccccaaaatctgatgaacggattaagtgctgctgggggcctactacctgctgtcgggttcgcaatgttgatgaagttactttgggataacaaactagctgtcttctatatcttaggttttgttttgacagcttacctaggcttgccagctgtggctgtcgctgtcttaggtgtcgtgatctgtgtcgtaagtgcccaacgggacttgcagatccgggatatcgaaagcggtgcagttgctcattccggcaataatggtgcccctatgacgaaagaagatgaagaggaggatttcttcgcatga

SEQ ID NO: 1490 - DNA (genomic), 1020 bp, Enterococcus faecium; double-stranded, circular
  misc_feature (B) LOCATION 1...1020
  hypothetical: NO
  anti-sense: NO
tgttcgtgttttgctggatgtgaacatcaggaggataatgtaatgaaagtatttgattacgaagatattcaattaattcctaataaatgtatcgtaaatagccgttctgaatgtgatacaacggtcacattaggtaaacatacattcaaaatgccagtagtgcctgccaacatgcagacgattattgatgaaacaatcgcagaattcttagcggaaaatggttatttctatatcatgcatcggtttgatgaagcagctcgaattccgtttatcaaaaaaatgaaaaagcgtggattgattacctcgatcagtgttggcgtcaagaaagaggaatattcctttatagagaagttggcagaagaatcgctaaatcctgattatatcactatcgacatcgcgcatggacatgctaactcagttattgatatgattcagcatattaaaaaatatttgcctgaaacttttgtgattgccggtaatgttggtacaccggaagccgtccgtgaattggaaaatgcgggcgcagatgcaacaaaagtcgggattggtccaggaaaagtatgtattacaaaaatcaagacaggctttgggactggaggctggcaactggcagctcttagatggtgtgcgaaagcagctcgcaagccgatcatcgctgacggtgggatcagaacacatggcgatattgcaaaatctgtccgttttggtgcgacaatggtcatgattggttcattgtttgccggtcacgaggaatctcctggcgaaacaaaagtcgaaaatggaatcgtgtataaagaatactttggttctgcttcagaattccaaaaaggcgaaaaacgaaatgttgaaggaaagaaaatctggatccaacacaaaggatctttgaaagatacactagtggaaatgcaacaagaccttcaatcatctatttcttatgctggaggaagagatctggaagccattcgaaaagttgactatgtcatcgtgaaaaattcgatttttaatggagacacaatctaa

SEQ ID NO: 1491 - DNA (genomic), 261 bp, Enterococcus faecium; double-stranded, circular
  misc_feature (B) LOCATION 1...261
  hypothetical: NO
  anti-sense: NO
tttgatcgaaacaatccaagagacattgcgtatccaaaaagaaggaaaagaaaaacgtcgtcatgcagaagtagagcttggacacatggaagaagatctgaaacaaaaactgttggatttaacccaatagatcacctttcgcttgttactagaacaaacgcccaacaacagtttattacaactgttgatgggcgtttttcttatctttcttctaacttctccattggagtctatttctcattcatcttgctgtgtccatag

SEQ ID NO: 1492 - DNA (genomic), 726 bp, Enterococcus faecium; double-stranded, circular
  misc_feature (B) LOCATION 1...726
  hypothetical: NO
  anti-sense: NO
ttcaaccgaaaataccactataggagcgtaactatgaaagggattatatttgatttcaacggaacaatgtttttggactctcatctgcatgaagctgcttggctgcatatgatacatgatcatacaaaagatggtttatcagacgaggatattttaaaaaatattcatggtcggacgaatacggagattttgaaacatttcatttcagagcatttgaccgcctctgagatcgccgtattgtcagaagaaaaagaaagctattatcgtatgctttgcttgcaaaatgaaaacgagcttcagttgacaaaagggcttgaagcgactcttgaccagctgactgaccaacagattccattaacgattgccacggctactgtcaaagagaatgttgctttttattttgatattttcgatttagcccgctggtttgactgggacaagattgtctatgacgacggctctttccctgggaaaccgcaaccggatatttttcttaaagcggcagacaaactgagcttagctccggctgattgtcttgttatcgaagatgcttactcaggattacttgctgccaaacgtgcggggatcggaacaattattgcaattgatccattcggtaaaaacaaaacagtatttgaacaggcacagctaaataaagatggaaccatcaaagattttactggtttttggacagagcacctgtctgccacatccgttaattcttaa

SEQ ID NO: 1493 - DNA (genomic), 495 bp, Enterococcus faecium; double-stranded, circular
  misc_feature (B) LOCATION 1...495
  hypothetical: NO
  anti-sense: NO
aaaacacgaaaatgctatccttatagaaaagagagacaagaagggagtttgatcatgtcaggaggagaaattgcaggattgatcgcagcaatcgcctttgcgatacttgtcgtttttatcgttcgtgtgttgttgcaagtttctaaaactttagaaaaagtagatcagactgtagcagaagcaaatacgacgatcgaaatcgtcacaaaagacgtagatcttttgtctagacaagtagaaggcttactggtcaaaagtaatgaactgctcttggatatcaatggaaaagtcgcaacgatcgatccattgttcacagcagttgctgatttaagtgaaagtgtatcagaacttaatcattctagtaaaaacatcgcgacgaaagtcggcggaatcggtaaaacgacagctaaagcgacggttgccggaaaagtcggtgggacagcgatgaaattttttaaaaacaaaaaacatactgaaacgacaggaggaaaataa

SEQ ID NO: 1494 - DNA (genomic), 3204 bp, Enterococcus faecium; double-stranded, circular
  misc_feature (B) LOCATION 1...3204
  hypothetical: NO
  anti-sense: NO
aggaaacgaaaaaaggcttcttgcaaaagatgtttgtttagggagggaagaagaatgaaaattagtcaccgtgaggaagcggaagtcgaagaacagttgattcgtgtcctcggggaaggacataatcagtggacgtatcgtccggatctaaaatcagaagaagatctttgggtcaatttacgtcaaaaaatcatctcaaataatcaagcagaactgaatgattctcctttgaccgataaagagtttgaaacgatcaaaaccgaattattgctacggacgaaaaccccatttgatgctgcgaaatggttaaaaggtgaaaatgggatggctcggatcacgattgaacgggaaaatccgcaattgggttctgtctcacttatcctttattccaatcaagacattggtggaggaatctctacttatgaagtggtccatcaaattgcaaaacgtggaagtaacatagaagcgcgggatcgacgttttgacgtcaccttattgatcaatggcttaccgattatccaaatcgagttgaaacaagtaaccgcaaaagatggtttttatcaggcgtttaatcaaatcaaaaaatatgctgaagaaggcatgtttcggaacaatatcttttcgaccttacagttgtttgtggtttccaatgaacaaacgactcggtattttgcaaatgccttaccgaaggatttgcatcctaagtttttatttagttggcgaacgaaagataataaaaaggtagaaaacttatatgagttttgcaaacaagtgctaaatatcccagatgcccatcgcttgattgcggattatacgattgtcagtgaagatcaagacaataaaaccctcatggtgttacatccttatcaagtgcatgcgattcaagccttgtttattgccgcaaataaacatcaatcagggtatgtgtggcatgcgactggttcaggaaagacgttgactagttttgtatctactaagcttttagcacgaaaatcggggatcgatcgaacgatcatgttagtggaccgcaaagatttagataatcagaccaccacagagtttacgaaatttgcttcggagtttaatactggggtttcttctggtaatgccaaagcgaatagcttgatcgtgggaacaggaagtgccaaagagttaagtgaaactctgttggcagatgccaatgcgaatgttgtgatcattacaacccgtcaaaaactagatgcggcgttgaaatatgcaaagaaacaggaagagaaaaaaggaaccaatcgcttccaaaaattaatggggcaacatatcgtgtttgtagttgatgagtgtcatcgagcgttaagtgctgaaaatatggaagaaatcaaaaaaatgtttccgaaatccacttggtttggctttacaggtacaccgattttccctgagaatcggaaacaagccaaagggcaattggcacgtacgacccatgatcagtatggagaggtcttgcacacctataccatcaagaatgcattagaagatggctcggttttaggatttcaagtagagcatgaaaacaccgtggagccgacttcattagagaataaaatctatcggaaattaaaagaagtagaaacatatgcagagtattcaccggaacagatcaatcgtatgatcgatcaaatggagtctgtcaaaaaagaaagttatttggaccctactgtttttgaagcagaggaacatatccaaaaagtcattcataaaatgttccgtccagacaatgcctatacaaaatttgattttcgaaatggccgtccaacgaaatctgcaatcttaaccacgagttccattgatatggccaaaaagtattatcgggccatcaaagagatgacgaaagaatctgattggttaataaaagagtttcccaatcagcctatccgtgaaggacgaacgatggaggatcctgatttcccacgaatcgctattacctattcattagaagaaaatagccgagattcaagtgcccaacaagaagaaatgcaaaaaattattgaggaatataatcagtattatgatactgcctggtcactagcagacattgagcgttataacggagacatcaataatcgtttggcacgaaaaagagcggaattcaaacaatttgggaaacaaatcgatttagtaatcgtagtggatcgtctattgacaggttttgacgctcctacgattcaaaccctatttgtggatcgtaatctagagtatgcaggattgatccaagccttttcacgtacgaaccgtacgtatcctgaaaaaacaaaaggactaattgttactttccgaaagccagcgacaatggagaagaatgtcgaggatgcgacaaaactgtattcagaagctaaagaagaatcgggtttgatttatccaagttaccaagaatccaaaaaaagattcaagcaagcatatggtaagttaaaagaggtttcatccatggaatccattgatgaacatacgccacttgaaatccgtatcgagtacgtcaaagcatttcaagaattgaatcgtgcgtatgaatcgttagtgacttatgatgattacaatgatgacatggtgcaatcttcaactttgaacaatcaaattcaacttttggaagaacaaattggcgtgtacgagaccgtgaagggttcattgatggaggaagaaccagaaaaagagggagaagatttttcaacgatcgaattttatagtgaaaataccactaagttgtatgatattgattctacttatattgatcaattactaggaacttatgctgcgaatagttcagatgcacgagaagaaattgaaaaagctttggctaaattgaataaaacagaaggagtcaaagaagtttaccgacaaatcttaaatgcatttgatatggggactttagatagtaatgaagatatctttgtcattaaacgtcgctattttacacaagcaagtgatgatttgattcatgccttttccaatgagtggtttgtttctgagaaagaattacatgcttctaatctgcaatatatgccaggtgaagatccaattcctaatatgaaagcaattatcaacagtaaggattacgaaggatataaagccaaacatccagaagccaagccatttaaatacccacaagaaatgaagcgagcctggcgtaaaatgttagatgatgagttgattccacttgagaatgaattgaggtaa

SEQ ID NO: 1495 - DNA (genomic), 255 bp, Enterococcus faecium; double-stranded, circular
  misc_feature (B) LOCATION 1...255
  hypothetical: NO
  anti-sense: NO
gaggaacgaaacatgggatttatttggtcacttatcgtcggaggaattatcggagcaattgcaggagcaatcacgaataaaggttcttcgatggggattattgcaaatgtcgtagcaggtttagttggatcagcacttggtcaagcattattaggttcttggggaccaagtattgcaggaatggcaatcgtgccatcattgattggtgccatcattttagtactaatcgtatcattctttgctcgaaaactgtaa

SEQ ID NO: 1496 - DNA (genomic), 3696 bp, Enterococcus faecium; double-stranded, circular
  misc_feature (B) LOCATION 1...3696
  hypothetical: NO
  anti-sense: NO
atcatgcgaaaaatgaaaacaatggatggcaatacggcagccgcatatatttcttatgcatttaccgagattgctgcaatatatccaataacacccagttcgaccatggctgaattagtagatcaatggtcagcagcaggaaaagaaaacgtattcggtcaaccagtaaaagtagtagaaatgcaatccgaagcaggagcagctggtgtggtccatggatcattgaaaactggtgcactgacaactacatataccgcttcacaagggctgcttttgatgataccgaatatgtacaagattgctggggaactactgccaagtgttttccacgttgctagtcgggcagtgacgacaaatgcgttgaatattttcggagatcacggagacgtgatggctgcaagacaaacaggatttgctatgttagctgaaagcagtgtacaagaagtgatggatttagcacctgttgcccatcttgcttctattgaaggagaagtcccttttttgaatttctttgatggattccgtacgagtcacgagattcaaaaaatcgaagttttggaatatgaagaattagctcctctgatcaatcaggagaaattagcttcatttcgtaaacgagggatgaatcccaatcatccgactgttagtggtacgaaccagaatccagacatccattttcaacaacgggaaacgatcaacccctattatgataaattacctgaaatcgttcaaaaatatatgaaagagatcaaccgattacgaggaacttcttatgacttggtgacttattacggagcagacgatgcggaagaagtcattgtttctatgggatcagttgcacagacgattgaacaaacgattgattacttgaatgcaaacggacggaaaacaggttttttgaatatccatctttatcgtccttttccagtggaaacattcgtgcaaaagttgcctcatacagtaaaaacaattgctgttcttgatcgaagtaaagaaccaggggcaggtggagaacctctcttattagacgttcaaagtgcgttatatgattctgaacttcgcccggctgttattggtggtcgctacggattggggtctaaagatgtgactcccgaccaaatctcagcagtttttgatgaattgaaaaaagacccaagcatacgcaaaaaacggtttaccatagggatcgtggatgatgtgacttatcaatctttggaaccaaaggaaagtctggatttgacagaaccgcaaacattccaggccaagttttggggatttggatctgacggaacagttggagcaaataaatcagctatcaagattattggagatcacaccgataaatatgcgcaaggctatttttattatgattcgaaaaaatctggcggtctgactgtctctcatcttcgttttggagatacgccgatacgttcagcgtatcttgtcgagcatgcggaccttgttgcctgtcacacaccagcttacctgcatagctatgacttggtcaaaggattgaagccaggtggcatttttttattgaatactctttggagcgacgaacaattagaaacgcatctgcccttaaaattaaaacgttacttggctgaaaataacattagattctatacgatcaatgccatgagattggcccaagaagtcggtttgggacgccggatcaatacggcaatggaaacggctttttttaaattagctgacatcattccttttgatgaggtgcttccgctgctaaaagaagaagccctgaaaagctatggacataaatcaatggctatcgtagaaaaaaacatacaagcaatcgatcggacgaccgaactgcttcatcaagtcgcgatcccagaccattggagaacgttggagatgcctgaaaaaatcaataaaaggaacactggttatatacaagaaatacttgaaccagtgaatgcacaggaaggaaatcaactctctgttggtacacttgtagcaaatggaatgacaactggcgaaatgcctttaggaacggcttctatggaaaagcggggcgtcgctttagaagtacctgagtggattagtgatcgctgtacgatgtgtaatgaatgtgcctttgtttgtcctcatgctgccatccgtccatttttagcagatgaagaggaaatggaagaagcgccagaaggatttatcgtgagagaaatgcgaggcgcagacggcgtaaaataccgtatccaagtttcagtggaagactgtacaggttgtggtctgtgtgtagaggcttgtcccgcaaaagaaaaagctttagtgatgaagccttatgaagaacagaaagaacaagctgtgaattgggcttttgcaatgacattaagacaaaaagcaaatccagtcaaaggaaagaatactgtcttgtctacacaattcaatcaaccgcttcttgaattctcgggcgcttgctcaggctgtggcgaaacaccttatgtaaaattattgacacaaatgttcggtgatcgaatgatgatcgcgaatgcgacaggctgttcttctatttggggcggtgcttctcctgcttctccttatacgaccaatgaatgtggtcaagggcctgcatggtcaaattctttattggaagataatgctgaatttggttatggtatgcttctagcggcacagactcgtcgcgaggctttggcaagttcaatcaaagaagtattgccaaaagtatcagaagaactacgagaattgatggaagactggttagtacacatgtttgagagtgaaggaacgcagcaaagagcagcaaaactgcaagctgcgatcgaaagcgaacgatcaattttccctgaactggaggatatatacaagagaaaggatctattcgtaaaaaacagccaatggatgattggtggagacggatgggcttacgacattggttttggcgggatcgatcatgtacttgccagcggagcagacgtgaatatccttgttttggataacgaagtctattccaatactggcggtcaaacctcaaaagcaacaccagcttcggcaatcgctaaattttcggctagtggaaagtatgcttcaaagaaagatctaggaatgatggcgatgacatatggaaatgtttatgtggcgcaaattgcttcaggtgccaatcaaatgcaaacgatcaaggcatttgaagaagcagaaaagtatcctggtccttctctgattattgcctatacgccttgtatcacacatggcttgcttggcggaatgaaagaatcgcttaaagaagcaaaagaagctgtttcttctggttattggtcattatatcgatataaccctacaatggtcgaaaaaaacaagaacccaatgactttggactacaaaaaacctgatttctctgctatgcctgatttcatgaggaaacaagttcgcttttcctcgctagataacgcaaatccaaatcttgcaaaagctttatttgaaaagactgtccacgacgctaaaacacgtttttacaactatgctgcactgacgggagaattagaaaaaatcaagaaacgacttgaaccagaggaatctatcgatgtacccgttaagactagaaaagaaaaaacgacggaccttgaagcagaagaaagaagagctgctagaagagctgccagagcagaacgacgtaaaaaaatggaacaagctacaaaagaaaaaaaggaaaaataa

SEQ ID NO: 1497 - DNA (genomic), 525 bp, Enterococcus faecium; double-stranded, circular
  misc_feature (B) LOCATION 1...525
  hypothetical: NO
  anti-sense: NO
agcatgcgaaaaatcatattttatggcgctgtaagtttagatggttatttggcaacgaaaacggatgatcttcaatggctttttgacactccgacaggtgagcaaaccacttatgaagctttttatgaaacaatcgatacgaccatcatgggcaggaaaacttatcaggaagcaaaaaaatatttggaaaccgaagcaatttatccagagaaaaagaatttcgttttttcaaccaatgcacaattacaattgccagatgctgaggtcgtacacgaagagcctgttgcttttctaaaaaatctacaaatgacagaaggaaaagatatctgggttgtgggtggaggtcgattgatcaaaccgttagtagaacatcaaatgattgatgaatggtatatccagattgcccctgtattattaggggacggaatccctttattccaaaaaggaacctatgaagcacgttttgaattgctagatacgacacgattcggtgaatttatcgaattgcattatatacgaaagtag

SEQ ID NO: 1498 - DNA (genomic), 876 bp, Enterococcus faecium; double-stranded, circular
  misc_feature (B) LOCATION 1...876
  hypothetical: NO
  anti-sense: NO
aaatggcgaaagcttcttgaaattattaaaataatctttttaaataggagaaagcaaatgaccaagttaagcgagatgttacaagaaacgacccagtttatccttgataaaggagtaaaagaaattgattttggtttgattctaggttcaggattaggtgaattagcagatgaaatcgaagatgctgtaatgatttcttatgatgagatcccgttctttcctgtttcgacagtagttgggcatgcaggaaagctagtttatgggtctctggcaggcaagaaagtgttagccatgcaagggagattccactactatgaaggtcattccatgcaaacagtgacctatccagtacgtgtgatggccggactaggggcccattcagtcattgtgactaatgcatgtggtggtgtcaacgaatcatttgtaccaggagatttgatgctgattaccgatcatatcaattttactggtgaaaatcctttgatcggtccgaatgaagatgcaatgggccctagatttccagatatgagtcaagcttatacgcctgactatcaagcaacagcaaaagcagcagcagaaaaactaggtttggatcttaaagaaggcgtatatatgggctattctggaccaacttatgaaacgcctgcggagatccgaatgtctcggacaataggagccgatgcagtagggatgtcgactgttccagaagtcatcgtagcagctcacagcggattaaaagtgttaggaatctcttgtattaccaacttagcagcaggtatgcaagcgaatctgagccatgaagaagttgtagaaacaactcagagagtcaaacaatcttttaaagcattggttaaagaaacattgacattattgtaa

SEQ ID NO: 1499 - DNA (genomic), 885 bp, Enterococcus faecium; double-stranded, circular
  misc_feature (B) LOCATION 1...885
  hypothetical: NO
  anti-sense: NO
tgttttagaaaaattatattaaaagggtcaagaaatatggttatatttaaaacagtgaatgatgttagaagtcaagtaaaagagtggaaaaaacaaggcttaaaggtaggattagttcctactatgggatatttacatgaaggtcatgaaagtttaattagaaaagcatcaaaagaaaatgataaagttgttgtaagtatctttgtaaatccaactcagtttgggaaaaatgaagatttaggtagttatccaagagacttagaaagagatatagaagtatgcacaagaggtagagcaacagcaatatttaatcctgaagttgaagagatgtattgtgacaatgcaagtacttttgttaatataactggaataacagaaggtttatgtggagctagtaggccaatacattttagaggggtttgcactgttgtaagtaaattatttaacataataccagcagatagagcttattttggagaaaaggatgcacaacagttagctgtaattaaaagaatggttagggaccttaatattgatatagacgttgtagggtgtccaattataagggaagaggatggactagctaaaagttctagaaacacatacttaagtttagaggaaagatcttcagctactattttaaataaatctttaactttagctaaggaagctttaaataatggagagagagacagcttaaaaataattgagataataagtaaaaatataaatacttataatttggcaaagattgattatgtagaagttgttgattctttatcattacaaagagtaaattatattgaaaaatcagttttagttgcaatagcagtatttataggaaaaacaagattaatagataattttacatttgaattacaatag

SEQ ID NO: 1500 - DNA (genomic), 345 bp, Enterococcus faecium; double-stranded, circular
  misc_feature (B) LOCATION 1...345
  hypothetical: NO
  anti-sense: NO
acatttagaaaggttgttttatcgatgaatacctatgaaataataaaagacttggcgaagaggaaaaagatatctatacggcagttagaaattaattttggatattctaacggttatctagcaaagtggaaaaataatactcctaattcagatgaattaagtcggattgctgactatttcgatgtctctgtagactaccttctaggtagagaagaaagagaaacccctaaacatgtggatttatcagaagacgatactgttttttcttttgatggaaaagaaatatctaaggagacaatgcgtaaagcgattgcaattgctaaagctttagaggaaaatgaatag

SEQ ID NO: 1501 - DNA (genomic), 189 bp, Enterococcus faecium; double-stranded, circular
  misc_feature (B) LOCATION 1...189
  hypothetical: NO
  anti-sense: NO
cagtttagaaactacaatgtctacttatacaaaataaccccctgtaccgcaaaggatacaggggttatttgtacgttcctgactaactattacacgtcttctgttgtgtttgttattgcaggaaatcttaatatagaaggttttctatttgtttacattttgttgaattcgaatttttttggcacataa

SEQ ID NO: 1502 - DNA (genomic), 444 bp, Enterococcus faecium; double-stranded, circular
  misc_feature (B) LOCATION 1...444
  hypothetical: NO
  anti-sense: NO
gctactagaaaggggtgccccatggatcaatatttaacagtaaatgtggtaactcctgccggtttggtctatgatcaccatgcagctatcgtcgttgcacgtacgacagctggtgagcttgggattttgcctaaacatgcaccaatcatcgttccattgacgattgatgaagttcgtgtaaaacgaacagattcagatacccacgtcgattggatcgctgttaatggcggaatcatggaagttcgtgataatgttgtttcaatcgttgctgatagtgcggaacgtgaacgtgatatcgatgtatctcgtgcggaacgtgcaaaacaacgcgcagaacgccaaatcgaagaagcaaaagcaaaacaagatacgaacgaattgaaacgggcaactgttgcgttgcaccgagcaatcaatcgtatcaaagtatctaagcactcataa

SEQ ID NO: 1503 - DNA (genomic), 816 bp, Enterococcus faecium; double-stranded, circular
  misc_feature (B) LOCATION 1...816
  hypothetical: NO
  anti-sense: NO
aagaatagaaaggaaaagatgatgatgaaaaaacagattatcactatagctggaggcgggagtacgtatacaccaggaatcgttcaagccattttgaacaatgaaaaacggttgccattatctgaaatacgtttatatgatattgatgaagaaagaaatatggatatgtacttgattgttaaatttatgctgaaaagaaaaggtttttcaaatattcgcattcgtgcaacggatgatccaaagcttgcttttacaggatgcgattttgttttctcacaaattcgtgttggaggattggagatgcgagaaaaggacgaaaagattccacttaaacatggattagtaggacaagaaacgtgtggactcggaggatttgcttatgggatgcgctcaatcaaaggtttattggaaattgtcgatcatatacaagactatgcccccaaagcatggattttgaattatacaaatccagagtcgatcgtttctgaagctgttcgtcgtaaatatccgaatgtaaaaatgattaatgcctgtgatatgactatttcaattgaagaaacgattgcagtgaattacggttatgatcgtaagaattggatcgttacgtattatggtttaaaccactttggctggtatacatcgatttatgataaagaattgcgacgagaaattatgccagagattattgaaaaactaataacaaaagaaatgcaagtcgccgattttaatataggagataaaacttggcaaaaaacctttcaaatgatgtcagtcatcacgaaaaattttcaagtaatatcgcgaataattacttag

SEQ ID NO: 1504 - DNA (genomic), 309 bp, Enterococcus faecium; double-stranded, circular
  misc_feature (B) LOCATION 1...309
  hypothetical: NO
  anti-sense: NO
ggaggtagaaagatgaaactaaaagacggattttacgctagtagtcatggtatcggcggtttaatgctagatatgccgacaaagaatcctaaaacacgtaagaaaccaaaagtcaaagtcggtgacatggttcgctgcgaagcagaggagttcatctatccgtttcgtggatatgtagaacacgtctataatcactcagcaatcattcgtattgaaaacacgatggaatgtgacaagttattagcgaaaagcaaagagaatttagcagtggctcgattggtggatatcgaactcattgaaagcaaataa

SEQ ID NO: 1505 - DNA (genomic), 462 bp, Enterococcus faecium; double-stranded, circular
  misc_feature (B) LOCATION 1...462
  hypothetical: NO
  anti-sense: NO
aaaatcagaaattggctggtgatttggatgttacgggaaatgcgtttagaagatgcagaagcactacgtgaaatcaatgcggatcaattagggtatgatataccattaaccgttacggtgagacaaatgaagaaactgctgaaggagccagagaaaaattttttcttggtttatgaagatcctacttctaaaaaagcagctggctatgtacaagcggagtcctatgaatcgatttttagcgatccaatgttcaatattatggcacttgctgtgtctaaatatgctgaaaaaagaggcatcggaaaggctttgatgactggcgtagaagaagaagcgaaaaaacgaggaataacgacaataaggcttaattctgcagaatacagagtagaagcacaccaattttatgaacacatcggttatcattccgataaaatgcaaaaaagatttttgaaaatcctgtaa

SEQ ID NO: 1506 - DNA (genomic), 189 bp, Enterococcus faecium; double-stranded, circular
  misc_feature (B) LOCATION 1...189
  hypothetical: NO
  anti-sense: NO
cgacacagaaaataccgtgtctcagatttctctactacttctaaaaactactgtttttttcctttgaaatgccttcaaaaagtaggatcaggcagaatatactggcagaatcaaggagaagggagcctaaataaggagaaaaaccatagaaaatataaagtaattacttataaaacaagctttttatag

SEQ ID NO: 1507 - DNA (genomic), 348 bp, Enterococcus faecium; double-stranded, circular
  misc_feature (B) LOCATION 1...348
  hypothetical: NO
  anti-sense: NO
ctagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaa

SEQ ID NO: 1508 - DNA (genomic), 348 bp, Enterococcus faecium; double-stranded, circular; identical to SEQ ID NO: 1507
  misc_feature (B) LOCATION 1...348
  hypothetical: NO
  anti-sense: NO

SEQ ID NO: 1509 - DNA (genomic), 348 bp, Enterococcus faecium; double-stranded, circular; identical to SEQ ID NO: 1507
  misc_feature (B) LOCATION 1...348
  hypothetical: NO
  anti-sense: NO

SEQ ID NO: 1510 - DNA (genomic), 348 bp, Enterococcus faecium; double-stranded, circular
  misc_feature (B) LOCATION 1...348
  hypothetical: NO
  anti-sense: NO
ctagacagaaaaattaaggtgtgtagactagaagaaaatataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaa

SEQ ID NO: 1511 - DNA (genomic), 717 bp, Enterococcus faecium; double-stranded, circular
  misc_feature (B) LOCATION 1...717
  hypothetical: NO
  anti-sense: NO
aggagcagaaaaaaaatgattacagctattattattgctggtggtgtgggtaaacgaatgggacaagatatcccaaaacagttcattacaattgaaggaaaacctattattatctatactttagaatcatttcaacaccatcctcaagttgaccggattttagtcgtttgcaaatctggttgggaagaaacgatgtgggcgtatatcaaagaattcaatattagcaaagtcaaatgggtcattacaggtggatcaaagggacaagagtcgatcaataatggtgttcagtttttgaaagactattctgaagatgatgatacgatcatcatccatgatggaatccgtccactagtagacgaactggtattgtcagatgtaatcgttaaatgtaaagaatttggtaacggtgtaacctctctaccttacaacgaacaaatttttatcaagaaaacagaagaaacgacggaacagtatgtcgatcgtaacacattgaggcgtgtctcaactccacaagcttatcaatacggaaaactacgggcagcatatgaccgggcagtgaaagaagacatcggtatgactgattcttcttatacgaataccatgatggtagatttgggagaaactttatattttgctgctggttctgataaaaatatcaaattgacaacaacagatgatctagaattgttcaaagcatatttaaaaatgaaagactag

SEQ ID NO: 1512 - DNA (genomic), 480 bp, Enterococcus faecium; double-stranded, circular
  misc_feature (B) LOCATION 1...480
  hypothetical: NO
  anti-sense: NO
gaggcaagaaagatgaaattccaacaaaccaaagaagtattaaatcaattagttgcagatctaagccaaatgtctgttgttgttcaccaaacacattggtacatgagaggaccaggtttccttacattgcacccaatgatggatgagttcatggatgatttgaacgctcagttagatgaagtatccgaacgcttgatcacattagacggttcaccttattttacattgcgtgaatttgcagataacacaaaaatccctgatgaaattggccgctgggatcgtactattccagaacgtttggaaacacttgttgcaggctatcgttatctagcagatctttaccaaaaaggaatcgaagtttctggagaagaaggcgacgatccaacacaagatatctttatcgaattcaaaacagccacagaaaaacgtatctggatgatccaagctcatttgggcaaagcgccagagatcgacgcgtaa

SEQ ID NO: 1513 - DNA (genomic), 183 bp, Enterococcus faecium; double-stranded, circular
  misc_feature (B) LOCATION 1...183
  hypothetical: NO
  anti-sense: NO
gtaaaaagaaacaaagaggtgtttacaatggggttgaaatttgaacgtacagataatttagataaacttttcgaatcatttgctgtcgatccggaaaaaacagttgcaccaaaagaagagatcgatcgatttctaaaaccacagccacaaaatgaaaagaaaaaagacaagaaacaaaagtaa

SEQ ID NO: 1514 - DNA (genomic), 1158 bp, Enterococcus faecium; double-stranded, circular
  misc_feature (B) LOCATION 1...1158
  hypothetical: NO
  anti-sense: NO
gaggaaagaaacatgcacattcaaacaaaattgatccacggaggcatcagtgaagatcccacaacaggagctgtcagtgtacctatttatcaaacatccacttatcggcaagatggcgtcggccagcctaaacaatatgaatattcaagatctggtaatcctactcgttttgcattggaagaactgattgctgatttggaaggcggtgttcgaggattcgctttttcttctggtctttctgggattcatgccgttttttctctttttcaagctggcgatcatatcttattaggagatgatgtctatggaggaacattccgtctatttgacaaagttcttactaaaaatggtctcgagtacacgatcatagatacgagtaatcttgataaaatagaacaatccatcaaacccaatacaaaagcactttatcttgaaacacctagcaatccgcttctaaagattactgatttagaaaaaagtgccactctggctcatcaacatggattgatagttattgctgacaatacatttgctactccttattttcaaagacctttagatctcggttctgatatcgttgtccatagcggtaccaaatatctaggcggacacagcgatgtagtagctggtttagtgacttctaaccataaagatctagccgatcagatcggattttaccaaaatgctatcggagccgtacttggtccccaagatagctggttacttcagcgcggaatcaagacactaagtgttcgtatggaggaacatcaaaaaaatgcttttgtggtagctgattttctattttctcatccagcagtagaaaaggtctactatccaggattacccgatcatgaactccatggagttgctaagcagcagatgagcggctttagcggaatgatttcttttactttaaaaaatgaagaatctgctattccatttgttgaatcactccaactatttactttagcagaaagtttaggtggcgtagaaagtttagtggaaattccttctgtcatgactcatgcgtctattccaaaagaaaaacgagaagaggctggcataaaggacggcttgatccgtctttctgtaggaattgagtatggtcaggatctcataaacgatttagctcaggcatttgacagaatcaagaactag

SEQ ID NO: 1515 - DNA (genomic), 711 bp, Enterococcus faecium; double-stranded, circular
  misc_feature (B) LOCATION 1...711
  hypothetical: NO
  anti-sense: NO
gaggaaagaaaaatggcacgaacacagaaacaaaaagcagcccaaactcatgcagtcagtttggtcacactcaccaatccctcttcaccaatcgctgaacaatatcgtacgattcggacgaatatccagtttgcctccgcagctggtcagcaaatcaaaacgattgttgtgacttcatcaggacctggagaagggaaatcgaccactgcagcaaacattgccgttgtttttgccaaatctggtcaacgggtgctgctagtcgatgcagacttacgtaagcccgtcatctataaaacgttcaagttgaacaacgcaagcggattaagtactgttcttagttcatcaggaagtgtagcagatgagatccaacgaacaccagtcgacaatttgtcgattctgccaagtggacctaaaccaccaaatccatcagaactactaagttcgccaagaatggatcagattttagcagaagcaagacaactatttgatgtagtgatcttcgacatgccgccagtcgttgccgtaacagatgcacagatcatgtcttcaaaaacggatggcaccttattggtcgtacgggaaaatacgtcacgaaaagaatcattgactaaagcaaaagaactgttagatatggtacaagcgcgagtccttggtgttgtatacaatggagcagaacacagcagagatgctggctattactacgggaattaa

SEQ ID NO: 1516 - DNA (genomic), 660 bp, Enterococcus faecium; double-stranded, circular
  misc_feature (B) LOCATION 1...660
  hypothetical: NO
  anti-sense: NO
tttttgagaaaaaaaagacaccaaaaaagatcaatgctttgcctagaatcggtatcccaaacaaaggtgtatggacagaaaagccgttgcgttttgttgtgtcgggaaatccttatatctctttacaaagaaaaaaccaaatcgagaaagattggggttggaggaaagaaaatgaaaaagaaggatctattaacatatttagatgaaataattgaaaaacaagtgacagactatgatgtagctttagattgggatacaaaaaatcatacgatcgagatcgttgttcgcttgtttgcagaaaataaagcacaatttgagattgatgatgcagaagggatcgtttcgcaagaaccaattatcgaatttgaagacggcgtacttctttttaatcctcagaaatctgtttttgatgaacgcaattatctagcagtaatcccttatgaaggaaaaaaagggttggcaaaatcagtagctgattctttagtggaatatctaaatgaagtattagctcaagggcaaagcgatttgcttgattttttggatgaagacgatgacgaagctgtattcgagcttcactgggataatcagcaactagcagaattagtagaagtaaaacagcaaaatgaagcagatacttatttaccgtacccaagttattaa

SEQ ID NO: 1517 - DNA (genomic), 744 bp, Enterococcus faecium; double-stranded, circular
  misc_feature (B) LOCATION 1...744
  hypothetical: NO
  anti-sense: NO
aatatgagaaacatcaagttgacaatcgaatatgacggaaaaagatattcaggatggcaaagacttggagatgacgataaaaccattcaaggaaaaatcgaaaaagtattgcatcagatgacaaatgaagagatagaaattattggatcaggaagaacagatgctggcacccatgcgcgaggacaagtagcaaattttaaaacaaacacagaaattggactggcagaaatgatcgactttatgaatcgttaccttccgcgggatattgtcatcaaaagaatcgaagaaatgcctgagcgcttccattcaagatataatgcggtgggcaaaaaatacagctattatgtttggaacaacgtgattccttcagcatttgagcgaaaccacagcttttatttccctcaagagttggatatggacaagctgaatgcagcttgcgaaaaattagtgggtacacatgatttcattggtttttctgcattgaaaaaatcaaaaaaatccacagtgcgtacgattgatgaattatctatcgaacgaaagggagaaatgcttcattttacttttgtcggagacggattcttatataaaatggtgcggattatcatggggacattactagaaatcggcacaggtgccatgccgatagaaacaatcgatgaaatatttgaaagcaaagtgcggcaacatgcaggagaaaccgtccctgcacaaggtctgtttttggatgaagtttattatcgataa

SEQ ID NO: 1518 - DNA (genomic), 225 bp, Enterococcus faecium; double-stranded, circular
  misc_feature (B) LOCATION 1...225
  hypothetical: NO
  anti-sense: NO
cttaagagaaagaaggtgatccatttgaaaaagattattcccttattgttagtactgtttgttggcgaaatacttatgcgagatagtgcagctgtacagttaaacctcgctgtatttttggtaatactggtgttttgtttgatcttttggcggtttgtattagtcctcgtgagtctactattcaagatgattgcagccatatttttcatggggttatttcgatga

SEQ ID NO: 1519 - DNA (genomic), 225 bp, Enterococcus faecium; double-stranded, circular
  misc_feature (B) LOCATION 1...225
  hypothetical: NO
  anti-sense: NO
cctaagagaaagaaggagatccatatgaataaaatcattcctctattgttagtcctatttgttggcgaaatacttatgcgccatgctgcagctgtgcatttaaacttcgtagtatttttggcaatactggtattttgtttgatcttttggcgctttgtattagcccttgtgagtctactattcaagatgattgcagccatatttttcatagggttatttcgatga

SEQ ID NO: 1520 - DNA (genomic), 720 bp, Enterococcus faecium; double-stranded, circular
  misc_feature (B) LOCATION 1...720
  hypothetical: NO
  anti-sense: NO
gtaaagagaaataagtacctgtttttgtttcctagcaatgaatgcgttatactaatggatgaaagaagttttggctatcaaggaggaatgcacatgcatatcgaaagattaaaaacaggaatgattgaagaaaactgttatttggtctacaacgaagaagcacttttgatcattgaccctggagaagatgcggaacgaatcaaacaagaaatcaaaaaaacaaaccaacagccggtagcgattttgcttacccatactcactacgatcatatcggtgcagtggaacctttacgcgcgtattatcaaatcccagtttatgtcagcccactagagcaaaaatggctaggtgatccgattttgaatctttctggactcggtagacatgatgatattgctgatgttattgtctcgcctgcagaatatgaatttgaaatgaaaacttatactttaggaaacatgtcttttcgcgtcgtccctaccccagggcattctataggaagcgtcagctttatttttgatgattttgtcgtttctggcgacgccctgtttagaggaagtatcggtagaaccgatctgtatacagggaatttagaacaattacttcatagtattcggacccagctgtttgtattacctgatgaatttgcagtctatccaggacatggcgatgcaacgacgattgaacaggaaaaaaggacaaatccttttttcaatcgttaa

SEQ ID NO: 1521 - DNA (genomic), 1164 bp, Enterococcus faecium; double-stranded, circular
  misc_feature (B) LOCATION 1...1164
  hypothetical: NO
  anti-sense: NO
ggagagagaaaaatgagagcagtacattttggtgcaggaaatatcggtcgaggatttattggagaggttttggcagctaatggatttgagattactttcgtagatgtgaatcacacgatcattgatgctttaaatgaaagaaaagaatacgaaatcgaattagcagatgaatcaaaagaaaaaatcactgtaaaaaatgtcaaaggaatcaacaatcaaacaaatccagaaaaagtaatccaagaaatcgctgaagcagatttagttactaccgccattggcccgaatatcttaccttttattgctgagttgattgcaaaaggtatccaagaaagagaaaaggaaggaagcacaacatctttagatatcattgcctgtgaaaatatgattggcggttcagcatttctagaaaaagaagtgtataaatatcttccggaaacatcatttactgacaaatatatcggctttccaaatgcagcagtcgatcgaatcgtcccattacaacaccatgaagatcctttattcgtccaagtggaacctttcaaagaatgggtcattgacgatagccaaagaaaaaataaaaaaatccaattaaaaggggttttatatgtagatgatctagaaccatatatcgaacgcaaactatttagtgtcaatactggtcatgcgactgtcgcttatacaggtgccttgttaggttaccagaccattgatgaagcaatgcaagatgcgttagttgtggcacaattaaaatcagttttgcaggaaacaggaagtttgctgattgccaaatgggggtttgatgcagagcagcatcatgcgtatattgaaaaaatcattcatcgcttccaaaacaaaaatatctctgatgcgatcacacgtgtcgctcggacaccattacgtaagttaggttatcaagaaagatttacacgtccagtgagagaactacaagaacataacttgacttgcccacatttgacggcaacaatggggattatttttaattactatgatcctgaagatgaacaaagccgtcaattgcatgaaatgaagatccatgaaaacttggaacaattgattcaagaagtcacaggaatcaatgatccgaaaacaatcgggaatatcaagcaaaacgtgaaccgttatgccaagcaagtcgcttaa

SEQ ID NO: 1522 - DNA (genomic), 360 bp, Enterococcus faecium; double-stranded, circular
  misc_feature (B) LOCATION 1...360
  hypothetical: NO
  anti-sense: NO
agggagagaaattttatagtgtcagaagaaagaatttatattcctaaaaaaggtgatattgtatggattgattttgatccctccgtaggaaaagaaattcaaaaaagacgaccaggactagtcgtctctcgttatgaatttaaccgtaaaacaatgttttcggtcatatgtccaattacttccactataaagaatttaccgacacgttactcattacctgaagagctagatataaaaggacaagtaattattacacaattaaaatctcttgattttaaggaacgaaaactcaaaaaaatagaaaacttaccattgcaagacatggctaaaattgatcagattatacagtatatgttttaa

SEQ ID NO: 1523 - DNA (genomic), 660 bp, Enterococcus faecium; double-stranded, circular
  misc_feature (B) LOCATION 1...660
  hypothetical: NO
  anti-sense: NO
atcaggagaaaaaatatggaaaataaaactttaaaaatcgtcttaacagctgcaattagcgttagtttaatcggcaatatcgcgttgttttggcagctgaaagaggaacaagcgacaaatacctataaaattgaagaagtggctaaaaacgcgtctgagaagctcaaaaaaaattcctcttcagcgcaggcaaagatcgacaagttaaatcaaactattaatgagaaaaaccaagaaatcgatcagctaaagcaacaagatggcacaaaagcaaaagaagaagtaaatgaagcacaaagtaagacggcagaagagttcggtaaattggccattgataaatcattaagcagaaatgaattaacggaaaaactaaaagatgtagcaacccaagaagtgattgacaaattaagtcctgcagacgatgatcaccaacatgatgattacggaagttactcctttacattaggtgacgtgcaaacttacgctcaaacaagcagtgtaaaagaggaacaaaattttgtcgtatttgttgattatacaatcggcaatcctcaattcaaagatgtcaaaccgcaaaaaataaaaggtggattaactgtcactgaaaaacaagtagatggtcaatggaaagtcacagactttagttatttcactcgttag

SEQ ID NO: 1524 - DNA (genomic), 225 bp, Enterococcus faecium; double-stranded, circular
  misc_feature (B) LOCATION 1...225
  hypothetical: NO
  anti-sense: NO
ttaattggaaatatgaagaaaggagagtctatgaaaacaacactagttctattctataaaaagcatccttattttacacttctgataaatatattgttggctagtgttatcgggatttctgttgaatatctaataaataaagatttcataggttcttgtttttatacggctttatttcttggacttcttgaagcattttccatttataaaaaatcaaaaaaataa

SEQ ID NO: 1525 - DNA (genomic), 1065 bp, Enterococcus faecium; double-stranded, circular
  misc_feature (B) LOCATION 1...1065
  hypothetical: NO
  anti-sense: NO
aagactggaaagcacaaggaggcgatcgaatcacacaagagtacgaggaagcatacaaagcagcggcacagtaatatagacgattgggacaaatacttcttggtatttgtcccaaatcctattttaatttttaaaggagagcaaataatggaaaactggtcaaagaaattagcaaaaagtatcatggaaagaacacctcgcttatatgaagaaaagtggtataaaggaaaatggtcttatgactatggcgtcgtacttaaagggttccaattactttgggaacgaacccaagaaaaaatttattttgatttcataaaagacaatatcgactatttcgtgcaagaagatggaacgatccgtggctacagcgttgaagaatacaatatcgaccatgtaaatacaggaaagcttttctttttattgtacaaagaaacaggcgaagaaaaatataaaaaagcagcagaactcctttcccagcagttggcaaaccatccacgcacatccgaaggagctttttggcataaagaaatttatccttatcaaatttggttggatggcttatatatgggttctcctttttatgctgaatttatccagaattttagtgaagaaaaagattaccaagatgttttgagacagtttgaaatcagttataaacatctattcgatccaaaaacaaatttgctgattcatgcatgggatgaaaagaaggtccaaccatgggctgatccaaaaacaggtctatcccatcatttttggagccgatcgattggctggtatttgatggctgcagcagatacctatgaattacttcatgaagaaacagattgttctttgctgaaagaaattctagaaaagacactggctgcattacttccatatcaagaagaaaacagcgggacatggtatcaagtaacaacagaaacaaaacggaaaggaaattatctggaagcttccggcagtagtatgtttgtttacgcaatggctaaaggaatacgtttgggactgctgaacaaagaagaatggcttccacagagtgaagaaatcacatcaaggattacttga

SEQ ID NO: 1526 - DNA (genomic), 837 bp, Enterococcus faecium; double-stranded, circular
  misc_feature (B) LOCATION 1...837
  hypothetical: NO
  anti-sense: NO
caacgtggaaataccaggagcttaaagcaactggtttttctacttatatcggaaaaccgatcgatcagctggaaaaggattttggcccaagcctatgatcgattaactagcggatttggttttgaaacaagatattatgaaaataaagctagtcatctcacatttgaagcgaacatccaagacagcagagtcacaactgttaaagtactgcaaacagggcctgctgatatcgcgccgttttatttagggatgacgatgcaagatcttacgaaaatcactactatctatactaatttcacttttgagtaccatgatacagaagttggaatcgaactaatggaagaggatatgaattatcgtccgctaattgcttttgataacgacacttttgctattttattttttgatcaaacaacaaacggcctattttcagttgtgtatttagataaagatagtcttttgaaactattgccatatcaagtgtttggtgaaggccttccacattatcaagcagataaatcggctgattgggaatcaatcaatcgcgttaaagaacgaaaaagtacgactttattaaatatgcttagaagagaagacgaacttcccatatacaatcaaacacttgcctttcaaaaccacagtcagctgctactacatgattttttgacaaggcctgaggaaatattgtcagaggaacgtatggctgattggcaaaaatcgctaggcagtgctcaaacgacagtgaaattctcactgacgaatgatgaattggagaagttaatcagtaaacaaaaattagaaaaccctgagtgggctatttattcatccggcgattga

SEQ ID NO: 1527 - DNA (genomic), 201 bp, Enterococcus faecium; double-stranded, circular
  misc_feature (B) LOCATION 1...201
  hypothetical: NO
  anti-sense: NO
tttaacggaaatgtttgcatgatactctgctcctatccttttgttccgccagatgtcaggccggtaacaaagttcttttgtaaaaagaagaataatagacaaatcggtagtgcaatcaaaattgccccagcagcaaaaagagagactctttggtttgtcacatcagaaataaatgtttgtaagccgacagcaacagtctga

SEQ ID NO: 1528 - DNA (genomic), 861 bp, Enterococcus faecium; double-stranded, circular
  misc_feature (B) LOCATION 1...861
  hypothetical: NO
  anti-sense: NO
aaagaaggaaaaacgatggttgtcgcttggcaccgcccaacgaaagcagtgatacataaaaaagctataactgaaaatgtagcaaatgaagttgcaagacttccgcaaggaaaagaattgtttgcagtagtaaaagcgaacggatacggtcatggagctattgaaacagctgaggcagcagttgcaggtggagcttcgggcttttgtgtttcaaatttagatgaaggagtcgagttgagagaagctggatttactcagcccatccttatcttgaatatggttccttacgacgcactgactgtagctgttgctcatgatttatcagtaactgcaggtacacgggaatggttgcaagcagcagctgctgttttagagaaaagtaagctagagacgcctctttcgattcatctaaaagcagacactgggatgggtcgtatcggattttgtacacctgaagaagtaaaagaggcagctgcattcatcaaagaaagtcgtgtattagaatgggaaggtttatttacccatttttctacagcagatcaggcagatgatacatattggaatctgcaaaaagaacgctttatagaagtgctgaaaaaacttcccgaacttcctcgatatgtacatgtcagcaatagtgcaacggctttatggcatgatgaaacaatcggcaatatgattcgttatggagtagcaatgtacggacttaatccctctgggcacgcactaccggaagtttatccattgcagccagcacttgagctggtttctgaattgattcaagtcaaaaaactcccagcaggtgaaggaatcggctatggagaaacatatatcactcctgaagcagagtggatcggaacg

SEQ ID NO: 1529 - DNA (genomic), 528 bp, Enterococcus faecium; double-stranded, circular
  misc_feature (B) LOCATION 1...528
  hypothetical: NO
  anti-sense: NO
aaaagaggaaactggatgtatattcggcaaacaaggaaagaagaagtagaagaagtggtagaaatcattaatgccgcagcggatttcattgcttcgcaaggctctcctcaatggcaaaacgggcagaaaccaacaaaagaaacgattttgaacgatattgaaagaaaagaaagctatgtattaatagtggaagatcaaattgctggaacagctgcattagtctcaggcgtggatcccgtttacacaaaaatagatggtagttggaaagaatcaactggtccttatttatcgattcatcgtgtcgctttagcagaaagtactcgaggaaaaaaactagcaaaaccgttcttagaacatttgttgacgattgcagccagcaaaaatatccaagatatccgtatcgatacttatccagctaatgaaccgatggaaaagaccatctattctgctggattcacttatcaagggatgattgaatttccttttgaacacggcgaaagaaaagcatatcaaataatcatcaattga

SEQ ID NO: 1530 - DNA (genomic), 1185 bp, Enterococcus faecium; double-stranded, circular
  misc_feature (B) LOCATION 1...1185
  hypothetical: NO
  anti-sense: NO
attggaggaaagaaaatgtttatgttctcaaaagaagaactacgaaagctaggagcagaaaatactacccgagaaattcgacagcaaccggaactgtggcatgagacgtttgaccgttatcaagaaacagttgcagatttagatcgtttgtttacggatgcgaaacaacatgctggagagcgaccaatccgagtcatttttacaggggccggaacctcgcaatatgtgggagatacactaattccgtttcttactagtcaaggaaatacgaaccagtttatttttcaaagtattggttcgaccgatatcgttgctacgccaaaagaatacctgattcctgatgagacaacgatcttggtctcatttgcccgtagtggaaatagtccagaaagtctagccgcagttaagatggccaatcagctggtcaacaagatctatcatatcgtgatcacctgtgcaccagacggattattggctacacaaatgcctacaaaaaaagaaaatctagttttactaatgccaaacaaagccaatgacgctggttttgctatgacaagcagtttcagctgtatgacgctgactgcgctacttatttttgatcaagcaagcaatcagcaaaaagaaagatatgttcatcaattaagccgactaggagaagaagtcatccaacgagaatcagagatccaagggtatctggcatcagactttcatcgcatcatttacttaggttcgggaagcttaggcggattgactagagaagcgcaattaaaagttctcgagttaactgctggaaaaatcgcaaccgtatttgatacatctttaggattcagacatggtcccaaatcttttgtcaatgagcaaacattggttttcctgtttgtcagcaatgactcatatacgcagaaatacgatgtagacatgctggaagaaatcaaaaatgacggtattgcccaacgcgttgttggaattggtcaaaagggttcattgtttagtggtgattcctttgaattagttgcagattcgttactgccggatggctatcttgctttagcagatatcatggtagcccaaacgatcgcattactttgttcggtgaaggttggtaatacaccagatacaccatcgccaagtggaacagtcaatcgtgtggtcaaaggcgtaacgatttatccatatgaaaaatag

SEQ ID NO: 1531 - DNA (genomic), 240 bp, Enterococcus faecium; double-stranded, circular
  misc_feature (B) LOCATION 1...240
  hypothetical: NO
  anti-sense: NO
aaaggaggaaaaacagtggatctaatgggaagattagaaggttatttgaagtatcggcgagcaaaacatagtgagaagcttcgagcaaagaatctcaaatcaggaaaaaagaagacaaaaggctggggaaaaatggtcgatacaggttttggcggactaaataatctgaatcctgtcgatacaaaagaattcatcaaagaagaacagaaacgaaatggtaaaatcaaatcacactattga

SEQ ID NO: 1532 - DNA (genomic), 693 bp, Enterococcus faecium; double-stranded, circular
  misc_feature (B) LOCATION 1...693
  hypothetical: NO
  anti-sense: NO
aaaggaggaaaagggatgcgtacacttatcatcattagccatccaacgatcgaagaatctttaaatcagcaatttttcaaagaagcttctgctggtttaccagctacttggcatcatttggaatcaagttatccagacggccaaatagatatagagactgaactacagctcttaacccagcatgatcggatcattttccagtttccgttttactggtatagttctcctgctcatttaaaaatttggcaagataatgtcttggaacgagcagcacatgtattaaaagggaaagaactaggaatcgtattgacaacaggtgtggcggaaaaagaataccaagctggaggaaaagaagaatatacgatttccgaatttttgaggccgtatcagcgaatcgcaaataaattccatatgacctatcttccgccattcgttttagcacaatttatgtatttatcccaggaaaaacgttgggagaagctaattgcttatcagcagtatctctcattggaaggcaaaccatcgctgactcagcggattgactggtttattcaaagagtacaggaaaatcagaaaatgcaggaagaagaatctgaaaaacaagcatatatcgtagaagcactgactgaggcaaaagagcagatcgaagacttgacctttacactgcaagaaatgaaaggaacttcattatga

SEQ ID NO: 1533 - DNA (genomic), 549 bp, Enterococcus faecium; double-stranded, circular
  misc_feature (B) LOCATION 1...549
  hypothetical: NO
  anti-sense: NO
ccgatgggaaaattaaaatgggatcatatccaacagcttctttccctcccttctgtcaaaaaacaatggatagctatttatggacaactacctcaggaaaaagaggtggaggaattgtatcaacaatttgaacattatctgtttaaagatttggtcaagcattctaccttgaaacccgacacattggaaacgatcgaacggttgagaaacgctgggatcaatattggttccacgaatggatttaatgctcctatgatgacaatcgtagcagaaaccgcaaaaaaagaaaggtattcaccagacttcatggcaacttttgaagacgtcgaagggtatggtcgaccgtttccttatatgatccataaaaacatgcagtacttcaaaaacaagtcggttgatgaagtaatcaaagtcggagatacggtctcagatatccaggaagggaaaaatgccggagtgttgacagtaggtgtaattgaaggtagttcgctaatggggatttcttatgatgagtaccaaaaattagagatggggaaaaagatcgtttaa

SEQ ID NO: 1534 - DNA (genomic), 354 bp, Enterococcus faecium; double-stranded, circular
  misc_feature (B) LOCATION 1...354
  hypothetical: NO
  anti-sense: NO
aaccagggaaaaaagatcgttgcgacaaaaaatgtaacaatcaatgaagattttttccaaggtcactttcctgacaatccagtgatgccgggtgcgttgattctagaaacactggcacaagcaggttcgatacttatcctaaaatcagaagagtttctaggaaaaagagcttatatcggtgggatcaataaggccaaattccgtcaaaaagttgttccaggagatgtgctgaaatgtcattttgaaatcaccaaaatgaagggatcagtcggtacagcgttatctgcagcatatgtagatgataaaaaagtctgtgagtgcgagttcacgttcatcgtcaaccaaaatgcttga

SEQ ID NO: 1535 - DNA (genomic), 393 bp, Enterococcus faecium; double-stranded, circular
  misc_feature (B) LOCATION 1...393
  hypothetical: NO
  anti-sense: NO
gaacagtgtttgaatcacctagcaatcacgaacggaggaagtaaaaaaatggcagaaaaacaaaccgcaggaagagatcaattgggggagtttgcaccaaaatttgcagaattgaatgacgatgttttatttggagaagtatggtcaagagaagaattatctcctcatcagcgtagtatcatcaccctatctgctttgatctcagaagggaattttgaacaattgccggctcatctgaaaattggcaagcaaaatggcattactagtgaagaaatagcagaaatcattacccatttagctttttatgtagggtggccaaaagcttggtcggcttttagtttagcaaaagaaatctatctagaagaaaatagtgaagataagaaagaggcataa

SEQ ID NO: 1536 - DNA (genomic), 288 bp, Enterococcus faecium; double-stranded, circular
  misc_feature (B) LOCATION 1...288
  hypothetical: NO
  anti-sense: NO
aacaagtgtttcacaggttgttctttcaacctatccatacaaatcagtaatccgaaaatatacatcccagatagcacaaggggcaaacgtcctataatgagagacgaccctgaagaaaaatcgattattcgctcaaataagattaatccctcttctatcagcaaaagtaaagtttccggcagccagcgattgaagagtgtgagaaataacacaccaggaagaaaaagaaacttgaataccggtgcaatcagtaatgtaaaaagactacctaaaataggccactcataa

SEQ ID NO: 1537 - DNA (genomic), 1098 bp, Enterococcus faecium; double-stranded, circular
  misc_feature (B) LOCATION 1...1098
  hypothetical: NO
  anti-sense: NO
acgcccaccctcttcttttttctctttccttctttcgtttttgctttatgtatcaaccgttgtttcttcgaaaactattttgttctctccttcttcctgatagaatggatgggaaaggagcttgatgccatgacaacgaaagacaaggtacttcaattattgaaaaagacaccagattttctttccggagaaaagttggcacagcaactggaagtttcccggacaagtatttggaaagccatcaaagaattggaaaaggcaggctatcgttttgagcacgggcctacagggtatcgttacctgccctctgacgtactagatgcaaaagaaatccagcaagagctacggtcgtttattcctgatttgaaagtacaaacgatgttgacttctgaatctacgatgaaagatgccaaactggcagcagctcaaggagattctgtttcgaagttatttgttgctgatacacaagaacaagctcgtggacgttttggacggccttttttcgctgaacctggacgaggaatctacatgagtctcttgctccatccagacaaacggtttgatgaattgcctcaatatacgatcatcgcagccagtgcctgtgtgaaagccattgaatctgtaaccggtcgttctgcttcgatcaaatgggtcaatgatatctacatggatggaaaaaaagtctgtgggattttatctgaagcagtcagtgatatggaaagcggcaggatcagtcatatcatcattgggatcgggcttaatttttctgttcctcaaaatcattttccagctgatctccaagaaaaagccatctctgtctttcccgacggacaagctagtgtcacaatgaatcagctaatcagcagaatctggcaagaattgttcacttatctttctcacccagaaaaagcgttggacttctataaagaaaaatcattcgtattgggaaaaaccgtgtcgttcaatcaaaaaggaacgacttatgtcggtcttgcaaaagaaatcggtgatcatggcgaactgatcgtccaaacaaatgaacagaagatgagtttgtcttctggcgaaatcagtctcacatctatccgtacgcaataa

SEQ ID NO: 1538 - DNA (genomic), 912 bp, Enterococcus faecium; double-stranded, circular
  misc_feature (B) LOCATION 1...912
  hypothetical: NO
  anti-sense: NO
atatttttgaaaagtctttcggtccaagaattatccaagaactttggtcacaaacaagccctcagcgatgtcagttttagcttatcccctggcaaaatcgttggattagtaggtcctaatggcgctggaaaaacaacgatcatgaaagctattttaggactgatccattactcagatggaacaatctgtattggtgaaaatgagatttctccctctagtcataaagggttggaacaagtaggagcattgatcgaatacccgggtatctatccattcttaacaggctatgatcatctgaagttattctctgaaaccaacgatgtatctgctatcgacactatcgtgaatcagctcaagatggaaaagtacattcacaaaaaagcgaaatcctactcgttgggaatgaaacaaaaattgggaattgctcttgccttactgaaccatccgtctatcgttattttagatgagccgatgaacggtttggatccacaagcaacaagagatgtgcgaaaaatcattaccgacttggctactcagggcacctctttcttgatctccagtcacttactcagcgagcttgaaaaaatggtcgatgagctgatcctgatcaatcaaggaaagatcatcaaacaatgtacaatggctgaattgaaccaaacagcgcaagatttcatcgttatctctacaacaaatgatctagctgctcgaacgatcttgacagaagctggatatactttggaagatcctgataaaatcaagcttttaaaagaaaacgaagaattattaggaaccgtgatccagctattgtctgcacaaaatatccatgtgacagacgtccagcatctgacgaatgatttggaatcttctctattggaaattctggattcagtaaagggggaagaagaaaaatga

SEQ ID NO: 1539 - DNA (genomic), 381 bp, Enterococcus faecium; double-stranded, circular
  misc_feature (B) LOCATION 1...381
  hypothetical: NO
  anti-sense: NO
aatttattgaaaaaaaggatgatacgattgacagataatcgccctatcggatttattgattcaggtgtcggcggcttgactgtantaaaagaagccctgaaacaattaccgaatgaaaatattttatttgtaggagacacagcacgctgcccatatggccctagacccgcggaacaggtattccagtatacttgggaaatgacggattatctggtggagcaaggaatcaagatgctggtgatcgcctgcaataccgcaactgcggtggctttagaagaaatcaaagctgctctttctattccagtcatcggtgtgatccttcccggtactagagcggcagtaaaaaaaacacaaaataaacaagttgggattattcggtag

SEQ ID NO: 1540 - DNA (genomic), 849 bp, Enterococcus faecium; double-stranded, circular
  misc_feature (B) LOCATION 1...849
  hypothetical: NO
  anti-sense: NO
tttgtattgaaaatcataacaataaatgatgttgagtatgctgtatttgctgctaatgaaggtacttccaaaccacaacctcatatcatagaaacgaaatctggtactattccagaaggaaaacaactgagtttattaaaagaatatcttaagcagaatgatatttccccaataaaaggagcaacaacatattggtgcattgacaaggttcttaagcttgattcaagtaaagaaaaaactataagtgaaacaatccataaacaaaaatacttatctttaactgaagaaaatattgagaaacagcataagtttgtaggtgcaagctctaattatgggaaagaaggtctaataatacatgatgttttgaatgcatttcctcttcataatgatttaaatactattgcgatgaagattgcggtaattgatgtaacaaattcaacacatctttctcaatataagagcaggttgtctctatatgatttggctaaagtaattctggagattccaaattttgatgatcggttggcaaaaggagatcctcagttgataaatattatcgcaaggaacattggtgcagttaatatgttctcatttgcatccaagtactgtacatatcataatgtggaagtgtgtgggagagatgattactccatctttgatggtatcgttaaaaatactcttccacactatatccaaggactaactacgaataagattgatacgtggcgaagaagttttgattacgaggcatttaacgaatgtgttggaaaactacttgatgaaaataatatacatattccttttagaagaagaaagttagatcacttcttgtggtatgcgaataggtag

SEQ ID NO: 1541 - DNA (genomic), 537 bp, Enterococcus faecium; double-stranded, circular
  misc_feature (B) LOCATION 1...537
  hypothetical: NO
  anti-sense: NO
atatcattgaatgaattatggatggatatcgaaggatacgagggagtatatcaagttagtagcttaggaagagttaaatctaatcgccctaactatgtaattaataagggatacgttaacaaagaaggatttattatgaaaccatctgacaatgggaaagggtatcaaattatcttcttaagcggcaaaggttttagagatagaaggtatgtccatcggctagtagcttttcactttttaaaagaagcgtatttcgaaggtgctgaagtcaatcataagaacggagataaatctaacaatactgttgaaaacctagaatggctcagttctgatgataataaaaagcatgctagaaaaaatggattaactaacttgaaaggaccatcaaaactaactgatttgcaagctttagctatcaagcgtttatatacaaacaaattgatgagctccggagaaataatgaaactttttaatgtcagcaggcataccgtgctgaatatagcttcagggaagacatttagtttcttggaagattaa

SEQ ID NO: 1542 - DNA (genomic), 621 bp, Enterococcus faecium; double-stranded, circular
  misc_feature (B) LOCATION 1...621
  hypothetical: NO
  anti-sense: NO
gaaaaattgaaaaatgaaaaaaaagcagttatgattacaaagaaagcaggagaagatatgctgaacaatgagcaatttgaagaaaaaacaatcagtcgcaaagaaatctatagcggaaaaattattgatgttgctgtagacgaagttcgtttgccagatggaggaacttcgaagagagaactggtatttcatcctggcggtgtcgggatcattgcttttgacgaacaagatcgtctgcttcttgtcaaacaatttcgaaaacctttagaaaaagtgattttggagattccagctggaaaaatcgatccaggagaaggacaaaatcccgaaatgacagcagctagagaattagaagaagaaactggctatcgtgcgaagtcgctgagccatcttacttcgatgtatctttcaccaggttttgcaaatgaagtccttcatatttatcatgcacaaggggtagagaaggtcgagaatcctttagcacaagatgaagacgaagtactggagttgtatcatctaactcttgaagaggcgcaacaagcgatgaaagatcagttgatttgtgatgcaaagacgatttatgcgattcaatactgggaactattgaccaaaggaaagtag

SEQ ID NO: 1543 - DNA (genomic), 513 bp, Enterococcus faecium; double-stranded, circular
  misc_feature (B) LOCATION 1...513
  hypothetical: NO
  anti-sense: NO
tccatgttgaagaaagaaacaatgaagtactatctgccaatcgttttgttctttttgatgttgatagatggtcatttaacaagaatgctaggggagtggtcgaaaggcacctatatgtcaaatgcccactttctgatattggcattattatgttgcagtatggcgtttgaaaaacgttatttactgattaccacgattgttctcggggctatctatgacgcttactatattggcgttatcggtatctatgcagtagctctccctttaattgtatggttgatgtatgtaatgaaagacgttatccatgtcaacatctttactgaatttttcagtatgatcatctttgtcacgggttatgaattgtttacgatggtggtccagttgatttttaaattagcagtagtaaataacacgtattttattacaaggtttttaggacctacactgctgttgaacatgattatatttgtattattcatttttccctttaagaaattattcagtgatgaataa

SEQ ID NO: 1544 - DNA (genomic), 837 bp, Enterococcus faecium; double-stranded, circular
  misc_feature (B) LOCATION 1...837
  hypothetical: NO
  anti-sense: NO
tttaagttgaaagtacaggctatgacaaagcgaaaaggtctcatggatgtttcggaactaaacgcctatcaagtagcgtatggtaaaccgttagattatagagattatttgaactatgttggattaccttgtttgtttatgggtggcttttcttttgctttatgttactactggtggattgctttgatttgtggagtaattggaggcgtatatggctttaaagttataatgcctaaaagtattaaacgctcttatgaattaaagagtttacaggaaagaaataaatttattaacaacatgactcaaattttgaccgatgatagtaaaacagttactagagcgttatctatagcaaaacagcgaacaaaaggtgaattaagagaagatattcaaatcttagaatcacgtttacaaggtgctgataaatttcagattgctgaagcttttcgtgaaatcaacaataaatattatagtgatgttgtttttacacaatactttgagcaattggaaacagctatttacgaaggtagaaataattcagatactatgaagcaaataaagagctatcataatgatgtgaaacgtaaaacagaaggttttatgaaaatcaaagacggctatcttcaagatatgaagcaaatgatgtttattgtagctgtttttattggagctataacttttgcttttggtttttctactttctatgaaggttttgctcgatcacctatcggatgggtatttggatctatttactttttgattatggttagcttcatgaagtcatttttcaaacattattttgatgatgaaataatgagtttgggggtaagtaattaa

SEQ ID NO: 1545 - DNA (genomic), 660 bp, Enterococcus faecium; double-stranded, circular
  misc_feature (B) LOCATION 1...660
  hypothetical: NO
  anti-sense: NO
nacgagttgaacctttttcaagataatgaatacgttattacttataacggggcactcgtacaacaaacgaaatcaggtaaaatcatcgcccgtcacggactgacacatgaagatttcctagagatcgaagtgatggcacgccgtgtcggcagtcatctccattcgatcgatgacaaagcgatctacacgcctaatcgagatatcagcgcttatacgatccacgaagcaagtttagtcaagatgccgctaaaatatcgaacacctgcagaaatgacaccagacatgaacatcgtcaaaatgatgatgatcgacgaaccagaaattttagatgcagcaattgcgcgtttaccgcaaactttccgtgataaatacacaacggtcaaaagtgcgccctattacttcgaagtactaaataaagaagcaagtaaaggtgcggcagttgcgtatctcgcacagcaccttggtattgatcaagatgaaatcatggctatcggagataacgagaacgacttatccatgattgaatatgctggtctaggagtagcaatgggaaatgccgtttctcttgtcaaagaagcagcaaatgtcatcacttcatcaaaccacgagcacggtgttcctgaacagccagaangccanttaaccncggaaccctggtga

SEQ ID NO: 1546 - DNA (genomic), 2205 bp, Enterococcus faecium; double-stranded, circular
  misc_feature (B) LOCATION 1...2205
  hypothetical: NO
  anti-sense: NO
caggagttgaagataatgaaagtaaattatgaagaaaaaactgtcgttactcagcagccagagacatcccagatgaaagtcatcaaacgcgatggccgccatgttgatttcgatgaacaaaagatcaatgaagcactgatcaaagcagaaaagaaaattcacggctcattatcaccacttacttatgaaaaaattcaaatgattgcagacttggttgtccaagaaatcaaaagccggtttgctgaaaatgtcaaaatctatgagattcaaaacatcgtggaacatatattactagaaaaaaacgaatatgaattagcagaagagtacatcaattatcgtaccaaacgagattttgctcgcagtaaagcaacagatatcaacttttcgattgaaaagctaatcaacaaggaccaaactgtcgtgaacgaaaacgcaaataaagacagtaatgttttcaatacacagcgagatctgacagccgggatcgttggaaaatcaatcggactgaaaatgttgccaccacatatagcaaatgcgcatcaaaaaggcgatatccattaccatgatttggattatcatccttatacaccgatgacgaattgctgcttgattgatttcaaaggcatgctgaacaatgggttcaaaatcggcaatgccgaagtcgaatcgccaaaatctatccagaccgccacagcacaaatctcacagattattgccaatgtagcgtcaagtcaatatggtggctgttctgccgaccgaacagatgaattgcttgctccttttgcagaattgaactataaaaaacatctaaaagacgcggaagaatggatcgattcgccagaacgccaaaaagaatatgcaaaagcaaaaaccaaaaaagatatcttcgatgctatgcaaagtttggaatatgaaatcaataccttatttacttcaaatggacaaactcctttcacttcattaggatttggactaggagaaaactggtttgaaagagaaattcaaaaagcaattttacagattcgaatcaatggattagggagtgaaaagcggacagctatcttccctaaactgatcttcactttgaaaaaaggtgtgaacttaaaccctgaagatcctaattacgacatcaaacaactagcattggaatgtgcaacgaaaagaatgtatcctgatattctgaattacgataaaatcgttgaattaactggaagtttcaaagtacctatgggctgtcgttcattcttgcaagggtggaaagacgaaaatggtcaagaagtaaatgtcggacgaatgaatttaggtgttgttacattgaatttgccaagaatcgcgatcgaatcaaaaggagatcagaataaattctggcagttactgtctgaccgcttagaaatcatgaaagatgcgcttctctatcgtgtagaacgttgtaaagaagccattccagcaaatgcgccaattttatatatgtatggtgctttcgggaaacgtctttcacgtaccgattctgtcaatgaattattcaaaaaccgtcgagctactgtatcgttaggctacattggattgtatgaagttgcttcagctttcttcggtggcgaatgggaaacaaacccagaagcaaaagctttcacacttgatatcgtcaaagaattaaaagctaatgcagatgcatggggggatgaatatggttatcatttcagtgtctattcaactccaagtgaaagtctaactgaccgtttctgccgtttggatacagaaaaattcggcatcatcgaaaatatcacagataaagaatattatacaaacagtttccactatgatgtgcgtaaaaacccaacgccatttgaaaaattggaatttgagaaggattatccaaaatattgttcaggtggattcatccactactgtgaataccctatgctccaacaaaatccgaaagctttagaagctgtatgggattttgcatatgacaaaatcgggtatcttggtacgaatacgccaatcgatcattgctatcaatgtggtttcgaaggtgatttcaaaccgacagaacgagggttcgaatgtccagaatgtggaaatcatgatccaaaaacatgtgatgtagtcaaacgtacttgtggctatttaggaaatccgcaagctcgtccgatggtacatggccgccataaagaaatttcctcacgtgtgaaacacatgaaatga

SEQ ID NO: 1547 - DNA (genomic), 273 bp, Enterococcus faecium; double-stranded, circular
  misc_feature (B) LOCATION 1...273
  hypothetical: NO
  anti-sense: NO
tcgaggttgaatctgatgattaaggcttggtctgatgatgcttgggatgattatctttattggcatgagcaaggaaacaaaagcaatataaaaaagattaacaagttaataaaagatatcgatcgttccccctttgctggattaggaaaacctgagccattaaagcatgatttatctggaaaatggtccagaagaattacagatgaacatagactgatatatagagttgaaaatgaaacgatatttatttattctgcaaaagatcactattaa

SEQ ID NO: 1548 - DNA (genomic), 378 bp, Enterococcus faecium; double-stranded, circular
  misc_feature (B) LOCATION 1...378
  hypothetical: NO
  anti-sense: NO
atgtctctgaaaaggattgctctccatcgtctgcaaaaaaatgggggaaatctttcaagaaacaaaatagcaggtaccgtatttttctttctgaaccaaagatctgcgcttttttataagaaaacgaaaggtgatactcaccaaaccattttctcaaccgctcttgtgtcgaacgatcatactcctgctcataaggttcattcaacagcagatttttcagtagacaaaaaggtggtgattgaatcagaaaaacaaaaaggaggtagggttcgctatatccttgatcataaactaactgaacggttttcttatgaagaatcagctggattggacagtcgctttctgccaaacgttttagatgccgatcaactgttttga

SEQ ID NO: 1549 - DNA (genomic), 642 bp, Enterococcus faecium; double-stranded, circular
  misc_feature (B) LOCATION 1...642
  hypothetical: NO
  anti-sense: NO
aaaatgctgaaaatcaagtataataccataggaacaaactggaaggtgaaaaagagcatggcacaactattttttaagtatggcgcaatgaatagcggcaagacgatcgagatcctaaaagtcgcacataattatgaagaacaaaataagccagttgtcttaatgacaagcggtattgatacaagagatggtttaggcgttgtttcaagccgaatcggactgaaacgtaatgcgatgccgatatttgaagaaacagacgtatttgacgtaattcagaaaatggaaagcaaaccctattgtgtgctgatcgatgaagcgcaattcttaaaaaagaaacatgtcattgcttttacgagaattgtggacgaattggatattccggttatggcatttggtttgaaaaatgattttcgaaacgagttatttgaaggatcaaaatatttattgctttatgcagacaaaatcgaagaaatgaaaacaatctgttggttctgccacaaaaaagcaatcatgaatttacattatattgatggaaaccctgtttatgaaggcgatcaagtgcaaattggcggaaatgaagcttattaccccgtttgtcgaaaacattactttcacccatcaatgattacagaaggagaataa

SEQ ID NO: 1550 - DNA (genomic), 216 bp, Enterococcus faecium; double-stranded, circular
  misc_feature (B) LOCATION 1...216
  hypothetical: NO
  anti-sense: NO
agacggctgaaagataccgtaatagttgatgaacatatatcttctatcgaaaactatccagaggtgggtagcgtatccaacaggtcgggggtctataaaatatctatggttagaatgttctataaggaactgacgaaacagcgaatgtacgggtctaaatttgaactttgtagaaatgcaaaggtacgagaaatcgtagctggtgtggcaaagtaa

SEQ ID NO: 1551 - DNA (genomic), 2091 bp, Enterococcus faecium; double-stranded, circular
  misc_feature (B) LOCATION 1...2091
  hypothetical: NO
  anti-sense: NO
aggaggctgaataagatggcaaaagacttattacttgaaatcgggctggaagaaatgcctgctcatgttgtcacaccaagcatgaaacaattagaagaaaaaacagcaaaatttttagatgaaaaccaattgacttatgatacgatcgaaacgttttctacaccgcgccgcttagcaatcaaagtaacaaacattccagaacgtcaagcagacagtgaagaagaagtcaaaggaccagccaaaaaaattgctttggacgcagatggaaactggacgaaagcagctgaaggatttgtccgcggacaaggtctgacgacagatgctatcacttttagagaattaaaaggcgtggaatatgtctatgtaacgaaatacactcacggcaaagaagcgaaagaagtattgacaggtttagcagatgtcattaaaagcctcactttcccagtaacgatgcattgggcagaatacgattttgaatatatccgccctattcactggatcgtggcattgttagatgacgaagtaatcccgtttgagatcttagatgtcaaaacaggcagagcctctcgaggacatcgtttcttaggcgaagatgtgacatttgcgcatgcaaaagaatatgaagaaaaattgaatgaacaattcgttattgcttcaccgcaaaaaagacaagaaatgatcgttacacaagcaaatgaattagccgaaaaaaatcactgggttattgatctagacgaagatttactagaagaagtcaacaatttagtcgaatatccaactgtcttttctggcgacttcgaagaaaaatatctttctgttcctgaagaagtactagtcacttctatgaaagaacatcaacgttatttcgaggtacggaacgatcaaggtatgctgcttcctcattttatttctgctcgtaatggtgatcgggtaaaattggaaaatgtggttcgaggcaatcaaaaagtattgacggctcgtttagaagatgcggaattcttttataatgaagacaagaaagcttcaatcgaccaatacgttgaaaaactaaaaactgttactttccatgaaaaaatcggtagtatctatgagaaaatgcagcgggtacaagtcattgcccgtatcattggcgaacaagtaggactatctgaggaagaattgatggatctgcaacgagctgctgaaatctataaatttgatctagtaaccaacatggtaggggaatttcctgaactacaagggatcatgggcgaaaaatatgctctgctgaaaggcgagaaacctgctgtagcaacagcgattcgtgagcattacatgcctatatccagtgaaggagagctacctcagtctacagtaggttctgttttagcgattgcagataaattagatagcattttttctttctttgcagttgggatgattccaagcgggtcaaacgatccttatgccttacgtcgccaagcatacggtgtcgttcggatcatcgaatcgaaaaaatgggcctttcctttgtctgttctgcaagaaacgattagtgatgttatcagtaaagatacggatcgtttcggcattggtttatcagaagggcaacaacaggtgatcgactttatcaaaggccgtctgcgccaattattgacaacgaagaatattcgtcatgatgtcatcgaagctgttttgaatgcagaacaaaaagatctgacaaaagtatttgcagcagcacaattgttcaagcagcatcttgcagatgaagacttcaaaccatcgatggaagctttgacacgtgtcgtgaacttagcgaaaaaagcggagcttgaaaaacaatcagaagtagaccctgaactgttcgaaaatgaagcggagaaagaactgcacaaagcagtagaggcaatgaaaaaaagctttgctgaccaaacgatcaacgaaaattatgatcagcttgtaagccttcgcccactgatcgaaaattattttgatcagacgatggtcatggcagaagaaccagcagtacgtaagaaccgattaacgcaattaagtcaaattgctgccatggctttgtcgctagcaagtttagatcaaatcatcacaaaataa

SEQ ID NO: 1552 - DNA (genomic), 336 bp, Enterococcus faecium; double-stranded, circular
  misc_feature (B) LOCATION 1...336
  hypothetical: NO
  anti-sense: NO
acgtttatgaaaattattttagcgattatccaagacaaagacagcaaccgtttatcaaatgaattgattgatgcaaatatccgtgccacaaaactatcatcgacaggcggcttccttaaggctggaaacagtacgtttatcgtgggtattgaagatgaccgtgtagaagaagcattggaaatcatcaaaaaaacgtgtgaatcaagaaagcaatttgtatctacacctgttacactggatatttcgatggatgggggcgtcccttatccagtagaagtagaagtaggcggtgccacagtcttcgtcttacctgttgaaggattccatcaattttag

SEQ ID NO: 1553 - DNA (genomic), 687 bp, Enterococcus faecium; double-stranded, circular
  misc_feature (B) LOCATION 1...687
  hypothetical: NO
  anti-sense: NO
tttattatgaaaaagaacatgattgggacattattactttcaacacttcttctaggcggcttggcaacaccagcttttgctgagggtcaagcgacttcaaaaggagatattacctttactgaaccaacaaataccgttgagcctcttaaccctactgatccttcaaaaccagtagagccagcagatccggaaaatccagcaactggccagacaggttctttaacattggatgtagttcctgaattgccatttggtacacacgagattgaaagcggaacaaaaacgtatcaagtagacgcttcaaaaaacgatacaccttatctccaagtatcagatcgtcgaggtgtaggtgcagatggccaagcacaagggtggaacgtgacagtttcggtttcagattttgtaaacggttcacaagttttgcaaggcgctgaattagattttggaacatccactgttaaaagtacgtcagataacgaatccactggaccaactagtcaaactgtaactgggttgagtaaagcaagtgcagcgacaccaatatttacagcagcaaaagatcaaggtctgggaacatggctttctgtttatgatccagcaaatatcacactgaaagtgccgaaagcagcagctggaacattcacggctgatttgacttggaacctcgtggctggcccagtagcatag

SEQ ID NO: 1554 - DNA (genomic), 2151 bp, Enterococcus faecium; double-stranded, circular
  misc_feature (B) LOCATION 1...2151
  hypothetical: NO
  anti-sense: NO
tttattatgaaaaataaaaaaacgatacgtttgctagctgctacttggctgattgctccgtctgttttgtcgaccaataccgtatttgccgtagataatcaaatagctgatcaaacagtcacaacagatacgactacatccagctcagctactagtgaaacaacggattcttttacagaagacccaactggaacaactaactcaacaacaggatcgaccgagccaactgaaattgatccggctgatccatcagaaaatgaaaagccagccgagacatattcccttacaattgctccttctttgattggtaagatccaactgactgcttcgacagcggattcccctgaacagcaacctttggatattacggaaagtggaacggtagaaggtttattagcggaaacgaaggtaacttacactattacgccagctgaaggtgaacaaattgcttcagtcgctgttaatggtgccaaagaagtaaattatgatgcaaagacctttacagtaggtacgaacaatttatctattactgcagaatttaaagctggaccggatacttcaacagagaaaccaactgatcctagtgaagaagtccctagtacaccagatccggaaacgccaaacaaaccagatgtgggtaataacaacaataataatggttcaaataattcaaacaataataacaataattcgaacagcgggaattcttcgaatcaaacaaacccatctggatcgaataacaatggaaatactcagagagaaccaaaccatccaaacaatggttcatcgaatggcggaacgaacaatgcttcatctcgtccaaatacagcaaatcaaagcggtatagagaatccatcttctgcttcttctgattttgttgtaaaatcaccaattgatgctgtattgcctacaaatacaacgaatgtccaacaagcaatcgttcgagaagcattcaagcatcttggaaaaccatatgtatggggagcaaaaggtccaaatacttttgactgttctggtttgacttattacgtatatatgaaagcaaccggtcattatatcggtggctggacaggcgaacagcaatatgcaggtacgcagattccagtaagtcaggcccaacctggcgacctcgtcttctggggaccttcttccggtgttactcaccatgtaggtatctatattgggaacggacaatttatccatgcgcctcaaccaggagataaagttcgagtaacttctatttcagatttcacgcctgattttgctgtccgagtaaacttagcaggtttacctgctgcttcaggttcgctgacaggcggctcatctattttagatggattagatggctcgttccatttcagtcaaaaccaaacaactgatcagttcttgaaaaagattgcagatgatgcacaggaaatcgggcaaaaagaaggaatctacgcatcagtcatgatggctcaagctatccttgaaagtggatctggaaacagcttattatcaagcgaaccaaatcataacctttttggtatcaaaggatcatataaaggaagcagcgtgaccttcaatacacttgaacaagatagttccggacaaagctaccaaatccgcgcacaattccgtaaatatccttcttacaaggaaagtttggaagactatgccgacttgatcaaaaatggactgactggcaatcctgatttctacaaaccaacttggaagtcggaaacaaaagactacaaagaagcaaccaaatatttggaaggacgttatgctacagatcgccaatattcacaaaaattgaacgcgatcatcgaagcgtacgacctgacaaaatatgatgaaccgaaaaaagaagcagcaacaactgaagaagcaaacgctgaaatcctcaatatgtctaagcgattcgatgtgccaatcaaatggacaacagatggcgtgccaatcacaggattagaattttcaacgataaaacgcgtcaacaacgcttcttccatcttccgtgtcgcttcaatctgggatttgtggaacaattttacggcaagacagataccagaaacaactactcgtacagttaaagctgcaactgttcctgtactaaccttgttaagtttagacaaatcattctggcttgatctgcctttaaagaaatag

SEQ ID NO: 1555 - DNA (genomic), 363 bp, Enterococcus faecium; double-stranded, circular
  misc_feature (B) LOCATION 1...363
  hypothetical: NO
  anti-sense: NO
tgtgttatgaacgatacaatagcaatcttatcagattcattaattgatttagataagacgtctacagactatatgattattgaagaacaacttaaaaataaaaatccagagttcgatattcaagaaaaatcattgcgtattgaattaccaaaatttaaacaaaaaaaattaataactattctctttgagattattgaacgatatgggcttacttattatcaaatttggacggataagaaagatggccaatatacaaaaggggtaagcatagaagccgttagagaagacgatcaagtaagtattaaagcagttcaacccttaatggggtataacgaagaattattgaattgtttaaacgtctag

SEQ ID NO: 1556 - DNA (genomic), 435 bp, Enterococcus faecium; double-stranded, circular
  misc_feature (B) LOCATION 1...435
  hypothetical: NO
  anti-sense: NO
ttttctatgaagatggacgtaattagtctagttggcaaactgaagcaaaaatataattcagctaatccctttactatttgcgaaaaaatggatattcagattaggtatgttccttttttgaataatccaaagggacaatttcaagaactgttagggcgttcggttattcttctaaatcacgaactaaagtattctgaagaacggttctatatttgtgctcacgaactaggtcacgcaatttttcatcaaggtttatctagttattatgtctctactcgatcctccagaagcaaatcagaaagcgaagcgaattgctttgccgccaatcttattatttctctttataaagaagataatgatcaataccctagaaaaattgaagatttaacaaatttgtatggacttcctaaaaattcatatagatttttaatttaa

SEQ ID NO: 1557 - DNA (genomic), 510 bp, Enterococcus faecium; double-stranded, circular
  misc_feature (B) LOCATION 1...510
  hypothetical: NO
  anti-sense: NO
acccctatgaactatgacgcaaagcagcccccggcaaacctggccgattccatccagcagaaagaaaccgtccaggcattatacgacctgttggataaaaatatggccgacttcgatgcaagtctggctggcatggataaagctgaaaccgctgacctgaaagaagtttctgatacgcgggaaatatacgacttcattcgataccattatggcgaatttggacagcgtgaagcagaacttttgctccgcatggaaaatcccctgaatttcatagtggaaaactggccctgccataatcttgaaacgctggctatgaattatctggcggataaaacgattaaggaaccgaacaaaaaggaaatgccgcagtccggccatgacacgaaagatgctgaaaaaccctctattttgaaacagattaaaaccaaccagggacagatcaagccaaacagacaggaaccccccctttttttttcgggcaggcccaccggggggggggcccccctttaa

SEQ ID NO: 1558 - DNA (genomic), 558 bp, Enterococcus faecium; double-stranded, circular
  misc_feature (B) LOCATION 1...558
  hypothetical: NO
  anti-sense: NO
agatatatgaagaaaatgagtatagaaaaacaggaatgtttgaagcgattgacggatgaagctggaattattagcgcgttagcaatcgaccagcgtggtgctttgaagaaaatgatcaaccaatataaagaagctacatcagaagatatcatccaatttaaacagatggtttctcagtacctgactccgtatgcttctgctattttactcgatccagaatatggtctgcctgcagcagcgcttcgagagaaagaatgtggcttgttgctagcttatgaaaaaaccggctatgatgcgaaaatgccgggaagattacctgatttattgaatagttggtcagtgaaaaggttaaaagaagtgggtgcggatgcttgtaaatttttattgtactatgacgttgatgaaccagtagagattaatgtgcaaaaacaaatagttatagaacggattggttcagaatgcgaagcagaaggcatacctttctttttagagatcctttcttatgatgcaactattggcgatccgtcttggtctagcactagcaatgatcagttataa

SEQ ID NO: 1559 - DNA (genomic), 561 bp, Enterococcus faecium; double-stranded, circular
  misc_feature (B) LOCATION 1...561
  hypothetical: NO
  anti-sense: NO
aacaatatgaaatcattctggccgaccctccgtgggagatactcacaaaagggggtgcagggagcggcagaacgtcactacgccaccatgagcatggaggatttatgctcactgcctatcagccgttttgctgcgccggactgcgcgctttttctttggagtacattcccacagcttccagaagcactgcatctgattcgtgcatggggattcacctataaaacagtggcttttgtctggttaaagcaaaaccgcaaatcccttacctggttctatgggcttggattctggacgcgcggcaatgcggaagtgtgcctgctggctaccaaagggcatcccaaacgccgccgggccgacatccatcaatttattatctcaccgattgaagcccatagtaaaaagcccgatgaagcacgggaaaaaatcgttgctctgatgggcgacctgccccgcgtcgaactgttcgcccgccagagagtccccggctgggacgcatggggcaacgaggtagaacccagccccggactggcggaggggctggcccctgaaaatccaacgtaa

SEQ ID NO: 1560 - DNA (genomic), 618 bp, Enterococcus faecium; double-stranded, circular
  misc_feature (B) LOCATION 1...618
  hypothetical: NO
  anti-sense: NO
gcggatatgaatagtaatagggggaataaaatggaatacaatggatcaatgagaattgtacaaattatattttggattacatcgggaattgtgatcataggaggagtttttttgatgttgccaagcttaatatttcctttctttgcattaatctcacctaaaatacccgaaccggaaatcacctatggagaatttccatttaggattgaatacgaactagatggacagattaacataattgaagatactgtcatagctgagtttaacgggtgtgagttcagcgcaggttctatgaaaagagaacgaagatggagaagtagattagctagtggtagagaagatctaccttttggggacgatctaggaatctattttagtcgaggaagtgcgcaatattatatgggggaaaatgtacaatcaatgtcattaaaaccacatatagcccttagaaatctcgaggaaggttttaaaagagaggtagactttatattaggagaaagtggatacataagaactgtacttaatttcggagaagcgcaagaagttttgacacaatacggaattaccttaatcaactgggaaatatctgaaccgattgttaacaattttggtgattag

SEQ ID NO: 1561 - DNA (genomic), 639 bp, Enterococcus faecium; double-stranded, circular
  misc_feature (B) LOCATION 1...639
  hypothetical: NO
  anti-sense: NO
acccacatgaaaaaaatcgaacctattccaccttctcttcctcttcttacaaagggagagttttatttagaagatgaggagatcttctctggtcttctgatcaacgggggtgaccaaagctatctcgatgccaaaaatatggtattaagagagagtcatatccaaaaacttacgatgcaaaaaacagttttacgtcattttgaatgcagtaatgtcatttttgaaaaatgtgatttttccaatctggagtggattggtggcagtttccaccaagtcgtgtttcatcaatgtaaattaacaggtacgaattttgccgaaagttatcttcgagactgtactttcactgattgtattgcttcgatggcttcctttagtagtacaaacttgaaagctgtctccttcgatcattgtcaattagaagacagcgaattttatgaggtcacttggaaaaacctttttttgtctgacaatcagttgaccggttcgaactggtttcgaacttctctgaagggattagactttacgactaatttcttcacagcaatcgctttatctcaagattctttggcgggactaatcgtcaaccaagagcaagcacttgtgatcgcccaagcccttggtttgcagatcaaagactag

SEQ ID NO: 1562 - DNA (genomic), 732 bp, Enterococcus faecium; double-stranded, circular
  misc_feature (B) LOCATION 1...732
  hypothetical: NO
  anti-sense: NO
caaaacatgaaacaattaacagtagacgaagcagcaaaagagatattagcttatcagcaaattacatttttgaccggtgcaggggtatccacaccttctggagtgccagactatcgatctttgtcaggaatctaccacgggatggagcagccggaatacttgctgagtcatcaagcaatggtgaatgaaccggataaattctatcaatttgtcaaaaagatttatcatcctgaagcaaaacccaatatcattcatttggaaatagcacatctagcgaaagaaaaaaatgtttgggttgtttcccaaaacatcgacggtttgcacgcaaaggctaaaagcccgcaactcgtcaattttcatgggagtctgtatcaatgtcattgtcgaaaatgtcaacaaacggtagactggaaagaatatcttcacagcgacaaacatcaagcatgcggaggacaaatacgcccagacatcgtgttatatggtgaagggtttcaagatggagtcatggagcaggcggcttatgccgtcagccaagcagagctgatcgtcattgttggaacgagttttcaagttcatccgttttgtgatctggtacagtttcgccagccgtcagccaaaatcttagtaatcaatcaaacgcctgtttatttagcggagccttatacgtttattcaagaagacggagcggttgttttcaaaaaaatacaagaattaggagcagattatgactga

SEQ ID NO: 1563 - DNA (genomic), 1734 bp, Enterococcus faecium; double-stranded, circular
  misc_feature (B) LOCATION 1...1734
  hypothetical: NO
  anti-sense: NO
gtgaacatgaataatctattgaactatcaattaccagtggcaaactgggtagaaaatatcacagaatggtttacgacaactttttctggcctattttcatttttacaaacgattggacaggcagtgatgtcggggattacaaatttactgttagtgattccagctcctttgtttatcttgttattgacggtagcagctttctttatttctaagaaacgtccaggacttacgttgttcacattaatcggtctatggtttatttataaccaaggtctatggaatgatttgatgaatactgtcacacttgttcttttatctagtgtgatctcgatcatcattggggtaccattagggatcttgatggcaaaaagcagtaaagcccaaagtattatcaaaccgatccttgactttatgcagacaatgccaggattcgtttatttgattccagcagttgcatttttcggtatcgggatggttccaggggtatttgcctcagtcatctttgctctgccaccaaccgttcgttttacgaatttagggattcgacaagttcctaaagaattagtagaagcttctgattcattcgggagcacaagtcgtcaaaaactattcaaactagaattgcctttagctaaaagtacgatcatggcagggatcaatcaaacaacaatgctgtcactttcaatggtcgttattgcctctatgatcggtgcacccggcttaggacgcggcgtattatcagcattgcaaagagcacaagtcgggaatggatttgtcaacggggttgcattagttatcttagcaatcatcattgaccgttttacacagcatttgaaccagccaaacaataaaaaagctgcaggagcaacaacacagaaaagtaaaaaacgtcaaggactgatcattggtgctgtagtagtagtgatcttaggtgcgattggtatagggagtttttcatctgccaaagaaacaaaacgtatcaacttatcttatgttgaatgggatacagaagttgcttcaacaaatgtagtcggtgaagtattgaaacaaatgggctatgatgtaacgatgacgccattagataattcaatcatgtggaaatctgtttcaaatggcgagtcagatgccatggtttcagcttggctacctaaaactcatggttcacaatatgcacaatataaagatcaagtcgaagacctaggtgccaatttgacaggagcaaaagttggtttagcagtgccagcctacatggatgtaaattcgatcgatgagttaaccgatcaggcaggtaagaaaatcataggaatcgagccaggagctggtgtagttacggctgctgaaaacacgatccaaaaatatgacaacttgaaagactggaaagtagagacatcttcttcaggagcaatgaccgttgcactaggtcaagcgatcaaaaaacacgaaccaattgtagttacaggatggacacctcattggatgtttgccaaatatgatctgaaatacttagaagatcctgaaaacggaatgggaagcgaagagcagatccatacgatggttcgaaaaggattgaaagaagaccagccagaagcttacaaagtattagacaatttccattggtcagaaaaagatatggaaaaagttatgttggaaatcaacaatggaaaagatccacagcaagcagcaaaagactggatcaaagagaaccaagaattagtcgaaagctggaaaaaataa

SEQ ID NO: 1564 - DNA (genomic), 969 bp, Enterococcus faecium; double-stranded, circular
  misc_feature (B) LOCATION 1...969
  hypothetical: NO
  anti-sense: NO
tttgtaatgaacaagaaaattattgggattgatttaggtggaacaacagcaaaatttgcaattttaacaccagaaggagagattcaacaaaaatggagcatcgataccaatattttggatgatggcaaacatatcgttcctgaaatcatcgaatcaatcaaccatcgattgaatttatataatatgaaagccgaagactttattggaatcggtatgggtactccaggaagcgtggacagtgacgctggaacagttattggtgcatataacttgaactggacagaagtacaatttgtgaaaaaactgattgaagcagggacaggaatcaaattcgctatcgataatgatgcgaatgtggctgctttaggtgaacgatggaaaggtgctggagaaaacgatccagacgttgtattcgttactctaggaacaggtgttggcggtggtatcgttgctggcgggaatttgatccatggcgtgagcggagcaggcggagagatcggccatatcactgtggatcctgaagggttcgaatgtacttgcggtaaacgcggatgtttagaaacagtatctagtgctactggtgtggtacgtctaggtcgttacttggcagaagaatacgcaggagattcaaaactgaaagcaatgttagataacggtgaagaagtaacaagtaaagatatctttgaaatggctcaagaagacgatccgtttgcattgatggttgttgatcgcgtatgcttctacttaggtttagcttgcgccaacttggggaatacattgaatccgtcaagtattgtgttaggcggcggagtatcggcggcaggagaatttttacgcagccgtgtagagaaatattttaaagaattcactttcccacaagtaagagaatcaacaaaaatcaaattagcagagcttggaaatgaagctggtgtcattggcgctgcctcattagccttgaaatttgcttaa

SEQ ID NO: 1565 - DNA (genomic), 1464 bp, Enterococcus faecium; double-stranded, circular
  misc_feature (B) LOCATION 1...1464
  hypothetical: NO
  anti-sense: NO
ctgacaatgaaacaacagatttacaatactgcactttattttaggttaagccgagatgatgaattacagggcgaaagttccagcattaccacacaaagaagtatgttgcgtctatatgcaaaagaacatcatttgaatgtgattgatgaatatattgatgacggctggtcgggaacaaattttgacagaccgagttttcaaagaatgattgaggatatagaggcaggaaaaatcaactgtgttgtaacaaaagacttatcacgacttggtagaaattatattatgacaggacaatatacagaattgtattttcccagccataatgtccgttacatagcgattgacgacggtgtggacagcgaaaaaggcgaaagtgagattgcaccatttaagaacatcatcaatgaatgggtggcaagagatacgagccgtaaagtgaaatcagcctttaagacgaaatttgcagagggtgcgtattatggggcttatgctccgttaggatataagaaacaccccgacatcaaagggaaactgttggttgatgaggaaacaaaatggattgttgaaaaaatcttctctctagcctatcaaggttacggtagtgccaaaatcacaaaaatactgcgagaagaaaaagtcccgacagcgtcttggttgaattttacaaggtacggtacttttgctcatatctttgagggaaagcccgaaagcaagcgttatgagtggacgattgctcatgtaaaggcgatattgaaaagtgaagtctatatcggaaacagcgttcataatcgacaatcaaccgtttctttcaaaagcaagaagaaagtacgaaagcccgaaagcgaatggtttcgagtagaaaacacgcacgaaccgattattgacaaggaagtgttctatcgtgtgcaggagcagataaaatcaaggcgtagacagacaaaggaaaaggcaacgccgatatttgcagggcttgtcaagtgtgcggattgtggctggtctatgaggtttgcgacaaataaggcaaataaaacaccgtatagttattattcttgtagtttctacggacagtttggcaaaggttattgttctatgcactatatccgctatgatgtgctgtatcaagctgtattggaacgattgcagtattgggctaaggcagtacagcaggacgaagaaaaggtattgaacaaaatacagaaagtcggcaatgcagagcgaatacgggaaaagaagaaaaaggcaagtgccttgaagaaagccgagaaccgacaaaatgagattgaccgtttatttgcaaaaatgtatgaagatagagcctgtgagaagataacggaacgaaacttcatcatgctgtcggggaaatatcnaaaagagcagatagaacttgaacagcagataaccaacctaagagaagaattaagtaaaatggaacaggatatgataggtgctgtaaaagtggattga

SEQ ID NO: 1566 - DNA (genomic), 813 bp, Enterococcus faecium; double-stranded, circular
  misc_feature (B) LOCATION 1...813
  hypothetical: NO
  anti-sense: NO
tgtcaaatgaatgacgtcttaacattggaaaatctccatcatacctttgaaaaaggaacgatcaacgaaaatcatgtcctgaaaggcattaatctttccttagatcccggcgacttcgtgacgatcatcggtggaaatggggctggtaaatctactttgctgaacagcatcgccggtacattttctgtcgatcagggtcaaattttattgaatggaaaaaatatcacgaaaaaatctgttgtcgaacgttcgaaatccatcagtcgcgtattccaagatcctaaactagggacagccgttcgtttaacggtagaagaaaatcttgctcttgctatgaaacgaggaaaaaaacgcggcttcttccgtggtgtcaaaccacaagaccgaacatttttcaaagaccagctggttcggctaaatttggggttggaaaatcgtttatcctcagaaatcggtttgctgtctggaggacaacgtcaagctattacgttattgatggccacattacagcgtccagaactgatcttattagatgaacacactgcagcgcttgaccctgctacttccaaaacggtgatggaattgacagaaaagctgatcactgagcagaatctcactgcttttatggtcactcatgacatggaagacgcgatccgctatgggagtcgactgatcatgctgcatcaaggaaggatcgtcgtagatatccagcaagaggaaaaacagcagctcacagtgccccaattattagcgttgttcaaacaaaacagcggcacggcattaaaagacgatcaagtacttttatcttcataa

SEQ ID NO: 1567 - DNA (genomic), 636 bp, Enterococcus faecium; double-stranded, circular
  misc_feature (B) LOCATION 1...636
  hypothetical: NO
  anti-sense: NO
cctaaaatgaatgttgaacaaagtatcgcaaaagacttattagaaattgaagcagtatttttaaatccaagtaatccttttacatgggcaagtggaatcaaaagcccaatttactgtgataaccgaatcacgatgagctatccaaaagtccgaaaagagatcgcaaaaggattagcaagcaaaatcaaagaagcttaccctgaagtacaagtgattgctggaactgcaacagcaggaatccctcatgccgcatgggtagcggaaatactggatttgccaatggtctatattcgaagtaaggcgaaagatcatgggaaaggtaaccaaatcgaaggacgtatatttgaaggtcagaagatggttgtgatcgaggatttgatttctacaggcggaagtgtcttggaagcagctgaagcagcaaaaagagaaggtgcggatatccttggtgttgcggctatctttacgtatgagttgccaaaaggaaaagcaaatttcgaaaaagccgaaatccctcttatgacgttgaccaattattctgtattgattgaagcagctttagaagatcgttatatcgatgagcaagaattaactctgctaaaagaatggaaaaaagatcctgaaaattggcagatttaa

SEQ ID NO: 1568 - DNA (genomic), 1011 bp, Enterococcus faecium; double-stranded, circular
  misc_feature (B) LOCATION 1...1011
  hypothetical: NO
  anti-sense: NO
gaaaaaatgaacttgaagaaagtgggtgttatttcattaacttttctgaccatctcttttatgggtattttgatgtgtgtgggtttgttgtttggtgaagacagtgagggaaatggtagttctggcacttctcctggcggaactagtgtctcagaagaagtattgaaacaccgtgcaatggtggaaaagtatgccaaagaatcggatataacagagtatattccaattcttttggcgattattcaagtggaatctggtggcacaatggaagacgttatgcaaagttctgagtcagccggattaccacctaattcattaagtaccgaggcatccatcaaacaaggctgtctctattttgcgtctttggttaagcgttccaaagaactagggtgtgatcaagatagtattattcaggcctataactatggtggcgggtatctagatcatgtcgggaaaaacgggaagaagcatagttttgctttagctgaatctttttcaaaggaaaaatcaggtggtcaaaaagtcgattaccccaacccaatcgcgattaaggaaaatggtgggtggcggtataattatggcaatatgttttactgtttattagtgaagcaatacctaactacaactcagtttgatgacaaaatagtccaagaaatttttgatgaggcatttaagtatgaaggaacggcctatgtgtttggtggctcaagtccagaaacggggtttgattgtagtggcttgacccaatggtgttatgccaaagttgacctgaaacttcctcgggtggctcaggatcaatatgatgccatgactcatattgatctaaaagatgccaaaccaggtgatttagttttctttcattcaacctatgatgccggtacttatgtgacccatgtgggcatttacgcaggggagaatcgcatgtttcatgcaggagatccagtggggtggacgaatctaacggaaaactattggcggcagcatcttatcggagctggccgatacaaataa

SEQ ID NO: 1569 - DNA (genomic), 768 bp, Enterococcus faecium; double-stranded, circular
  misc_feature (B) LOCATION 1...768
  hypothetical: NO
  anti-sense: NO
gaaaaaatgaaaaaaatgtatacgattggccaagtatcggaactatttgatttgccaaaatcaacgatccgctattgggatgaacaaggattaatccgttcaagtagacaagaagagaatgattatcgattgtttgatatcgatgatatttttatgctttatgatatcgttttttatagaaaattagatataccgatcaaacagatgaagaatttatatggaaaaacattgacggagttatatgagacacttgatgaaacagaaagaagaatccataaagaactggtggtgatgaaacaaaaacaaaaagagataagggagcgaaaaaaacagttgaaattgatgatcgatacaaacgaggaagaatttcctgtagaagagatcccttttgactgtatgatctcaacggagtttgaagatattgtggaaatcaaaaaatttctacctaactattcaagctttgggatgatgagtatgccagcttccagttcacagacgatgtatggattttttatcgaccctagtgaagtacatttatttactcaagacgtgatttgggagaaaaaagatacggctgtttatcgtcgattcttattgaaatccgagatgaaccatgcggaacgtaataatattttagaaatcagagaaagaatgtatgaaaaaggatggaaaacaggagaagtgatcggccagtatctattgacgaatacggatgaaaacaatatcagaactgaatattatcatgcatggatagaaatgaaaaaatag

SEQ ID NO: 1570 - DNA (genomic), 891 bp, Enterococcus faecium; double-stranded, circular
  misc_feature (B) LOCATION 1...891
  hypothetical: NO
  anti-sense: NO
atgaaaatgaatgaaaaaattcgtaacatgactatcggtttattttgtgcagcaacagtaagtatcctgctgacaggctgcggctcaggtgaagcaacgaagcaatcggctgcggcagacgactctttagatacgattatagaaaaagccaaggaagaaggagagattgccagcttgggaatgccggatacttgggcaaattgggtaggcacttggaacgaccttgaaaaagaatacggcttaagtcacgtggatacggatatgtccagtgcagaagaattggctaagtttgaatcagaaggaaaaaatggaaccgccgatattggtgatgtcggtatcagcttcggtccgttggctgaaagcaaagagttaaccttaccttataagaccaactattgggaggaaattccggattgggcaaaggatgatgatggggattggttgttaagctatacgggaaccatttcctttatcaccgataaagagaatgtgaagcaagcaccgactagctggaaggagctgcaagagggtgactatcaagttagcgtgggggatgtgacgattgccaaccaagcacaatttgctgtattggctgcggcgattgccaacggaggtgacgaaaaggatattcagccaggtctgaattactacaaaaaaatggcagaaaaaggccgtttgtccaccgttgatgccagcgtagcaaatcttgaaaaaggtgaaatcgatgtggcagttgtttgggacttcaatggactaaattatcgtgaccaaattgactccgagcgttttgaggtaactgtgccaacagacggctccatcattagcgggtatacaaccttaatcaataaaaatgcccctcatcccaatgcggcaaagctagcacgggcataa

SEQ ID NO: 1571 - DNA (genomic), 906 bp, Enterococcus faecium; double-stranded, circular
  misc_feature (B) LOCATION 1...906
  hypothetical: NO
  anti-sense: NO
atgaaaatgaaagaaaccttgcaattaggaaaaacaaaattccctatgcgtggtaatttgccaaaccgagaaggcgagtggcaaaaagaatgggaagaaaatcgaatctaccaaaaaagacaagagttgaacgaaggaaaacctagctttgttcttcatgatggacctccatatgccaatggtaatatccatttaggacattcattgaataaaatcagtaaagacattatcattcgttcaaaatcaatgtctggctatcgtgcaccatatgttccaggatgggatacacatggattgccgattgaacaagtattggctaataaaggcgtgaaacgtaaagaaatgtccatggcagaatacttggaaaaatgtcgtgaatatgcactttcccaagtagataagcaacgagcagatttcaaacgcctaggagttgcaggagattgggaacatccttatgttacattagatccttcttatgaagctgcacaagtacgcgtatttggtaaaatggctgaaaaaagctatatttacaaaggattgaaaccaatttactggtctccgtcaagtgagtcttctttagcggaagctgaaattgaatataaagatgtaaaatctccatctatttttgtagctttcaatgtcaaagacggcaaagatattcttgatgaagatacagcttttgtcatttggacgacaacaccatggacattgccagcaaaccaaggtattgctgtaaatccaaaatttacgtatgtattggtggaagccgatggccgtaagtttgtcgtancgaaagaattgctagaaacagtccaatcagaaatcggttgggaaaatgtaacagttctaaaaaaatttgctggacaaggagatggaatatatgactgcaagtcatccattctatga

SEQ ID NO: 1572 - DNA (genomic), 801 bp, Enterococcus faecium; double-stranded, circular
  misc_feature (B) LOCATION 1...801
  hypothetical: NO
  anti-sense: NO
atagaaatgaaaaatgaaagaggaggagaagaattggaaaagatgatcgaagtgaaacatctaagtaaaagctacggcagcaaactttctcccgtcaaagccttagataatatctcattcacagtagaagaaggcgagtttgttgggattatgggcccaagtggtgcaggaaagacaacgctgatgaatatcttgtccacgatcaatttgcctacgatgggcagtgtctcgatccaaggaaaagaaatcacaaaaatgaaaaacagtgagctcagtgactttcgtcgaaaaaaactaggattcatttttcaagagttcaatttgatcgataccctaaatgcaaaagacaatatcctattgcccctagcagttgaacggatgactaaagaggaaatggaaaagagagtaagacatgtagctcaattgttgaatatagaagaactgctcaaacggtatcccgatgaactttctgtcggacagagacaacgaattgcagctgctagagcacttgttgttcagccacaagtgatttttgcagatgaaccaactggctctttggactcgaagtcggctacagaattgttgaactacttgaagaccatgaatcaaaaagaaaaagcaacgatactgttagtcacccatgatccatatacagcaagctactgcgatagaattttatttattaaagatggtgtgattttttctgaagttgtcagaagagggacaagaagagagttctttgagaaagtaatagacatgcaggcgacgattggcggaggaggaaaaatgaatgctgtataa

SEQ ID NO: 1573 - DNA (genomic), 780 bp, Enterococcus faecium; double-stranded, circular
  misc_feature (B) LOCATION 1...780
  hypothetical: NO
  anti-sense: NO
gaagaaatgaaagcgcaattatttcaagtttataaaaaaatactcgtttcttttgaagtcgaaggaattggaatcagctctcctggagtagtgaataatgagaaacaggtgattgagggaatcagtgcgattccttatattcatggatttaatattttccgagatttggaaactctgtttcaactcccagtaacgattgaaaatgacgccaactgtgccggaatggctgaattttatgaaggtgctgcccgtgattatcaagatgttgcttttgttgtggcaggaactgggattggcggggcgttgttcacgaaaggacaaatcaataaaggggcacatctttatggtggagaatttgggttgatgttcttaaatggcgataagacattcagtaaacttggtacagcggtacagatggcttggcgttattgtgaacgcaaaggtctcgataaaaattcttataccggaaaagatgtctttgaattagcagaaactggagatgcaatagcaaaagaagaagttgagagtttttatacgtatcttacaaagggattattcagtattcaattttcgtttgatccagaagtgatcgtattaggcggcggtgtttctgcaaaagaagggctcattgatgagatcaaaagccgaatgaagaagctgacagaacaattcgatctgcatgatttcgaaccgcagattttattatgtgaatacagaaacgatgctaatcttgtaggtgcagcagcaaactatctcgctgtacgtcaaggggagaattaa

SEQ ID NO: 1574 - DNA (genomic), 1368 bp, Enterococcus faecium; double-stranded, circular
  misc_feature (B) LOCATION 1...1368
  hypothetical: NO
  anti-sense: NO
cgggaaatgaaaaaaatatcaacatatgaaaataagaaagtgcttgtcttaggactcgcaaaaagcggagtaagtgcggccaaattattacatgaattgggcgcacttgtcaccgttaatgatggaaaaccttttgacgaaaatccggaagcacaagagctgctttctttagggataaaagtaataacaggtagtcatccaatcgaattgttggatgaagaattttcattgatggtcaaaaatccagggattccctacagtcatcctttagtagcaaaagcccaagaaatgggtattccggtaattacggaagttgagctagcttacgaagtagcggaatgcccaattattgggattacaggaacgaacggaaaaacaacgacaacaacgatgacaggactactactgaatgcaggagcagatcaaggaattgcacgtttagcgggtaatattgggtatccagcaagtggtgtagcgcaagaagcaaaatcagaagataaaattgtgatggaattgtctagcttccaactcatgggaatcacagatttccgccctcatatagcggtgattaccaatatctatgaagcacatattgattatcatggtacaagaaaagaatatgtcaaagctaaatggaaccttcaaaaaaacatgacagaaaaagattatctgatccttaactggaatcagtcagaactacaagaattagcgcaaagaacaaaagcacgcgtactgcctttctcgacaaaagaagtgttggaagacggtgtgtatgctgacgattactcaatatactataaaaaagaaaaaataatggaaatatctgaacttggcgtaccaggtaagcataatgtagaaaatgcactagctgctatttctgtagcaaaattgtatggtatatcaaatgaagctatacgagaaacgttgcattttttccatggcgtaccacatcgtacgcaatatgtaggagaaatccaaggcagaaaattttataatgattcaaaagcaaccaatattttagcgactaaaatggctctaagtggatttgaaacgtctaaggtcgtgttattggctggcggattagacagaggaaatacatttgatgaattaattccttcattaaaaggaatcaaagcaatggtcgtatttggccaaacaaaagaaaagttgatggatgctggaaaaaaagcaggcatcgagacaatagtaacagccgattctgtagaacaagcagttcctttagcattagaaaacagtacagatggtgatgtagttttattatcaccagcgaatgccagctgggatcaatacccaaattttgaaactagaggaaacagattcatggaagctgtgaaccgattaaaatag

SEQ ID NO: 1575 - DNA (genomic), 3135 bp, Enterococcus faecium; double-stranded, circular
  misc_feature (B) LOCATION 1...3135
  hypothetical: NO
  anti-sense: NO
tcaagaatgaaaccgaaaaaattacaacttaaaaattttggtccttttatcaatgagaccgtagatttttcacgtttgacagaagcaccgctttttttgatcagcgggaagacaggagctggcaaaacgacgatttttgatgggatcaccttcgcactttttggtgaaacttccggaagacttcgctctggaaaagagatgcgttctttgtttgctacaccagacgaagaaacaagcgtgactttttcttttgaacatcagcagatgagctatgaaatcgaacgaaaaccagaacaagttttagcaaaacgaaaaggaaacggaacaaaaaaacaggcagccaaagtaacgttgaccatttttgatgggaaaggaaaagaaataaaacaaatcacaaaacgtacagaagcagatcagttgatcagagaactgatgaatctcgatgcgaaacagttttctcaaatcgttttactaccccaaggagaattccgtaattttttggtttcatcaagcagtgataaagagactgttttacgtcatttattcggtactcaatttttccaacagttcaatgagcgattaaaagaaaaagcaaaacaacagcaacaaaaattggatcatttagagcaagagctgcatcttctgcaaaaaaggtttgttttagtcaaagaagaggaaccagcagcagggtttgaagccgttttagcccaatggacaaaccatcaggcaatactcgaaaaacaaatcacggaagaaaaagaagctctaacggaacttcaggaaaaacaaaagcaactagaaaattcctactatcgttttgaaagcttgaaaaaaagttatgaagaaaaaacgatattaataaacaagcaaaaggaattagctgctcaaaaagacgaaatagaggaaaagaaacgatggattgggtattatgaatttacgcaacgattagtcgaaccaatccagcgcctacaagaaataaaagttgaaaaaatagaactgtcacaaaaaagtagtgagcaaacaaagaaactagcgatgactacgcagaattatgaagagtggcaaaaaaatgaagcaaaccgcgtacgccgacaaacaaaaatcaaagaagctgctcaaaaactgcaaaacaaacagatgatggtgccaattgtcgaatccttacgtagtaaaaaacaagacgcagaacaattaacaatttcattggataaagaagaattgaatgccgagaagctgtatcaaaatctcgctatctatcaggaaagaactcgaattcttcaagaaaatttactggatcaggaaaaactgcaagaagatcgtcttgcttttggacagttaaaatatctagatgaaaagcagcaagaaatagaaaaacaaaaagcaaaagacactgggtcgctcgcacagataagagaagaactcaaaaaagcaactgaagaaataacaaaaaatagtcagctattgaaagaacagacagaacaagcagaacagctgaaaagccaatgggcaaagcagcaaattgctcgtcttcagctttttttgcgtccaggggagccatgtcttgtttgtggatcaacggaacaccccatacaacaattaaaacacgaacagccaaataaggaagatatcttaaaagtagaacaacaactggcagaagctgagtctgctgtagaaagaactcagcaaatcattgccaaaagtgaagcacatgaaaataatcttcaacaacaattatcagatttagaacaaaaaatcatggcaacgaatatacaattggctgaacaagaagaacacttgcaacaggctttgaaaaaggcatttcctgagataacagaacaaaaaacaaaaacaactcttgtagtaatcgaacaatctttagatagacgaaaaagcaagatggccaatgcaagaatagagctggaagaaataagacaacaagcagaaaagctcgaacaacaattagctgtctacaaacagcagcagacagaaaaaaataatcagctccagcaactgcaaggagaaatcaaaagtttagaacaacaattgcaagatacggatagtaactgtttagaagaggagatacgacgacttgaaaaacagttagaagaagactcgaatcaactagctgttgagcagaaagcaggagtgcaattgttgcaagatcttcatacgcttcggacacagcttgatcttcaacatgaacaaatagaaaaaatagatgaaaaaatagaaaaggaacaagaaagaatagctaaaaagttagaaagccagtcgtatttttcaacaattgaagaaatctgtgcatttgcacaacagcaagcacaatataaagaaaaccaacgtacagttacttcttatcatgaagagcaattagtgacagctgaccggctgcgtcaattagaaaatatccagctaactgagacattcccagatacagaagagatcagccaacagttagaagaaataagacgtatgatcgaaataaagcaagaaaagatatacggtttacaagaacaaaaaattagtaatcaaaaaatctacgatgaatgtctttcgatttatcacacaagccagacgaaattagatgagcttacgcaattacagcagctttcgcaaacattcaacggagaaaatcctaagaagactagtttggaacggtatgtgcttcaggtttatcttcaagaagtgttacaagtagcaaatgatcatctccaacgtttaacgaaaaatcgttatcaatttgagctagcggataccattggcagttatcgagggaaaaccggattagaaatcaatatctatgatgatcaggcaggtatgtctcgaagtgcgcataccctgtctggcggtgagagttttattgcagcactttctttagcattagctcttgccgatgtgatccagacacaagctggtggtgtagcaatcgatgcattgtttattgatgaaggatttgggtcattagatgaagaagctttggaaatggcaatggaagctttagaaacgatcgaaagtgaaggaagaatgatcggcatcattagtcatgtaagagaattgaaagaacgagtattacaacaaataagaattgatacagaaggtagcggacaaagcaaaatacgctatcaacttggataa

SEQ ID NO: 1576 - DNA (genomic), 534 bp, Enterococcus faecium; double-stranded, circular
  misc_feature (B) LOCATION 1...534
  hypothetical: NO
  anti-sense: NO
aaaggaatgaagataaaggagcgacgacccttgaagaaaaaacagacaaaggaaaaaacgattaatcgcgtattgcttggcttgatcgtatttttattagcggtcatcgtgatcagctcgattttttacttgcgttccagtcgtccggcagtccaggcgaaaaaagaagcagtagaaatcgcaaagaaatatgcaaatctcgaggaagccgatcatttttactggtttactcgaaagaaaacgtacttttcattgacgggtacgaatgataaaggaaaagaaatcgccgttatcattcctaaatctggtgaaaaagtaaaagtattggatcaaacgaaggggttgactgaaaacgaagcgaaacaaacaattgctacagctcatcctgaaatccaaatcgaaaaagcagcattaggaatgtacgatgatcagcctgtatgggaagtagtaggaaaagaaacaaatggaaaattgaattattacctgattggttttgaatcaggagatgaagtcaagacaatcaagggaatttaa

SEQ ID NO: 1577 - DNA (genomic), 474 bp, Enterococcus faecium; double-stranded, circular
  misc_feature (B) LOCATION 1...474
  hypothetical: NO
  anti-sense: NO
caactgatgaagtattctctgcaatttagtgatgcaatccatgtacttgcctatattgaaatgtttcaagatacccgatcactttctagtgagatgattgccagtagtatcgaaacaaatgcagcaaatgtacgtaaaatcatgagtcagctcaaaaaatccggtttgatctttacaaaaaccggaaaaccgcagccttcccttgccaaaagtccagatcagatttctttactagatgtctatcgcagcatcgaaggtaatacacagcttatccaagtcgatccaaaaacaaatccaaattgcgtcgttggtgcgaatatccaagaagctttagaagaaagctacgctcggctgcagaaaaaggcagaagaagaaatggctaagatcacacttgatagtctgatacataaaatagccgttttggaaaaagaaaaaagaccagaaaacacaggcctcgtagagagatttttataa

SEQ ID NO: 1578 - DNA (genomic), 225 bp, Enterococcus faecium; double-stranded, circular
  misc_feature (B) LOCATION 1...225
  hypothetical: NO
  anti-sense: NO
gacatgatgaaaaaaaagttgacaaaatctaataaaaatgttgttttgacagggactttagcaggaataggagaatacatcgggattgatccgactgttatccgtgtgctttatgtattcctgagcttagttgcttttggaagtccaattattttatacattttattagctttgattatacccattctgcgcgttctgcacgaacaaactctgactatactctca

SEQ ID NO: 1579 - DNA (genomic), 1173 bp, Enterococcus faecium; double-stranded, circular
  misc_feature (B) LOCATION 1...1173
  hypothetical: NO
  anti-sense: NO
ataatgatgaatttatccaatcgatttagtcctaggctttctagaatagaagtatcaaaaatacgacaattcgatcagcaaatatcgtcgataccagatgtgatcaaactcaccctgggagaaccggattttccaactcctgaacatgtcaagcaagcaggaatagcagcgattgaagaagacttttctcactataccggaatgagaggattagaggaactgcgggaagcggcttgtatatttcagcaacagcgttatggattaacttatgatccgcaaacggaagttttgacgacagttggtgcaacggaagcgattgcctctgcgttgttatctgttttggaagaaggagacaaggttcttattccagcgcctgcttattcaggatatcagccattagtggaactagctggtgctgaattgatcccgatagatacttctgacacagggtttgtctgtcagccggaacaatttgaacgagcatttgaacaatatggatcagctgtcaaagcagtcattttaaactatcctaacaatcctactgggacgacattgtctgcaaaacaattgaaagcaatcgctgaggttttaaaaaaatatccggtatttgttataagtgatgaagtatatgctgaattgacttatagtggaacgcatatgtccatagctacttatcttccagaacaaacaatcgtgataagcgggttatccaagtcacatgcgatgactggttggcgagtgggctttatttttgctcaaaaagcccttattgacgaactaattaaagtccatcaatatctggtgactgccgctacaacgatgtcgcaaaaagctgcggctgaagcgctaataaatggggtgaaagatagcgagaatatgaaagagcaatatcaaacacgaagagactatctggtccagcaattggcgcctttaggatttgaagtgacccagccaaacggtgcattttacttgttttgcaaactcccagctgccattcaaactgactcttggcagttttgtgtaaaattagcggaacaggcaaaagttgcgtgtatcccaggaattgcatttggcccagaaggagaaggttatatccggatttcttatgctagcagcatggaaaaattacatgaggcctgcaaacggatcaaagactttttaacagaacagtga

SEQ ID NO: 1580 - DNA (genomic), 2157 bp, Enterococcus faecium; double-stranded, circular
  misc_feature (B) LOCATION 1...2157
  hypothetical: NO
  anti-sense: NO
gaaatgatgaaagattttatgaaaaaaatattaaatacttcttggttagaaaaaataagaaaaggtgcacaagaacctaagaacaaaacgtttcgccggtcccatgttccttttcgcttaaattttctttttttcattatatttacgttatttgttgcgttgattgctagattgggttatttgcagatcgtgaacggcgaagagatggaggcgcgagtgaagtctacttctacgattacggtccaagaaagtactcctcgcggaatgatctacgactccacaggaaaagctttagttacgaataaagcgaatcaggccatcacatatacgagaggaacacaagttacggctaaagatttgcttgaaatcgcaacgaagctgaactcgctgatcgatgttccggtagatgaaaatctgacagatagagataaaaaagatttttggctggctgatcccaaacatttgaaagaagccacaaaaagactttcggcaaaagaaaagcaattagggaacagcgaacaatatagtgcgatggtcaataaagtcacagctgatgagattaatttaaacgaggagcaattaaaaattgctaccatctttaaacggatgaatagtgcatatgaattaaacactgtctatatcaaaaactctggtgttactgatcaagagttagctgttgtggcagaacgcgcttctgaacttccaggagtttcgactggcacagactggacacgagaatataatgcagcaagttcactgaaaagtattcttggcagtgtgacgactgaaaagcaaggacttccagcagatgaagcagagaaatacctagcaaaaggttattctcggaatgaccgtgtaggacaaagttatttggaaaaacaatatgaagatgtcctgcaaggaaccaaaacccaatatgaagtttcccttgataatgaaggaaatgtttcgaatcaaaaagaaatcttctctggggaaaaaggttctaatttaatgttatctatgaatgcagaattccaatcaaaagtagaagaaattttgaaaaggaattatcaaacattgatcaacaacggcaaagcacagtattcgcctggtgcttatgcagtggctatgaatcctcagacaggagaagtgctagcaatgactggtttcagtcatgaacaaggttccaaagaaatcaccgagaatgctttaggcacgattactagcgcctttgctccagggtctgtagtcaaggctggtactttgacagcaggctgggcaagtaacgcgatcagcggaaatcaagttttgattgatgagccgattcgtctgcaaggtgcttcagaaaaaagctctgtctttaatcgaagcggacaagttgctcttgatgcagtcaaagcattggaattgtcttctaatacgtatatgatcaaagtggcgttaaagatgttaggactagactatacacctggaatgggactacctagtttagatgaagaagctaaagcttatcagcaattgagagactctttcaaagagtttggtcttggtacaacgactgggatcgatttgccgaatgaatctcctgggatctcacgttctgttgattatatgaagaagttcaatgcggataatggcaaagaatggtatactccaggtaactttaccgatttggcatttggacagtttgacacatatacaccaatccaattagctcaatatgcttcaacagtcgctaatggcgggaaacgagtacagccgcacctagtcaaagcgatctatggcaatgacgaaaatggaaacttgggtgaagtgaagaaagaaattggcacaacagtagaaaatacggtcaatatttctgcagaaaatatggcgatcctccgtgaaggattccaccaagttgtccatggtaccgatccttacacagcagccaaaccattagccagtgcgaaaatggacctttccgcaaaaacagggactgcagaaacggttgcggaaggtcatccagatattacgacagtcaatagtaatatcgtggcatacggaccaacagacaatccggaaattgccatcagtgttgtcttgccgaacttattagacgaacaagaccacatgaacttgacgattgctaaagaaataatggacgcgtattatgatatgttcatggcaaaataa

SEQ ID NO: 1581 - DNA (genomic), 699 bp, Enterococcus faecium; double-stranded, circular
  misc_feature (B) LOCATION 1...699
  hypothetical: NO
  anti-sense: NO
aaggtgatgaaaaaaatgcagacttcctttcacgaggggcgtacaataggacttttgctgacatttatcggaggagccatggacagttatacttatatccaatatggtgcttttgcctctgctcaaactggcaatatcattctatcgatcatccaagcatttgacggagaatggctaagtgttggtaaaaaagtattgtctacccttttctttttcttagggattcttctaacaaagtatctaattgattattttagaaaaaaagaaaaacatttctggcgcttgtttgttctatattatgaagcagtgatttttttctttgttagtttgacacccgtccatgagcatcccgcattagtaacgattttgattgcttttactgcatcgatccagtgggtagcttttgataaaatcaacgggcgtgcctacactaatttatttacaactggaaatttaaaaggggtagcaacgaacttatatgattattgtatttctaaagaaaaagcagattttgatcgatttttccactatctaagtgtcgttcttgcctttatcgcaggagctattgtccttgttttctgtcatcatctgtttggcgcccattcgattttgatcgtttccattttatttttgatcatggccctcactcagacatttcatttatggcaattttatcatacgaatcggttcactatttga

SEQ ID NO: 1582 - DNA (genomic), 1479 bp, Enterococcus faecium; double-stranded, circular
  misc_feature (B) LOCATION 1...1479
  hypothetical: NO
  anti-sense: NO
tacaagatgaataatacttacccagacgacagtttgacgctgcatacggatctatatcaaatcaatatgatgcagacatactgggaattaggtcgagctgatttacatgctgtttttgaatgttactttcgagaaatgccttttaaccacggatacgcggtttttgcaggattggaacggttagtcaattatttagagaatctgacgttcaatgattccgatattgcttacttgcgtggattagaagtctatcctgaaggttttttggagtatttacaaaattttgaatttaaagcaacagttcgttctgctcgtgaaggagaactagtttttgcaaatgaaccattaatccaagtggaagggcctttagcgcactgccaattagtagaaacagcactgttgaatatggtcaatttccaaacgttgatcgcgacaaaagcagctcgtatcaaatctgtcatcggagaagatccactattggaatttggaactagacgggcacaagaactggatgcagcagtctggggaactagagcggcatatatcggcggagcagatgcaacaagcaatgtacgtgctgggaagatatttgggataccagctagcgggacccatgctcattcgttagtccaatcttatggaaatgattatgaagcatttatggcctacgctaaaacccataaagactgcgtgttcttagtcgacacttatgatacgttgaaatcaggtgtgccaagtgcgattcgcgtggcgaaagaattaggtgacaaaatcaacttccaaggcgtacgcatcgacagtggagatatggcctatatatctaagcgtgttcgggaacaattagatgcagccggatttacggaagcaaaaatctatgcttcgaatgacttggatgaagcaacgattttgaatttaaagatgcaaaaagctaaaattgatgtatggggtgttgggacaaaattgatcacagcctatgatcagccagcccttggtgcagtattcaagctagtatcgatcgaagatgatgaaggaaaaatgatggatacgatcaagttatcaagcaatgcagaaaaagtaactactccagggaaaaaacaagtgtggcgcatcactcgaaattttgatgggaaatctgaaggagactacgtgacattatgggatgaagaccctcgagaagaagaagctatcttcatgttccatccagtgcatacgtttatcaataaaactgttcgagactttacagctcgcccagttttacaagatatctttatcgaaggaaaaagagtttacgaattacctgcactaaacgaaatcaaagaatatacaaaagaaaatctagattcactatgggaagagtataaacgagacttgaatccgcaaaaatacccagtcgatctgtctactgaatgctggaaccataaaatggctatcatggaacgaatgaaaaaaagcgtagcagaacttcatacagaagcatag

SEQ ID NO: 1583 - DNA (genomic), 828 bp, Enterococcus faecium; double-stranded, circular
  misc_feature (B) LOCATION 1...828
  hypothetical: NO
  anti-sense: NO
aagaagatgaagaattctgagatcaaaaacagcaaaataacgaaaaaagagctaaatcacgtattttggcgttcttttcaaatggagttttcttggaattatgaacgtcagatgaatatggcttatgtttatgcaatgattccgattttgaaaaagttatatcagtcgaaagaagaaatggcagcagctttgaaacggcatctagagttttttaacacgaccccacatatcgttacactgattttaggaatcacggctgcaatggaggaagaaaataaggatgatcctgaatttgatgtgactgcgatcgatagtatcaaaacatctttgatgggacctcttgcagggttaggagattctttcttttggggaactttgcgattgattgccacaggtgtgggtacctctttagccatgcaaggaaatattttaggccctatcttgttcattttgattttcaatattccgcacattctgtttcgctatctagcaacaggttggggatatcgcttaggaacgggttttttgaaaaagatccaggcaaacggtatgatggaaagtttgacattaggcgcgtctattattggactgatggtcgttggagcaatgactgccacgatgatcaccatcaatattcctttaaaaatcggttcaggagaaaatgctgtgactgttcaaagtatttttgatgatatcgttccaaatatcttatgtcttggagcatttggcatagtgttttatctattgaagaaagaagtgaaaccattaacgatcttgatcggactagctttctttggaatttttggttcgtggatagggattttttaa

SEQ ID NO: 1584 - DNA (genomic), 693 bp, Enterococcus faecium; double-stranded, circular
  misc_feature (B) LOCATION 1...693
  hypothetical: NO
  anti-sense: NO
cttttagtgaaagaaggaaagaatatggatcacaaattaagtgaaacagaacagtacctctggaactttatcggacaccacatcctagagatccctaactactccatcgtgaaactaagtgaacaagcaaatgtctcaacagccaccattgtgcggacaatgaagaaaaaaggctatgaaggatttacttcgtttaagcaccatctaaaagaaggagaaaacaagaacatcaatttttctttcttagataaagtagacaaaggtatccgtcgagccattctaaaaaatgaacaagaagtggtacgtacgatcaatatgttggaaatcgggaacattgaagatgcactacaaagaatcaaatttactgaccgggtttttatctttgcccgaggattttcagaaatgattggtcaagagatgctcgtaaaacttcaattaacaggaaaaaattgtcaaatgcatactgatccagagattatcaaaagcatcagtcggaaactaactaagaaagacagcgttatttttgtttctttgaacggcgagacaaaagaactcgtcaccgccgcaaagaactgctatgatgcagagattggttcgattctagttacagccaatcattcattcctctacactcaaagattattgcgagataaatctcgtaggtttcaaatcagaaggttcttatttccctga

SEQ ID NO: 1585 - DNA (genomic), 1023 bp, Enterococcus faecium; double-stranded, circular
  misc_feature (B) LOCATION 1...1023
  hypothetical: NO
  anti-sense: NO
tttaaagtgaaacgtgttttattttttttagcccttgttgtaatcgcttaccaaatgatggggtgtacacctaatacaaaggaagcacctgacccactagtcgttggtttttcgcaatcaggaacggagagtagctggcggaaaaagcatactgaatcaattatcactgcgcttgaaaaagaatattaccaagttctctaccgaaatggctacatgaatcaggaacggcaaatccaagatatacggacgttcattgcctataaagtggatatgatcatttttactcctttgcaagaatccgggtgggactctgtattaaaagaagcaaagcgagcagggatccctgtcatacttgtcgacagacatattcaaacgaatgatcccgagcttttcgtcacccacattggccccagtttcaaagcagaaggaaatcgggcgggtttatttgtcagcaatcacttcacaaattcaaagaaacaggaaatcagaatcctagaacttgctggttcagagaactccacaccgaccaagctacgctccgaaggatttttggaatcaatcaatcgtaaaccaaccctaaaaaaagatggaaccatcgaccataaacctccgatgactattgttcaccgaattgtcggtgattttattcggatgaaaggaaaagaccagatgaaacgatatttagaaacaaatgatttatccgaaatcgatgtattatacagccatagtgatgaaatgactcacggtgctttagctgcgataaaagaaacatcaatcaaacctggagaagatttgatcattgtaactattgatggacaagaagatatgatcgagaagctacgctcaggaatcgtcaattgtgtagtcgagtgtaaacctgatgtcggctggtatgtagccaataccgttactcgttattttggaaatattcaaacaggaaaaacattacctaaagatatttttatttccgagactgtcttttcccagcagaatatagctaacatcccaaccagaaattattga

SEQ ID NO: 1586 - DNA (genomic), 678 bp, Enterococcus faecium; double-stranded, circular
  misc_feature (B) LOCATION 1...678
  hypothetical: NO
  anti-sense: NO
agggaagtgaagcaattggataaaatgaatgtctttcaacaatttttctattatttccaggaaaatggctcctatatctttgcacaatttatccgtcacttcctgatttctatctatggtgtcctctttgcagcagttgtcgggattccggttgggatcatgatttctaggagacgtaaattagcaaactgggtgattcgtttggcgaatatcatccagacgatcccttctctagccatgatctccattttaatcattggattaggcctgggagtcaatgtcgtgattgttactgtatttttgtattccctcttaccgatcatcaagaatacgtataccgggatgatccaagtagacaaaaacatccttgatgtcggcaaaggcatggggatgactgctagacaacgactattcatggtagagttaccactctctgtttctgttatcatggcaggcataagaaacgcgttagttgttgccatcgggataaccgcgatcggtgcattcgtcggtgctggtggtcttggagatatcattatccgaggaaccaatgcaacagagggcacatcgattattttagcaggtgcattgccaactgcattaatggcgatcatcacggactggcttttaggtattttggaaagacggctagatccagccagccgtacatcacgctga

SEQ ID NO: 1587 - DNA (genomic), 3729 bp, Enterococcus faecium; double-stranded, circular
  misc_feature (B) LOCATION 1...3729
  hypothetical: NO
  anti-sense: NO
agaagagtgaatcaaattcctttaaaaccgcaaaatgaacgattcacagatgatcagtggcaagcgatttttgatcaaggagataatctattagtctctgcgtctgccggatcaggtaaaactacagtgcttgttcgaagagtgattgaaaaactaaaaatgggttttgatatcgatgaattattgattgtgacatttactgaagctgccgcaagagaaatgaaagaaagaattcaagaggcattacaagaatccgtcaatagcgaaagtgaccctgtacgtagacagcattttactaagcagttagttttattgcccacagcgaatatctcaaccttacatgctttttgcctgacagttattcgacgttattattacttaattgatattgatccagtctttcgcatgttaacagatgaaacagaaacgatcttgatgaaggaggatgtgtgggacgagctgagagaagcactttatgcagaaaatgatgaacgatttttccaattaacaatgaatttttctaatgatcgttcagatgacggcttgacgaatctggtgttttctctttatgagtttgcccgtgccaaccctgacccccaaaaatggctagaacagttaagcgataattatcgtttgcctgaggggctagcgaaatctcgattatatcaaaaacaaatccgtcctttagttttggcagatatataccaatgtgtacagttatatgaacagatgactcagttagcacaaggtgaaggattagaaaaaatgcatgagcaagtagctggagaacaacagcagatcaagaatatctatgaagcgttctcgcaagatcggttagaagaagcttatgctggtttggaacaactaactttttcaacttttaagagcagtcggaaagcagaattgaaagaaatttccaatgaagtcaagggcatgagggataaagcaaaaaaactgattcagcagataagtaaaagttattttcctgtttccccaagccaaatggaagaattaacggacaaagcactaccgttagtcgaagaaatgacaaaagtcacgcaaagcttcatggacggtttcagtatgcgtaaacgggaaaaaggtgtgctggatttcaatgatctggaacatttagcgttgcagattctcacagaaaaaacgaaagatgtatggctgccaagtgaagcttcaaaacattatcgaaaaaaattcaaagaagtaatggtagatgaatatcaagacgtgaaccaattacaagaagccattttatactggctaagagaacccgatgatacaaaaggaaatatgttcatggttggggatgtcaaacaatccatctattctttccgtttagcagatcctagtttatttatcgggaaatacgagaatttctcaaagaaagaaggcggacgtcgaatcgttttggctgagaacttccgctctagaaaagaagtcctttcttttacgaatcttatttttgaacaactaatggatccagcagtgggtcaaatcaattatgacgaagcagccaaactgatccaaggattttcagactttccagagaatgaacagtttgagccggaaatcatgatctatgaaaaagaacaggaagaatcagagattgagattccgacggatgatatactggaagacaaaacagaaggcgaactttttatgacaggactaaaaattcgtcaattaattgattcctcctttatgatttatgataaaaaatcaaaaaaaagtcgtccgatagagtacaaagacattgttctcttgacacctacaaagaagaacaacttaacgattttagagattttcaaaacattggatattccattagagatgaatgatgctcaaaactattttcaagcgacagaaattcgcacgatgatctcgctgctacaattaatcgataatccctatcaagatattccgcttgcggctgtattgcgctcaccgatcgtgggtctgattgaaccagaattagccagcattcgattagctaaccgtgcacatacttactatgatgctgtgcttgcttatcaagcatcaaacgaagatgaattagcagctaagctggaacattttggcaagcaactagagcattggcgagaacttgctcgccgttcttcgatcactgacttgttatgggatatctattatgagacgggatatctagagtatgtggtcggtctgccagcaggggcacagagacaagccaatctttatgcattggttgatcgtgccaaagcttacgagcaaagttctttcagaggattataccagttcgtgcgtttcattgaaaaaatgcaagaaaaagataaagacttagcagaaccagtcatttcaatagaagataatgctgttcgcgttatgacgatccatgcaagtaaaggcttggaattcccagttgtatttttgttagatatgacaaaggagttcaacttacaagacttgcgcaatcggtatgcttttgaagaaaaacttggagcaggaattcgctatatggatcctgaaacacgagtgttatatgatacgttaccgtttcaagccatcaaattggcaaagcaaaacaaattgttgtcggaagaaatgcgtaaattgtatgtaggattgactcgggcagaacaaaagcttttcattgtcggttcctataaaaataaagagcaaatgatccaaacgtggtctgaagcagctgatcatgaggagttagtttttgatcctgcgctacgtttgaagggcagaagcagcttgatgaattggattggttacggattgatccgtcatcctgaaatgcagaaatacttagaggaagaaatttcgacttctcttcttcaacattcaaatgcacagttttctatttcatggatgaatcagcaatcgatcattgaacaaagacagttgcttgctgaaaaagaactggttaacttagatcagcagatgaaagaagatgaaactttattagcagattcgttacaaaaacgtctggcatatgaatatccttatcaagcttcttcacaaaccacaagttatcaatctgtatctgaaatcaaacgattattcgaagatccagatgatacacaagaatcacgtttgactctggaaagcagtcagaacaaagcagcatcccgtcaatttcgttatacgcaagaacaactagcagaaccaaaatttttgcaaaaagatcggcaagtgtcagcagctgctgttggaactgctacgcatgctttgttacaattactgccattagagatgccaactacagagagtatccatcaaaaattacaggaattggtaaggaaacggttagtagacgaaaaagtcgcgaaaaaagtagatgtttcttctattatatggttctttcaaacagaacttggtcaacagctgattgccaacaaagaaaacgtaaaacgagaacaacctttttccatgctgcttcctgctgacgaagtatttcaagactatccaaatcaagaagatgaactattaatccacggaatcgtcgatggatacctagaagaaaaagatcatctcaatatctatgattttaaaacagattttattttacatccggatgatccagcagaaatagatgcaatcgtccaaaaatatcaaggacagctaagactttaccaacaagcaatgtcagaagctttgaataagccagtagaaaatgttttcctaattttgcttcgagtgaaacaaattataaacattaacaaataa

SEQ ID NO: 1588 - DNA (genomic), 756 bp, Enterococcus faecium; double-stranded, circular
  misc_feature (B) LOCATION 1...756
  hypothetical: NO
  anti-sense: NO
aaaggagtgaatagcttgagaacaaaacaagtattaaagggagcgttggtcatcttatttgctgtaagtacaagcgtcccgcaatggacagtatatggagagagcatttcttccgaatcggaatctcgggaggtagaaaccacagaaactactgatgctggaaatgaaacgaaatcgagtacttcacaaacagaaacaaatactgaaacaacggttgagacatctgttactagcacagatcaagaaacgaccgntaccacagataaccaacaaacagaagaagcaacagctacaaaaatgtcaaacgacgaatcctcttctgctaaagtaagtgacaaagagaatgggacagaaaatgatgatatcggtaaaggtgaaaatttcaatggtaaagaatatttgaattacttcggtaaacagatgacagaaatacttaatggaccaacagaagacatcaagtcaaaattaatagagttattagtcactgagcttgctgttaatgattatggtgtagataaagagattatcaaacatctgattgctacttatctattgtacgatatcgcttttgcaaaaaacagtgtgttgatgtcgatgcttggaggtacagatgatgggacaacgcctacagaaaacacaggcttctatccaaatacaaaacaacttcatcaaactctactaaacaaacaagatggccaaaatgatgggatgtatatgcatattaagtcgatcagggttcagataaaacagtcatga

SEQ ID NO: 1589 - DNA (genomic), 627 bp, Enterococcus faecium; double-stranded, circular
  misc_feature (B) LOCATION 1...627
  hypothetical: NO
  anti-sense: NO
ctcgtggtgaagacgcgcgattcactgagtaanaaatgtgagcccccctctataaaaatcttgttctcgttgccttctgtcgttgtcggtttattcggtttctcggttttcgttattcaattccagtatggtttctcgattatttctggtgcattggctttgactgtattcaacttgcctcttttgactagaacagttgaggagtctttacaagcggtccattacacacaacgagaagcaggattggccttaggtttgtcacgctgggaaacagtgataaaagtggtggttccagaagcgacaccagggattttgactggtgtgatcctaagttctggaagaatttttggtgaagcatctgcattgatctatacggctggacaaagtgcacctgcgttagattttacgaactggaatccattaagtgtttcaagcccgatcagcattttccgtcaagctgaaacattagctgtccatatttggaagatcaatacagaaggcacgatgcctgatggtgtttctgtttcggctggcgcttctgccgtgttgattattgctgttttactgttcaacttcggcgctcgtgcgattggcaaacgattataccgaaaaatgacttcagcctaa

SEQ ID NO: 1590 - DNA (genomic), 1602 bp, Enterococcus faecium; double-stranded, circular
  misc_feature (B) LOCATION 1...1602
  hypothetical: NO
  anti-sense: NO
cccgtggtgaagacttatgatctttcaagatttcagaaagatcttttggctgggatcacagtagctgctgtagcattgcctttagccttggcttttggggtgtcaagcggagctgatgcggccgcaggtttgattacggctatcattgccggtatcgtcattggcggtttatcaggcggtttttatcaaatatcaggtccgacaggtgcgatggcagctatcttgatgtctattgcggcaacaaagggaatgcaaggtgtattgcttgctacttttttagcgggtctatttttacttgcagcaggacttttccgattaggaacactgacttcttttatcccagcacccgtaattacggggtttacttcaggtattgctatcattattgcattaggtcagatcgataatttatttggtgttcactcggaaggtacaaacgttattgaaaaactaagtagttatcaaacgataggatttccgataaacacagcctctttgatcatgggagggctagtcattttagggatgtttatctatccaaaaaaatgggcgaaacgaatgcctagttcgctgctgtctatcattttggcaacagcagttatgctattgttccatttaccagtagcaactgtgggtaagattccacaaacattgatcagtagtaatcgtttgaatatgggagattttagcttttctgccttgcaacaagtggcagttccagctattagcattgctttattaggaatgattgaaagcttgctatgtggtgcttcggctggccgaatggcaaataagcccttagatagcaatcaagaattaatggcgcaaggaattggaaatctgttgcttcctttctttggcgagattcctgctactgcgggcatcgcccgtacaagcgtggccatcaaatctggtgcacaaactagattagctggtatgatacatgcagttgtcttactgctctccatgcttgtttttgcgccagtgatgtcacagattccaatgccagcacttgcaggtgttttgatcgtgacggcttggcgtatgaatgaatgggaaacgatcaaggagctatttactaataaatattggtcagcagttctattgtttatccttacgatgatttgtacagttatctttgatttaagtattgctatcgtgatcggggtgatcggcggctgtgtattttttgttgtcaaaagcgctgctatcacgatttcattagaaacgatcgattggcaaagaatggggctgccagaaacggaaaagctgaataactggacagtagtgtatattagtggtccactgttttttatgtcttcagaaaaactcaaaaataaattggaagaactaaatcatcacgatggtgtcattttctccatgcgaggcgtaccaagtattgatttgacggcacgtgcagtttttgatgaatttcaagaaaaagcagagcaaagaggacaaacgattatctatacttccttgcagccagaagtagaaaaacaactttctcacttgtgggaacatacattcacgcatcaacatcaaacagttgctcatgcgttgacagctttacatgcgaaatatactgcaattagccattaa

SEQ ID NO: 1591 - DNA (genomic), 291 bp, Enterococcus faecium; double-stranded, circular
  misc_feature (B) LOCATION 1...291
  hypothetical: NO
  anti-sense: NO
agtcaggtgaaaaaaatgaaacttgaggataaaaaagtcattttgaagaaaatcaaacgactaccagaccaaatagatggctatacgatctgttctttcaaaaaagacaggagtataaaagcttatacgcaaaacacagaaaaaggaataatctatttcctacatgaagaaggttacgatacccaaacctttatgtttactgaaaaaaaagaatttcataaacagatgaaaaaactgattgaaaaagaatttccaagaagtcataaactctatgtgaatcagcaattttaa

SEQ ID NO: 1592 - DNA (genomic), 1281 bp, Enterococcus faecium; double-stranded, circular
  misc_feature (B) LOCATION 1...1281
  hypothetical: NO
  anti-sense: NO
aagcaggtgaaatcgatgcgtaagttttggattattaccaaagatgtctatttaaaaaatgttaagtcgatttctttcttgatcatgatattagtcccttttatcatgctgggtatcatttatgtagcaggaaactttgctcaacaaaatagtgatgtcaataaaatcggcgtattggctgataatgagcaaatcagtcagcaaatgagccaagtcaaaacagatgattttgagttcaaagcagttgattctgaagaaaaagcacaaacaagagctttccggaaagaaaaaatcgatgcgtatttagtagtctcaactgagaatgataagataaatgggatgctttatagcgaaaattcattaggacaaagtacacaactactgatacaacaacaactgactggcttgcaatcgatgcttcgagcaagtcaattaggcatttcaccagaagaagtagctagcttgagccaacaagcaagtttgactcgacaaaaagtcaattttgattcaaaaggaaaaatgacagttggagaagataactcgacagtccaatatgtcgtaagttatgtagcaacgattgtcttgttcattattattttgacgtatgcgcagatcattgcacaagagatcgcttctgaaaaaggcacgcggatcatggaagtgatcctgtccagtacgactgcacaaaagcatttttacggaaaactaacaggtgttttacttgttgcattaacgcaaatggcattatacggtattatttttggtataggatacagtcaattcaaagatatggaaatggtcaaaaatatattagacggtatctcattggataacttgattggaccattcttgtggtattctcttctattcatgatctttggcattttgattttttctgttttagcagctttatgtggctctttggtcaacaaagcagaagatacagcaaaagcaattttgccagtgacttatctatctctaggcggatatatgcttggattgatactaggagcttcagatccaaacaatatcgttattcggatcacttcgtatattccattcttatcttcatatattatgccggttcgcttagcaaatgagacagtcggtatgggtggagcattgatttccttgttggtacttgtagccgtaacattcttattgatgatcttgtctgcaaacatgtacaaatcgaatgtactcgtgtatagcgaaggcggattatggagttcattgaaacaatcgatttcaattatgagaaatgaacgaaaaaaagcataa

SEQ ID NO: 1593 - DNA (genomic), 1431 bp, Enterococcus faecium; double-stranded, circular
  misc_feature (B) LOCATION 1...1431
  hypothetical: NO
  anti-sense: NO
tttgaggtgaaagaattgtttgaatttaacaatgtttctttttcatataaggatgttaaggaacaagcgcttgttgaccttaatttttcaataaaaaaaggcagtcttacattgattactggttcttctgggagtgggaaatccacactattaaagttaatgaatggacttattccaagactttatgacggaaaattggttggggaaattttatttgaaaataactcgctacaatccttaacacaagaaagtatatcaaaaaatattggctacgtaagtcaaaatcctagaggacaattctttacaacaaatacaacgagtgagttagtattttcgatggaaaactttggatttacaaaagagcatatggataaaagaatcaatgaattagctgaattattagatctttcaaatatattagataaaaacattttttcgctatcaagtggtgaacggcagaaaatttctattggatgtagtttatcgctaaactctaaattaattatattggatgaaccgtcttcaaatttggacttcaaagcgactaagaaacttgctgacttactttgtgatttaaaaaataaaggatttactattgttatagctgaacatcgtttttactatttgaaagaattaattgatcaagttctatttgttaaaaatagaactgtaaaaactacaactattcagttgttaaaaactgaaaacaataacgcattaaggaaatttgacatttttaatagttcgattgaagttccctatatcgaaaaggtaagtgcagatgtattaaaagttgaagaaattacttatgaaaatattctaaaagacataaattttgatgtcaaagttggagatgttattggtttggtagggaaaaacggtgtggggaaaacaaccttactaagaatactcatgaagattattcgccctaccaaaggaaagataatcgaaaataaaaaaaatttgtcatcgccgtttttagtaatgcaagaaatggattaccaatttttcacagaatcagtgaggagcgagttagccctggggaatgaaatagttagtaaagatcagcaagaaaaaattttaaaaaaaatggaactttataaaatgaaagatcaattaccgtttgatttatccggtggagaaaaacaaagattattggtttctatagcttcattgtcaaaaactaatttatttctatttgatgaacctacaagtgggttggattatatcaatatggaaaggattgctgaccttattaaagacttaaaagaaaagggtgcagtagttatagccactcatgatccggaatttctttataaaacatgcaatagaattatttatttaaaaaatggtggaataaaaaaagatataaaacttagagtagaagattcaactttgatagaacagatttttaatgacataacgaaatag

SEQ ID NO: 1594 - DNA (genomic), 1695 bp, Enterococcus faecium; double-stranded, circular
  misc_feature (B) LOCATION 1...1695
  hypothetical: NO
  anti-sense: NO
gaagaggtgaagtttgtgagtaccattaaaattatcccattaggcggcgttcgtgaaaatggaaaaaacatgtatgtcgcagaagtgggcgaggatatttttattttagattgtgggctaaaatatcctgaaaatgagttgttggggatcgacgtcgtaatccctgattttacgtatttagaagaaaacattgatcgtgtagctggtgtctttttaacacatggacatgcagatgcgatcggggcacttccttacttgttgtcaaaaatttctgtaccagtattcgggacagagttgacgatcgagttagcaaaattgaatgtcagtcgtaatgaagcagccaaaggatttaaggatttccatgtggtagatgagcatacagaaatagactttggtgaaacagtagtgagctttttccgtaccactcatacgataccagattcagtggggatcaatctgaaaacaaaagaaggtagtatcgtttatacgggagattttaaatttgaccaaacggctatcccaatgtatcaaacagattatgcacgattggcggaaatcggcaaagaaggagtcttagccttactaagtgaatcggcaaatgcagaaaatcctcagcctgtagcttctgaagcccaaatagcagatgaagtatttgatacgatcaaatattgggaagggcgtatcatcgtcgcttgtgtagcaagtaatttgcaacgagtgcaacaagtattggatgcagcagaaaaagcacaacgaaaagttgtcttgactggtcaagatttcgaacgaattattcgcacagcgatgcgtttagaaaaacttcaattaccaagtgaagatctgcttgttacgttgaaagacatgaaaaactatgatccagaagaactgatcattttagaaactggccgaatgggtgaacccatcaagtctctgcaaaaaatggcaaacggtacacaccgtaatgtcaagattgaagaaggagatttggtttatatcactactacgccaagcatcgcgatggaaaccatcgtggcgaaaacggaagatatcatttatcgagctggtggaacagtgaagttgatctctgagaatatgcgcgtttctggccatgccaatcctaatgacttgcaattaatgatcaatttgatgaaaccaacatattttgtgccagttcaaggagagtatcgtgaattagctgctcatgcagatttggctcatgcagtagggatgccatacaaaaatatctatattactggacgcggagacgtgctggaatataagaacaagcgtatgagtgttgcaggaactacaagtgcagaaaatgtaatgattgatggattaggcataggtgatatcggaaacattgttttacgtgatcgaaaaatcttgtcagaagacgggattttcgtagcggttgtcactatcagtcggcgagaaaagaaaatcatttcaaaacctcaaattacttcacggggattcgtttacgtaaaagctagccgtgatctgatgaaagaaagcagcaatatgattgaaacaatcgttgagaaacatttagaaagcaatgattttgagtggagcaaattaaagcaagacatccgagatcaattaggccgttacttatttgaacaaacaaaacgccgcccagtgatcttgccagtcattatggaagctactcaacgtcgaaataaaaaataa

SEQ ID NO: 1595 - DNA (genomic), 630 bp, Enterococcus faecium; double-stranded, circular
  misc_feature (B) LOCATION 1...630
  hypothetical: NO
  anti-sense: NO
ctattttcgaaagctgcttcctcctttgtgacttttttattcaaaggaggaagtttttttatgggaaaaaatagagtttgggtagaaggaacgattgttgcagcgttagcgatggtgttgtcgttgattccgatccagatcggcagcagtttttctatttcattagggcagattccattgactctttttgcgttaagaagagggacaaaggcagggatgctggcaggtttcatttggggcatcctacattttccgttgggacaagtttattatttaagtgtcgttcaagtgttgattgagtacccgattgcctatacttttgcaggcgcagcagggctcatggcttcaaatgtccaaaaaggctatgtagacgataatacgaaacaaattagaaaaagcatcgtgtttggtgcattgattggcgcactttccagatatttttggcattttattgcaggagtggttttctggggagcgtatgcactatgggggatgaattcttggctcttttctttcgtaatgaatggtgccagcgggttgagtacagctattgtaacgatcatcgttttattagggatccaacaaacgactccttcgatttttgtgccagataaacgacaggagctgtaa

SEQ ID NO: 1596 - DNA (genomic), 1125 bp, Enterococcus faecium; double-stranded, circular
  misc_feature (B) LOCATION 1...1125
  hypothetical: NO
  anti-sense: NO
ttattatcgaaagtagaaaaaggaacgagacaattaagtgaagaaaaattgaatcttgtgttggatagtttgcaagaagaggtcgttccagttaaccgtgttttgattgattatctaaccattcactttttctcgaatcaacatttaaagctaattgaagagattattgaaatgcccattgaacgttttgaggaactggattatgcgccaaagggctatattggccaatacgtgtggaatcaagtaatcacgattcggtattccattgacgatgcggttaaaggaactgtgatggagttttcaggtcaaggctgtaaacacttagcaagatggctaaaaacacgaaaaacaaattggcaacagttttttcgtaaggtattagattatcaggggaactttacacggattgattttactttagatgattttgtggggagtctcagcattccagaacttaagcataaggtaatactaggccatgtgtggaccacttttcaagtgagtgaatctcatggcggtacggatatcataaacaatgaatcaaatggtgagaccttgtatttaggctcaaagaagagtcagtgtcgtttttgcttttatcagaaggaccatgaacaacggaagcgacgaggaattcctttagaagaggcaaaagtaaagaatcgctttgaactacggtatcgaaaagagaaagcgcaaagcttggcaaagattatttcaaaaacccatgatttaaccaaactgttctttgagttacttaatggagcaatttgtttttatgaccgtgatccaaatgatctaggtgcaaaagttgatgccaaatgggcagcctttattagcaattatggcgcaatcaccatttctttagatacaattcctcaaagttttgagaaaactatgagttggttaattcatggtgtttcaccatcattagtttttattgcacaggtcgatcaaacgtttcattcttccttgttgcctttgattattgaacaaggagaaatgaatccaagacagatcaaacttctccaaaatatgaaggcagacccggagtattatcaggaggaggttgagtattatgaacgaaaattacaaagtatatcaaatgagaaaacaagctactaa

SEQ ID NO: 1597 - DNA (genomic), 204 bp, Enterococcus faecium; double-stranded, circular
  misc_feature (B) LOCATION 1...204
  hypothetical: NO
  anti-sense: NO
ttgatatcgaaaaaaaatacccagaagaaaactcttcgccagctgaaaaagaaaaaccaaaaaagaaaaaaagcttctgggatcgtttattttaaaacgaaaaaacacataaatttttacatgcaaaaaaagcttttgatcagattgacatcaaataggacaatctgtcaaaagctttttcttttaaaatacttcaggatataa

SEQ ID NO: 1598 - DNA (genomic), 924 bp, Enterococcus faecium; double-stranded, circular
  misc_feature (B) LOCATION 1...924
  hypothetical: NO
  anti-sense: NO
aaccaatcgaatacaagaggtgaaaaaatgaaattaacgaaacgacatttgatcctcgttttgttcccattattaattgcgatcatcatctatgcaggtttagctgcttctataccgaaagctggcccactaatgaaaccagtaactactgtgagagaagatccaaataaaaaagaaaaacttcactacatagctatcggagattcgctgactgaaggagtaggagatcaaaccaagcaaggaggattcgttccccttgtcgcaaatgatctaaaagaccgttataatttgaccgcggttgaaacagaaaactatggtgtaaatggtgaacgaagtgaccagatcttaaagcgagtaaaaacaaaagaagaaattcgaaacaatatcaaaacagctgattttatcacactgactgttggcggtaatgatttgatgaaagttatccaaaataatttattcgggttaacggtcaattcctttaaaaagccactgaaaaactatcaggaaaatgtcacagaactattggaagaatttcgatccctcaataaaaccgcacctatttacattttaggcatctacaatccattttatttgaactttcctgagatcactgacatgcagacaattgttaacaattggaacaaaggaacagaaacggtgacaaaaaaaatgccgaactgctactttatcccaatcaatgatttgctttatcaaggattgaatcaggaagtaggtgtcacagaagaaggaacagatcaaacaactagcacgacagaaaatctaaatggcatcaaaaataatgtgctctatgaagaagatcatttccatccaaataatttaggttatcaattgatggcaaatgcagtgagagatcagctgatcgagacacaaaaccaatggttagagaaggaggatgatcaataa

SEQ ID NO: 1599 - DNA (genomic), 582 bp, Enterococcus faecium; double-stranded, circular
  misc_feature (B) LOCATION 1...582
  hypothetical: NO
  anti-sense: NO
gagataccgaacatgacgaaattaagtgaacttgaagcccttctttttattgttggcgaggaagggatcagtaatgaagaattaagcggactgttaaatctcagcgaagcagaagtcacaagtttagtgaaagaattaaaagaatcttacactcaaaactcgcactcagctttgcatatttttgaaacggaaagccattatgtattaacgactaaaaaagagctggctcccttacttaagcgatatgcgcaagggacatcaaacacattatctcaagccgccgtcgaaaccttagcaatcatcgcttataaacagccaatcacaagagctgaaatcgagcagattcgaggagttcaggtttcaggagcggtacagcgtctagctgcccataaactgattgaagaaaaaggtagagtagaaggaccaggtcggccgatattatatggaacaactggctacttcttagattattttggtttgaaatcattagaagaactgcctgatacacaagaaatggaaatttcacttgaagaagacgtgtcaccagatctattctttgatggaatgaataaaggagaataa

SEQ ID NO: 1600 - DNA (genomic), 255 bp, Enterococcus faecium; double-stranded, circular
  misc_feature (B) LOCATION 1...255
  hypothetical: NO
  anti-sense: NO
gaaaagccgaagaagcccacttggaaattgttcttagaaactttcaaagatgcaatggttatcgtattgctgattgtcgcactgattcagatggtcatgggtgactacatcgaattcttagttatttttgcagtattgatgttgaattctataatcagtgttgtccaaacaaaaaaagcagaaggttctttagaagcgttgaaaaacctttcagcgcccgatgctcgagtgattcgtgatggtaaggaaaaaact

SEQ ID NO: 1601 - DNA (genomic), 1047 bp, Enterococcus faecium; double-stranded, circular
  misc_feature (B) LOCATION 1...1047
  hypothetical: NO
  anti-sense: NO
ttggttacgaatctgatcttgtttgtctctaatctaatgatcgggcttttttcaggaactgtctccattatggctgatgctgtgaacactctatcagatactgcttcatccatattgactttgatcggatttaaaattgctgcaaagccagcagatcaggaacatccttatggacacgatcgcttcgaatatatcactgggttatttgtttcgatcatcattacttatgtgggatttcaatttttagagtcttctgctgaaaaaatcatccatccagaaaatgtctctttaacacccatcgtcttttttgtcctaatcatttccatctttttgaaatttgcacaaggcaaaatgtatcaggttattgcgcaatccattgattctgaaacattgagagctacagcaacagatagttataatgatgtctttactacactggctgtattgctttcagcagcaatcgaatgggtaactggatggcgtattgatggatatataggttttgctttagcattatatatcctttatagtggattgacgatgcttcgaaattttgtatacgaactattaggaagtcgcccaacgccagcagagattgaagaaatggaagagcatttaaatgcttgcgatgatatacttggctatcatgatttattggtgcataactatggacccaataaacgctttgcatcagtccacatcgaagtagatgaatcaatgaatttgaatgtggctcataagattattgatctgatagaaaaagactttaaaaagtctttggatgtggaacttgtctgtcacttggatccaatgcctgttgataacgaaaaatactataatatcttgcggcagttaaagcaaattcttcttgaaacaggtacagggcttaatattcatgattttagagtaattcatcaaggaaaaacgctgcaatttgatgtagtggtccctgagaaattccagtttgttgatacagaactagaaagaatcttacgtagtcaaatagaagaaaaaaatcggagattaccaattggaaattacgtttga

SEQ ID NO: 1602 - DNA (genomic), 3345 bp, Enterococcus faecium; double-stranded, circular
  misc_feature (B) LOCATION 1...3345
  hypothetical: NO
  anti-sense: NO
attttaacgaaaaaaaaggcggaatgcaagatgtttttcccacaactttatacaattacttcttattctcttttacaaagtacgatacgtattcgagaatatgtacaagaagcaaaaaaacaaggctacacttcattagccataacggataaagatgtcttatacggtgcacctgaattctatcgtatttgtgtagaagaaggagtacagccaatcattggattacatcttagttatacttatgaagaaaaaaattatggcttgcttgcgtacgcaaaagatgaaataggttatcagcagctgatgaaactttccagccgaaaaatgatccaagaaaaattggaacttgcagaaatgacagaaaccgaccatctagcgtttgttgttccggcaaatcattctgtttctgaggctttcaataaagaggataactttttcggtcattggcagtttttacttgaaaatgtttttactagaaatttttatatcggcttgacagaaaacacgcctgatcaattgcctgaatggtatcagtatgtgataaaagaaaattattcgctttgtgcattacatcccatcgctagtttacaacaagaagaactttttgcacttgaagtgatgaaacatatcaaagagggaagccaaatacctttagaaaatttatctgcatctttaccactaacagcaaatgtctatcttctttcagaacaagaaatgatcaaacgattggaaaaagcgggtctttcccaaagtgtaataggcgcccagcgtttagctgaatcgatttcatttgaattccagttccatcagaaattacttccgcattatccagttcctaatggaaaacaagctggagaatatttaagagagttatgctattcgcaagtggaacgccgaatcactgactatacaaaggaataccaagaacgtttggactacgagttatctgtcatccatcaaatgggattcgatgattatttcttgatcgtatgggatgtaatggcttttgctcatagagacaaaatcgttaccggtgcaggtcgtggttctgctgcgggttcattagtagcctatgtgttagaaatcacagatgtggatccattagaatatgatttgctgttcgaacgctttttaaaccccgaacgctttacgatgccagatatcgatttggatattcctgacaatcgacgtgaagaagtattgaattatgttcgagaaaagtatggacaatatcatatggcacaaatcgcaacatttggcacaatggcagcaaaaatggttcttagagatgcagctagagtgtttggtttatcgcaaagtgaagcaaaccgctggtcaaaagcaatacccaatcaattgaaaatcacattgacccaagcttataaaacttcgcatcaattagtagaattagttcaggcaagcgaaaaaaaccaacttttattcaaaactgcagtgattttagaaggattgccaagacatgtttcgactcacgcagcaggtgtagttatcagcgataagaatctacttgaactagttccgctccaacgcggttctgatgaagcttttctgacccagtatacgatgaatgaggtagaagcaatcggtcttttgaaaatggactttttaggactacgcaacttatcgattattgattttactttgaaagctgttaagcgagtagaagggtatgagatccgattaaaagagatcccgctaaatgatgcaaaaacgctgctcttgtttcaacgaggcgaaacctcaggagtatttcaatttgaatctgctggtatccggaacgttttacgaagattagatccagaaaacatcgaagatattgccgcagtcaatgcattgtatcgaccaggccctatgcaaaatatagataccttcattgccaggaagaaaggaaaagaagccattcgctacccagatgattcactgatcccgattttgaaaaacacatatggagtgatcgtctatcaggaacaaatcatgcagatcgcctcgactatggctggatttacattagggcagtcagatattctgcgacgggcagtgagtaaaaagaaaaaagacgtattagatgaagaaaagtcgcattttgtatcaggagcattacaacagggatattcggaaaaaacagcagcgaccgtatatgaatatatcgaaaaatttgcaaactatggattcaatcggtcacatgcatttgcttattcattcgtgggattccaaatggcgtatctaaaagcccatcatccaggtgctttctttaccagcctgatgaattctgttcggcataacacatcaaaattgaaagaatatattgcagaagcacgtaaaaataaactcaaactttcctcgccgtccattaatcaaagtaattccagttttgagttggtcaataaggaagaaatcagattcggactgacagcgataaaaggtattcggcgtgattttgtagaagatatattaaacgaaagaaaacaaaatggcccgttccagtcagtggatcaattcctcatacggatcgataagcgttggctgaaattagagttactgcaatcactgacagcagtaggagtttttgatgaattatctcctaacaggaaacaattgatgcttgatctcgaaggaaaaatccaaaatatcgtttacagtggtggaagtcttgacttgctgggaatcatggcattaaaagaagaagaagtcgctgactatacactagaagaacgcttgaagctggaagaggagtacttaggtatttatttgtcaggtcatcctgcagaagggtttgatcgtcttcgtttagctaaacaagttcagctgattacagatatcgtccctaatcaaccagtcaatttattagtgatgatcaaggaagttagagaaattcggacaaaaaaaggagaactgatggcctttgttgaaggaaccgacagtagtggagaaatttctgtcacagtttttccaactctttatcgtaaatatcgtaatttgtttgccgttgatcgagtgatctttgttcaagggcggagcgaaatcagcaaatataatcaggaactgcaactaattggagaaagctttgctgatcctaaccagttagaagcccagtatccttcacaaacttgctatttgcgtattacagaagaacgggaagatcccgagataatgaaacaattacaagtgatttttcagaaacacccaggatatataccagtagttatgtatcacgaaaaaacgcaacgaaaagtagttctgtcagatgcttattgggtggatgacagcaagagtataaagcggcaacttatttatctgcttggcgaagataatgtggttttcaaataa

SEQ ID NO: 1603 - DNA (genomic), 330 bp, Enterococcus faecium; double-stranded, circular
  misc_feature (B) LOCATION 1...330
  hypothetical: NO
  anti-sense: NO
agtaaaacgaaagttcatgcttctacaatctcttcttatacaattgaagaacaaagagcggtccaaacagaaatcctgtttggaccgctcttttattttaaacatttttcattaccaaaatattcgagtcgcgtttcttatgcttcgatctctgtaacgatacctgaacctactgtccgtccgccttcacgaattgagaatgtcgttccgttttcaacagcgattggatggatcaagtcaacatcaatcgtcacgttgtcaccaggcatgaccatttctgtatcttctggcaatgtgattgttcctgtaacatcagttgtgcggaagtag

SEQ ID NO: 1604 - DNA (genomic), 918 bp, Enterococcus faecium; double-stranded, circular
  misc_feature (B) LOCATION 1...918
  hypothetical: NO
  anti-sense: NO
agcaaaacgaaaaccgctggtatggggaaatcgacctttcggagaactgcaccgtctatgtctgcgccaacggccatgatgggaaagtgtatgagaaatcccgctatattgagtgtttcgaccgcaccgcgcctgccttacgcgccggcatggacgggcggctgctccgtgcggaagcaagcgacgacctttccggcgtggccgcaatctatattgacgggcgagaaatacaccgatttaaccaacggcacactggacataccgctgcgggatttgccggatgattacgaacagctttccgtgcaggcggtggacgctgcgggaaataaatcaaaaatcgtgcaggtcaagaaccccaactatcaggcggaggataacaagcagaagccctccaccggccagacacagcccccggcgaccaccgcgccggttacatccaccacgcctgcgccaacgacaccggccaccagcgcaaccacacccccgactacaccgaccaccaatccggcaacaacgactgccacaaaaccggctgccggcacgggcagcgcaaagccctccgcttcggcaagcgcagccccggacgaagaaacggacaccacgccccgcgatccgatccctttgaccccggacggccaggctaccgttctggacaacgccaccggtgaggacggtaaggagttttataccatccagacaccggatgaaaacgtattctacctgattatcgacaaccagcgcgatacggaaaacgtgtatttcctcaatgctgtcaccgaagccgacctgatggctcttgcagtaaaagaggacgatacgccgcagacagacgcaatccctgacccggagccggcctgcatctgtacggaacagtgcgccgccggcgaggtcaacaccgcgtgcccggtctgcacctga

SEQ ID NO: 1605 - DNA (genomic), 879 bp, Enterococcus faecium; double-stranded, circular
  misc_feature (B) LOCATION 1...879
  hypothetical: NO
  anti-sense: NO
agccagacgaatagctacaatcatcaaaaaaatgaaatcgatttcgtagttggcgttggcggaggaaaactgaccgatctagtgggttatagtgccaatcttgcaagaatcgatttcggagtcatccctactttagctagtaattgtgctccatggacacctcttgctgtcatgtataaggagaatggacaagcagaagggaaaacagaacacttttacagacaagctgctttttttataacagatccccaattagtgattgattcccctgttccatatttcattgccgggttagcagatacactagcaaaatggtatgaatctgagctcatcttagaacaagattttttgcaagatgaatcatttttgaagctagcacaagatactgcgaagatctgcaaagaagagattttgaatcattctgctaaagcaatccaagatatggcacaaagaaaactgacatcggagttcaaacagctttcagagattatctttgctgttgctggtttagttggaggattaggagataaatacgcaagaaatgcggcagcacatgctatgcatgacgctatcagtaaatatattccggaaagccatcgttttctacatggagaaaaagtagcgtatgggattttctatcaactggcactagaaggtcgctgggaaaaaatagacgagttatatcctttgtatcgggaattagaactgccggtttctctagaacaaatgggattatttccgaaagataaacagataatagataaaatggctgaatttattgattcgaaagagaaagtgcatttgattcctatagaggtaacacagaaatcactgatacagtcaatgatggaactggaaggttatatcagaaagatctga

SEQ ID NO: 1606 - DNA (genomic), 576 bp, Enterococcus faecium; double-stranded, circular
  misc_feature (B) LOCATION 1...576
  hypothetical: NO
  anti-sense: NO
ggaggtgcgaaaatgaataaaggtgtaaaaacgatcggagtgatcggaacattacttttgctatctgtgcttttgtttgcgatactattaagtgcaacctatccattgccttttcagctagagaagtttcgattcttttccatcactaattcatacgtgcaacaatatgtattttggcttgccgttgcatttgctattttgacaattatcacgttacttgttttcctgttttatccaaaaacaatcggaaactttctactgaaacatggtgatggggagttgacgttggataaaaaagcaattgaaggaatggttcgttctcacttgcatgaagatgaattcatccattcaccaaaagtaaatgtcaaagcaacgaaaaacaagatcgccgtcaatgtaaaaggggagttgaaacgaacttcagcactcattggtaaaacaggaacattgatgaaagaaatcgaaaatgaagtacaacacatattgggaacaaaagagccagtgaaagtatcggtgaaatacacaggctttgaagaaccagctaaacgaagcaatgaccgcaaacgagtagaatag

SEQ ID NO: 1607 - DNA (genomic), 1542 bp, Enterococcus faecium; double-stranded, circular
  misc_feature (B) LOCATION 1...1542
  hypothetical: NO
  anti-sense: NO
gattacgcgaataaacgagcgggtaaagaactgcagtctttgttagataacaccccaagaattgcccatcgattcaaagaaggaaaattgcaggatatagtaatcgatgaaataaatattgatgaccagttactagtcaagcctggcgaacttgtacccgcagatggtcgagtgaccaaaggagaatcttcggtcgatgaatcttctttgacaggtgagtcccgcccggaaaccaagaaacctggagatcagattatgtcagggtctttaaatggagacggatcgatccaaatgatcgctgaaaaacgtgccgcagacagccagtatcaaatgattattaaactagtcgaagaatcaaaagaaaagcctgcccgatttgtccgtttagctgatcgttatgcagtccctttcacgttgattgcttatttgatcggtggtatttcttggtggttctcaaaagaccctttacgatttgctgaggtactggtagtggcatcaccttgtccactgattctagctgcgcccattgctttagttgcaggaatgagccgttcaagtaaaaacgggatcgttgtaaaaactggaacaacgattgaaaagctcgcacgtacaaaaacgattgcttttgataaaacaggaacgcttaccaaagggatattggaagtagaggcgattcagccagtcaatggaataaaaaaagaagagctacttctgtatgcagctagtgcagaacaggaatctagccatatcttagctcgttcgttagtgaacaacgtgaaaaacagccaactgtatcctgttagtcaactgaaagaagtgaccggtcaaggaatccaagcagtagtcaataatcatgaagtaaagattggacgtgcctcttttgtttcagctgaagaaatagaaacgtccaatacagcaatctatgtaacaattgatcgatcttttgcaggaacgatcctattttcggatcagattcgcccagaagcagcaaagacaatcaaggagctaagaaaacttgatgtgaaaaatttgatgatgatcaccggggatggatctgccattgctcaaacgattgcagaaaaagtccaattagattctgtacatgcccgtagcttgcctcaagataaactgaccattttagaaagtatccctaaagatcaaagacctgttgcgatggtaggagacggcgtgaatgacgcaccagcacttgctgctgcagatatcggtattgcaatgggggctcatggttctacagctgctagtgaaagtgcagatgcggtcatcttgaaagatgatctcttgcgtgtagcaaaagcagtagtgatttcaagagatacgatgagaatagcgaaacagtctgtactgattggcatctttatttgtatttttttgatgttaattgcaagtacgggactaatccccgcattattcggagctgttttgcaagaagtcgtggatacggtctctattttgagtgccttgagagcaaaaaaagatccagccatttttcctgattcagtacccaagacaaacatagtatga

SEQ ID NO: 1608 - DNA (genomic), 1539 bp, Enterococcus faecium; double-stranded, circular
  misc_feature (B) LOCATION 1...1539
  hypothetical: NO
  anti-sense: NO
caaatagcgaatttaggactaaagtattctagtagtttcagaaaaaattcagaaagaaggagaaatatgagtaacaaccaacccgtagatatttacggaaaaccatataatcggacacttttagttgttgtcttattaattggtacattttgtaccgttttgaatcagaccttattgacgacagcttttcctacattgatgaaagctttcgatatttcagcgtctgatgtgcaatggttaacgactggtttcttgctagtcaacgggatcatgatcccaataacagcatggctgatcaataaattcagttcaagaaatttatatctttctgccatgacgatctttttgatcggaacgattacttgctttacagcacctaattttagtacattactaatcggtcgtttgatccaagcttgcggtgtgggagtatcgatgccattattgcaaaatatcatgctatctattttcccgccagaaaaaagaggatcagcaatggggatgtcagggatcgttattggacttgctcctgctttaggccctacattatctggttatatcattgataactaccattggcgtgacttgtttggtatggtactgccaatcgttgttcttgtcttggttttagcattcttcctaatgaaaagtgttattccattgtcaaatcctagcattgatattttatccgctattttatcaacgattggattcggtagtttactttacggattttctagtgtaggagatgacggctggggaagcttgaaagtaattggtttcttagttgttggtgtgattttcatcgccttgttctcatggcgtcaattacatttggaacatccattcttggaacttcgtgtattcaaatcatctacattcacgattgcagctgttttagctggtgtaacaaatatggcgatggtaggggcagaaatggtcgtaccattgtatattcaaaatattcgtggagaatcagcattccattctggcttgatgttgttgccgggtgcattgatcatgggggctatgatgcctgtgacgggtgcgattttcgataaatacggcgcgaaacgtttagccatcacagggatgttcattttgacagcggcaactgcaccatttgctttcttgacaaaaacgactccagttttatatatcgtgatcctttatgcgatccgtatgtttgggatctccatggtcatgatgccggtaacgacttctggtatgaatgcattgccaaataacttgatcagtcatgggacagcggtaaataatacattccgtcaaatcgcaagctcgattggtacagctattttgatcagtgtgttgacgaatgtgacaaaagcaaatatcccaagcaaatctgtattggataatacgccattagcttataaagatcaggcaatcaatgccacactgtcaggttaccatgccgcgtttatcgtagcgatcatctttgggattcttggctttattattgcctttttattgaagaaaaaagaacctgttctaatgaaagcgggggataatgcatga

SEQ ID NO: 1609 - DNA (genomic), 198 bp, Enterococcus faecium; double-stranded, circular
  misc_feature (B) LOCATION 1...198
  hypothetical: NO
  anti-sense: NO
ctatcagcgaagtttccaccgatattatttacttttccaaatgaatttattcaaaggagtatttttattgaaattgatctttttgaattaacgaagaaggaccgcgacacagatttgtcacgatccttcttttttatacctacaagtaaacagatgcgtaaactaatttatacgatcattctgcgtattgaagagtaa

SEQ ID NO: 1610 - DNA (genomic), 468 bp, Enterococcus faecium; double-stranded, circular
  misc_feature (B) LOCATION 1...468
  hypothetical: NO
  anti-sense: NO
aactttcagaaaaggtttgttagtaaaatgaaagctatacgtaaggagtgttgtttgatgaaattttttcaagagtttttcattattattttcttttctgtattaggagaaggcatacggatttttgctcatttacctattcctggaagtatcttaggtattctttttttatttttagcatttgaaatgcatcttgttgatcctgaaaaaatcggagcaactggtgattttttattgaataatctagccattttatttgttcctgctggtgtaggtttattggaatattttgatgatattgcttcgatatggcctgttttactgggagcagtcgtcgtgtgttccatcgtcacgatggttgcagcgggaaaaacggcagaaggtgtagaagctttgctgggctatgtccgtaagaaaaaagcagaaagggtatctgtaaacgaaatggaggagaatcaaattgactga

SEQ ID NO: 1611 - DNA (genomic), 729 bp, Enterococcus faecium; double-stranded, circular
  misc_feature (B) LOCATION 1...729
  hypothetical: NO
  anti-sense: NO
aaatttcagaaatataaacctatcttaaaaggagagctaaacatgccaaaattagttttttctcgtcacggtcttagtgaatggaatgcattgaaccaatttactggttgggctgatgtaaatctagcaccagaaggaatcgaagaagcaaaagaaggcggacgcaaaatcaaagaagctggaatcgaatttgatgttgcttacacttctgttttaactcgtgcaatcaaaacatgtaacttgatcttagaatattcagatcaactttgggtaccacaaatcaaatcatggcgcttaaacgaacgtcactatggtaaattacaaggtttgaacaaaaaagaaacagctgaaaaatacggcgacgaacaagtgcacatctggcgtcgttcttacgatactcttcctccattaatggaagaaactgacgaaggttctgcagcaaatgaccgtcgttacgcaatgttagacaaacgcgatattcctggtggagaaaacttgaaagtgacattagaacgcgctttgccattctggcaagatgaaattgctccagcattactagacaacaaaactgttttagtagctgcacatggtaactcattacgcgccctagctaaacatatcgaaggtatctctgacgaagacatcatggatcttgaaattccaacaggtcaaccacttgtttatgaattaaatgatgacttaacagttgctaaaaaatactacctataa

SEQ ID NO: 1612 - DNA (genomic), 1035 bp, Enterococcus faecium; double-stranded, circular
  misc_feature (B) LOCATION 1...1035
  hypothetical: NO
  anti-sense: NO
caccgccagaagaaatccaacgtcgctgggctatctttaaagagaaacaaaaacatacttacggtcaaggaggaattgctgatgccaaataaactacttgaagttaaaggattgaaacagtatttcaatgtaggaaaaaagaatgaagtacatgctgtaaatgacatcagctttcacatttatgaaggagaaacattcggtttagttggagaatctggaagcggaaaatccactactggccgtacgatcattcgcttgaatgaacctactgatggtgagatattattcgacggtcaagatataacgaagatcaaagataaaaaaggtttgacgaaattccggcatgatgttcagatgatctttcaagatccatacgcttcgttgaatcctcgtatgaaagtcagagatatcattgccgaaggaattgatgttaatggactagctaaatcatctgaagagcgtgcaaaaaaagtcgatgatctattgagaactgttggattgaatccaagccacggtactcgttatcctcatgaattttcaggtgggcaacgccagcgtattggtattgcacgagcattggcagtaaaaccgcgttttatcatttgtgatgaaccaatttctgcactagatgtgtcgatccaagcccaagtggtcaatttgttgcaagatctccaaaaagaacatcaattgacctatctatttattgcacatgatttgtcgatggttaaacatattagtgaccgaatcggtgtaatgcataacggcttgttattagagatgggaacaagtgatgaaatctataatcacggtgttcatccttatacagaaagtttgttatctgctattcctctaccagatccagaccatgagagaaaacgcagaagaatcaaatatcaacctgaaccagatgacggacaagtacgtcaacttcgtgaaatcgcaccagaacattttgtctatgcaactgagcaggaagtcccatattacgcaaaaaaactaaaacgacaaaaggaatctcttctggttgctaactag

SEQ ID NO: 1613 - DNA (genomic), 981 bp, Enterococcus faecium; double-stranded, circular
  misc_feature (B) LOCATION 1...981
  hypothetical: NO
  anti-sense: NO
ctcttacagaaagaaggacttttaatgacttttccttattcagaaggaaataaaagatatcattcttggaattacgctttacgaaatgagtttggcgggaaaattttcaaggtgccgatcgatggaggatttgactgtccgaatcgagatgggactgttgcccatggcggttgtactttttgcagtgtatctggttcgggagacatgatcgttgcacctgaagaccctcttccaatccaattccagaaagaaatcgacatgatgcatcaaaaatggcctcatgtccaacaatacatcgtttatttccaaaattttacaaacacccatgcgccagttgaaataatcaaagaacgatttgagcaagtagtcaatttaccaggtgtcgtaggattatcagtcggtacacgaccggattgtctgccagatgaagtagttgattaccttgctgaactgaacgagcggatgtatttatgggtagaacttggattgcaaacaacttttgaagaaacttcaaaactgatcaaccgagcacatgattatcaaacttatttagatggcgtggctaaattacgcaaacataatatccgtgtttgtacgcatttgatcaacggattaccaggcgaaagtttagaaatgatgaaagaaaatgtcagacgcaccattttagattcagatatccaaggaatcaagctccatttgatgcatctgatgcgcaaaacgagaatgttgcgggactatcatgaaggtcgccttcaattaatgagccgtcctgactatgtcaatgtcatttgcgaccagctggaaatgataccaaaagagatcatcatccatcgtttgacaggggatgcgccgtgggattccttgattggaccaatgtggagcttgaaaaaatgggaagtcttgaatgcaattgatgaagaacttcttcgcagagatagcttccaaggaaaatatgatgtacggaaaaaggtgagcgtctga

SEQ ID NO: 1614 - DNA (genomic), 1113 bp, Enterococcus faecium; double-stranded, circular
  misc_feature (B) LOCATION 1...1113
  hypothetical: NO
  anti-sense: NO
aaacagcagaacgttcttttgaaatggagtgaaaaaattatgagtaatgaacaaaattatgaaacaggcggaacttatcgcctgtttcatggaagtatgaataaatttgatgaatttagtttagatcataaaggtttaaacggaacagctaatggatttggtgtgtacttaacacctaataaagaaatggctacaatgtacgctgaacagggtagtaacggaaataatggtttcgtatatgaagtaaatgttgaattagagaagccgatttctatgaatgaacgcactattactgatgaagagctttctaaagtaatagataaattacaagaaagtaatgatattttaaatgattacaatgatgttagttattacggagaaaaagttgtaaaaagagaagtgattgcttctcttagtgagaatgaaaatgacgtagatttgattaacgacattggaaatacaattggagatcatgaagctactgctaaggcattttatgacgttgggaaatatacacatattattgcggaagaacagttaagacaaaaggatgtagttatcgtagtgttacagcctgataaagtaaagattgaaactattcacgatttaaacgaggaacggaatagcttagaaagtagtgaggacatgacagataaatttgttgggcataaggtttcggaagttcccattcgagaagttgtgataaaagattttgagcaagagctagaaacaactaattattatgacaaacaagcttggcaagagcgcattgaatacttagaaaacatggaagaaccagtttccagattagcattagatagtgatattaatgaattttatgatagtcataaagaagaaattgaaacgaaattgacaaatttatccgaaaagttagagatcgataaagaagaactgctaggttttccagtagatacttcttctacggaatacaaaaaagctacgtctatcatggcttacaacggtgcaatgagagaaatttataatgaaattgaaaatgatacgtttgaaataccacctgtttctgaagaaatggagaataagattttgaaattgactaattttgaaaatacaacaaaatttgaaatggagtag

SEQ ID NO: 1615 - DNA (genomic), 186 bp, Enterococcus faecium; double-stranded, circular
  misc_feature (B) LOCATION 1...186
  hypothetical: NO
  anti-sense: NO
attaagcagaatcagtccatttcatccgtctgttctggcagaaaaataccagcgaaactatcgtccatttttgctgggagcacccgggacacaatcgttaagccaatatatgatgatgcgttctgcaggagatgctatgaaaaacaagaaagtcgtctttattatttctcctcagtggttcgttaa

SEQ ID NO: 1616 - DNA (genomic), 1110 bp, Enterococcus faecium; double-stranded, circular
  misc_feature (B) LOCATION 1...1110
  hypothetical: NO
  anti-sense: NO
gctgttaagaaaacggtttccatgtatactggaatcagtgcaaatgaaagaaaagagggtgcaaggaacatggaaatcaatgaacaaaattttggcgaaaactatcacttgattacgatcacgaatcaaaatgggacatctttgtctgtcagtgatcttggggcacgggttgttcattttcaaacaataatcgataatgaaaaacgagagttgatcttaggttttgatgaagcaaaagaatatctagaaaaagacccttatatcggtgcttcaatcggacgtatggctggacggattacgaatggcacattcaaattagatgatgaaacgttcgaagtaaaaacagacccggacactggtcattgtttacatggtggtgcacctagctttgaagccaagcagtggcattatacagtcatcaatggtgaaaacgaagcatcggtcattttctatcagactagcccagatatggaaaacggatttcctggaactttagatgtagaagtacggtatacgctgacgaacgatgatacatggcgagtgacggtccaagggatcagtgaccgcaaaacagtattcaatcctacaaatcatgtctatttcaatttaaccggtgatccagcacagtcaatcgacgaacatatactttggttgaatagccgattatttgctacgctcaataaagatacaacgcctacaggagaagtagtttcagtaagtggcacagcatttgacttccaacgtcctaaaaaattaggtgaggtctttgccagtgattttcgccaatcaatgatagtgggcggcatcgatcatccatttttgttgaaaaaacaatctggtttactaaatgctgcggaattgacaagcccagatgaaaaagtatcgatccaagtaaaaacagatgcttcaggaatcgtgatttttacagcaaattttggagaagatggaccggaaatgcgcgggaataaattagtaaatcatggcggtatcacatttgagactcaagaactgccaggagcggagcgacttgaaagttttggagatgtcactctggaacctaaccaagtacgcgagtttgtaacggaatacaaaataaatataaagaaatag

SEQ ID NO: 1617 - DNA (genomic), 297 bp, Enterococcus faecium; double-stranded, circular
  misc_feature (B) LOCATION 1...297
  hypothetical: NO
  anti-sense: NO
gaagttaagaaatttgcgcatccaaaagaatttgacacaagaagaactaggcgaacgcacagatttgtcagaagggtatatttcccagttggaacgagatttaatgctttgaaccaacggatgaagcaattggaagaccaaatgaacgagtattatcaccgcgtaacaaaatggttcactagttctgaacatgcagagcagttaaacgctattcttcaattggcagaaaagaatacgaatggtttttacgcaatgcagcagttatattactgcattgctttctggcaatgtcaatga

SEQ ID NO: 1618 - DNA (genomic), 525 bp, Enterococcus faecium; double-stranded, circular
  misc_feature (B) LOCATION 1...525
  hypothetical: NO
  anti-sense: NO
ttaactaagaaaggagtgcttttcatgtcacgacaagaaaaaataaacatcgtacttgatgcaaggccgagactagttcacatcatcaaatgtgccacagatgatcaacttggggaatatgtcggaaaagtgttagatgatatggttatgactgtcccgtttactgatgtcccaccattagaaggaattcgttcagatggggagcctttaacaattaatgatcaattatttgatccgcaagaaaaccgatggattgttttgacgaatgtattggatcacaataagctaaataatcttgaagcagtgtacgaggcactggaaaacgagaacggcaatctaaaacagctcaatgccaaactcatgctaaatgatgtagcaattaaacaggaaaacactgcattaaaagaaaaagctgatagtttagcacaaatcaattcaaaaatgatgcttgcttcgattcaaaacagcaaggatattgcagaaattaaagagcaattaaatccagcttcaaagggaggcgagtag

SEQ ID NO: 1619 - DNA (genomic), 1494 bp, Enterococcus faecium; double-stranded, circular
  misc_feature (B) LOCATION 1...1494
  hypothetical: NO
  anti-sense: NO
aatcataagaaaaactggaggcgtgtatcaggaatgctggaaaattacatcgagcgaaatatatttagaaaagtgtatctgtgtgaacaattatttgaattccaagaaatagacatcgaacaaacagctatttctctaagggtgactacaccaacgatccttcacgatctagaaagtctagccgagtgtctagaatattgtataaaagaacaagtaagagagaagcataagtataaactcgtattcaaacatggtattgctctttctgagctcacacagtttctgtacggtcaatcttattttttaaagtttttaagttattattttaatggtatattcacgagtacagaactggctgatcttgaatttatttctttgagcaaagtatatacaatcaaaaaaatcgtattggatttttttaaagaaaatgattatttgaaaaataaagaaatcattatcccagaatttgactcgcggaacatcttgctagctttagtacgttatgtcaattgggaaggctatgaaaataaaaatccgtatgtagaagaagcttgtaacgagttgattgattatgtagagactcatttttttaaaagaagatattcggaagatgaaaagtcctttatcatacgaggaatagagatcgcaatcggaagaaaggcatttccccttggactgaaagaagaagataagaaaagcgcagaaacgaagccgttatttcaattagtctgtcaaggattggaagagcaaaaaggaattctagacttacaagaagaagatgtctattatattttttctttgttcaacagtagaaattataccaatgagaacatggagctgttaagaaaagatttcgaagttgtttataaaaattttgttctcaatgacctatcactgaatgaattgattttacagattattagtatcgctgaaatcgacgatgcagaaaattttattttcaagcaatcctttttacaatttgtccgtacgttgtgggcagatggacaagtatttttaccggaaaggatctatcttctatcagaaaaagaacaacttctgtacggaaaaattgtagaaatattggaagagtggaaaaagaaaaatcaaatccaactaagatggaatgaaaatttcattcgaaaattcgtcaaaagtctttctttgatcaacagtgaacaagcggggagacaggaaatagaaatttttgttgtttcagaaagttcagtcaaacaatttttttatcgaacccaatttcatttgtatgcggaagaaggcatcgctgaaataaatcctattttatttcgttcattagaagaattgcctgatgaatgtctatgtgcgaaaaaaagagtggttttgtgcgatgctgctagctatcaaaatggattagaaactgaaaagacaaagatctatccaatctcattaaaaggtgcaaacatccatttgtatcatattgctcaggaacttcacctattaaaaaaacatatttcttga

SEQ ID NO: 1620 - DNA (genomic), 252 bp, Enterococcus faecium; double-stranded, circular
  misc_feature (B) LOCATION 1...252
  hypothetical: NO
  anti-sense: NO
aaacataagaagctgtttttacttggctgttcttattacttgatgcaaggcagctttttcacaacctcttttcaaatatttcgttttcttattctacaaatggttcttctcctaacgcttgttgagcggctagattcaacatgctccattgtcggtcaaagcctggctggaagaagaagtcagcttctgctagttcttctaaagtcagtttgttttggatcgctagtgccaatacatttccttgacctgtaa

SEQ ID NO: 1621 - DNA (genomic), 366 bp, Enterococcus faecium; double-stranded, circular
  misc_feature (B) LOCATION 1...366
  hypothetical: NO
  anti-sense: NO
aaacataagaagctgtttttatttggtcgttcttattacttgatgcagagcagcttttttacaacctcttggtacacggtgttcaatcagctgaccctcggtattagctcaaaaaaacggcaaaatatgaggaactatttttccatttttttctctaatactcaggtcaaaacactgatttcacaacctctttttttaatgaaaaatatggctctcatgcgccgcttctttgaatttcgtcattttttcttcgatgaacggatagattgccgttcctacgattccaaagacaacaaacaaaccgatcatgatccagattgctttcgtagcatttggccaataaattcctcctgcagattcccgtaa

SEQ ID NO: 1622 - DNA (genomic), 996 bp, Enterococcus faecium; double-stranded, circular
  misc_feature (B) LOCATION 1...996
  hypothetical: NO
  anti-sense: NO
aagaataagaagagaaataggagagaaaagagcatggaatggacacaagcattgattcccattgtcagcagttgtgcaatgacaattgccgcaatgccgctatttattggttattttcaaatgaaaaagcaaggtcaggcgattcgtgaggagggaccaaagtggcacaatagcaaagccggaactcctacaatgggcggcttagtgtttctgatcggctctattttgacaggaatttgggttggagcttggcaaaaacagctaactcctactcttttcatcttgctttttgtattagcgttatacggagtaatcggctttcttgatgattttataaaaatattcaagaaaagaaacatgggactgaactcgaagcagaaattgattggacagattctagggggaatcatcttttatcttgtttaccgttctgaaggttatccaggtgtattgaatttcttcggactagatctacctttaggaatcatttatggtattttcgctctcttctggcttgttggattttcaaatgcagtaaatctgacagatggcatcgatggattagttgctggcttaggaagtatctcttttgcagcttacggtctaattgcttggcatcagcatcagtatgatgtattaatcatttgcttaagtgttttaggaggtttactgggtttcttcgtctacaacagaaaacctgccaagatttttatgggagatgtcggttcattagcgttgggcggacttttagcggcaatttctataatgctaaaccaagaatggacattgcttttgattggtttgatctatgttatggaaacagcaagtgtgatgcttcaagttacttcctttaagcttacaggaaaacgaatttttaaaatgtctccaattcatcatcactttgaaatgtgcggatggtcggagtggaagattgatacagttttttggttgatcagcattgtgacttcgttgatcacattatggatcgtttggtag

SEQ ID NO: 1623 - DNA (genomic), 369 bp, Enterococcus faecium; double-stranded, circular
  misc_feature (B) LOCATION 1...369
  hypothetical: NO
  anti-sense: NO
cttagtaagaatttgatagctaagacggaaaccacaaaagatacgaatgttcctacaagaagaacaacagtttcttccattttgaatgaattcccttcagctaaatatttgacgatcttcaagccgcttgcgccaaacatgacaggaatccctaagaaaaatgaaaactctgtagcgacaaaacgcgaagcaccaatcaagatagatcctaggatcgttgcgccagaacgggatgttccgggaacaagtgccaagacttggaataacccaacaagaagagctgcttggtacgtaaagtcattcagagaagtccaacgaggtgttttgtttttgttgcgtttttcgacaataataaaggcaataccgtaa

SEQ ID NO: 1624 - DNA (genomic), 195 bp, Enterococcus faecium; double-stranded, circular
  misc_feature (B) LOCATION 1...195
  hypothetical: NO
  anti-sense: NO
aaacacaagaatactaataaatcaacgattcttgtgtttttaatttttcactaccgtgcattttcgtttctatgttccatgtaccccaatcttgaaaaattaattaaagacttagataaagccattgacgacttagtcgtggtgctaccggagtatcaatgtttaaccagtatcccaggtattggtcctgtttag

SEQ ID NO: 1625 - DNA (genomic), 1494 bp, Enterococcus faecium; double-stranded, circular
  misc_feature (B) LOCATION 1...1494
  hypothetical: NO
  anti-sense: NO
tcaaacaagaaaactagcaagtttagggggatcgatatgaaaaaatttccagaaggatttttatggggcggagcgacagcggccaatcaatgtgaaggtgcatgggatgtagatgaaaaaggattatctgtgtctgatgtgtatacattcgacagcgatttacctaaagaaaaatggacagatcaatggcatatgatgacgcatcagcaagtaaaagcggcgcaggatcccaacagcaagtattattatcctaaaagacacggaaatgatttctatcatcactttaaagaagacatccgtttatttgctgaaatgggttttaaatgctatcggatgtctatcgcatggacaagaatttttcctcatggtgatgaagaaacacccaatgaagcgggattatttttttatgatcaagtgtttgacgaatgtctaaaatatgggattgagccagtcgtttctctttcccattatgaaatgccgttatatttggttacagaatatggtggatggcctaatcgaaagcttattcagttttacgttcgtttcgctgaaacagtattcaaacgctataaaaataaagtaaaatattggatgactttcaatgagatcaactgtgtaaaacatcacccttttgttagcgtaggagtaattgaagaaaaccatccccatttggaacaagcgaaataccaaggtgcacaccatcagtttatagcaagtgctttagctacaaaagcttgtcatgaaattatcaaaggttcacaagtcggttgtatgatcagctatcagcttcttgttccgtattcttgtgatccggatgatattcaaaaaacaattgagcagcaaagaacttctttgttctttagtgatgttcaagcaagaggatattatccagcgtatacgcaacgaatgtttgaagaaaaaggtgtcaacttaaaaatagaagtaggtgatgaagaaatcttagcagcctaccctgttgattttgtttcttttagctactacatgtctagtgcagtcagtgctcatccagaaaattgggaaggggtccaaggaaacttaataactggaggaattaaaaatccgtatcttccatcaagtgaatggggctggcagattgatcctaagggtttgagaattgctttgaatcaattatatgataggtatcaaaaaccactgttcatagctgaaaacggactcggagctatagacaaagtagaagaagatggaaccgttcaagacgattaccgcattgactatttgaagcagcatattgagcagatgaaggaagctatcaaagatggaatagatttatttggttatacgtcgtggggctgcattgatatcgtcagcgcttctacttcacaaatgtcaaaacgttatggatatatctatgttgatcaagatgacgaagggaatggcacaaagaaacggttaaagaaaaaatcatttgattggtacagacaagtcatccaatcaaatggcgaaatcctataa

SEQ ID NO: 1626 - DNA (genomic), 909 bp, Enterococcus faecium; double-stranded, circular
  misc_feature (B) LOCATION 1...909
  hypothetical: NO
  anti-sense: NO
atggacaagaatattggaggaatgaagatgataaaaggttcgatcgtggcgctgatcacgccgatgaatgaagagggatcagtagattatgctggtttggaaaaattgatccaattccatttagatgaacaaacagatggattattagttttaggtacaacaggagaatcttctacgctcacacaatctgaggaggagcagatccttcaactgacagtaaagaaagtggctggccgtgtgccggtgattgcaggagctggaacgaataatacgaaagaaacgattgaaaaagcgaagcattttgcttctttgggggcagacgcacttttggtcatcaccccttactacaacaaaacaagtgatgcaggactagctgctcattttacagcaattgcagaagcctcaccgattccgcttattttgtataatgttccttctagaacaggcatgtcgattccaatccatgtattagtaaatttagcagaacatcctaatatcattggtttgaaagaagcctcaggagatatggcttatgtgatggatgccgctcggttgattggagaagaattcttcctttacagtggaaatgatgatttgatcctaccagtaatgagtgtaggaggaagcggtgtaataagtgtatgggcgaatatccaacctaaaatagtccatgaattagtaaaagatacgcaggacggaagatggcagcaagcaaaagaaaagcaattaaatgcacttgaactgatccatgccttgttcagtgagaccaatcctattcctgtcaaagcagccatgtcattattagacttaccttccggacctctacgcctgcctttagtttctctttcaaaagagaaaaagaaacaattagctcagcttttgttaaaagaaaggacggttgaaaaatga

SEQ ID NO: 1627 - DNA (genomic), 255 bp, Enterococcus faecium; double-stranded, circular
  misc_feature (B) LOCATION 1...255
  hypothetical: NO
  anti-sense: NO
aaaataaagaaacgatggaacctgttcagactgtccgcaccaagggcaatcaaaacaacgttccatcgttttttggttacagaaaaaataggtaacaaaaagatgattcacttatcaacgcctcgtccacaagtcacgatattcatcaaagatgagaagctgttttttgaaattgctctttgtgactcagagttaaatgacaggctcacgacctctttcttaaacggtgttcaatcagctgaccttcggtattag

SEQ ID NO: 1628 - DNA (genomic), 1086 bp, Enterococcus faecium; double-stranded, circular
  misc_feature (B) LOCATION 1...1086
  hypothetical: NO
  anti-sense: NO
cgatcaaagaaaggaaaaccgatgaatcgaaaagacgaacatgtttcactagctaaagcctttcatgataaacaaaaaaacgaatttgacttcgtacggatcatccataaccctttgccgcaaatagcagtttctgatgtcgatctaagtacacaggcagttgggtttacactaagcagcccattttatatcaatgcgatgactggcggaagcgaaaaaacaaaaaaaatcaaccaagatcttgcaatcgtcgcaagagaagcagatttgatgattgccactggttcagtcagcgctgccttgaaagtcccttctttagccgatacttatacgattatgcgacaagaatatcctcacgggaaaatcattgccaacatcggtgcagggacttctgtcgaaagagccaaagaagctatccgattgtttcacgcagatgccttacagattcatttgaatgcacctcaagagttggttatgcctgagggagaccgtgattttaccaattggaaagtacttattcaagaaactcaaacagccattgacgtccccctcatcgtaaaagaagtcggttttggcatgacaagagaaacgctcaatgatctagctgctttaggagttcatacagttgatatcagcggtcgaagcggaacaagcttcacccagatcgaaaacgcccgtcgctccaagcgggaactgagttatttagctgactgggggcaatcgacagtctcttcattgcttgaagcaaatgaagcagacacttctatggaaatcctagcctccggaggtatccgcaatgcctatgacatatttaaagccctttgtctcggcgcaaatgccgtgggtacttcaggaaccgtactgacgcatctgatgaatcacggcgtagaagaaactattatactgatgaagcaatggcaagaagagcttcgtctgctttatactatggtcggcgcaacgaataccgcggccctacaccaacaatctctgatcttttccggaccagtgaaggattggtgcgaagcaagagggatcgacttagtgaagtatggaagacgcacagaaaagagcgtgggacaaaagtaa

SEQ ID NO: 1629 - DNA (genomic), 705 bp, Enterococcus faecium; double-stranded, circular
  misc_feature (B) LOCATION 1...705
  hypothetical: NO
  anti-sense: NO
ttgaaaaagaatatggatgtcgaatggggctattctggagacaaaggtccggaaaattgggcgagtttatgtgattggtttgcgagaggtgcggaatttccattgcagtcgcctattcatttgaccaagggggaagaaaccaaaatagaaggagacacgctttcctttcattatcaaaagcaacggtttactgacaaggaattcaaaaacacgattcatttagtaccttttgaccaactcagttatgtagagttcaagaaagaacgctattatttgacagatattcatttccacttgccttctgaacatatcatcaacggaaaacaggaagatattgaatttcattttgttcatatgaacagcaaaaaagagaatctagttgtgggtgtcatgtaccagctaatggtacaggaaggttggctgtataatcaagaaaatggggaaagttggaacttagaaaaacatgagcattgggtaaatccggatgtgttctttccggagcaaaaaagccatttccattatattggctcattgacaactccgcctaccagcgggccaatccaatggtttgtaatggatcatgtaggaaaactgaaccaagagtttcttctccccttcgatggtcagtatgctcgaccgaacaaccgaccaatccagcccttgaatggaagagaaatttattatttcgaggagtttgagcaatga

SEQ ID NO: 1630 - DNA (genomic), 2703 bp, Enterococcus faecium; double-stranded, circular
  misc_feature (B) LOCATION 1...2703
  hypothetical: NO
  anti-sense: NO
atgaaaaagaaagtatatatcatttctcatagccactgggatcgtgaatggtacatggcttacgaacagcatcacatgcgactgattgaattgatagacgatctactagagctatttgaagttgatccgtccttcaacagttttcatttggatgggcaaacgattattttagatgactatcttcaagtaaggccagaaaaaagacaggcaatccaacaagcaatcaatgaaggaaaattgagaattggaccattttatatcttgcaagatgattttcttatcagctcggaatcgaacgtgagaaatatgctgattggcatggaagaaagccgtaaatggggaacccctgtcatgttaggctattttcccgatacatttggaaatatgggacagacgcctcaattaatgaaacaagctggtatttcagcagcagcgtttggccgtggtgtaaaaccaattggctttgataatcaagttttggaagcagaaaactattcttcccaatactcagagatgtggtggaaaggacctgatcaaacagcaatctttggtctgctatttgccaattggtatagcaacgggaatgagattccagtagaaaaagaagcagctcttgccttttggaagcaaaaattagcggatgcagaacaatatgcctctacgaaccacttattgatgatgaatggtgttgatcatcaaccggtacaaaaagatatatcaaaagcaatccatctcgcaaatgaactgtttccagattacgagtttattcattctaattttactgactatctggaagcagttcaaaaagatgtgccagaagacttaggctcagtagaaggagaattgacaagtcaagaaacggatggctggtatactttagccaatacagcatctgctcgggtttacttaaaacaatggaataccaaggtccagcgacagctagaaaatattacagaaccacttgcgacgatggcttatgaagttagtggaaactatccccatgatcaattagattatgcttggaagacattaatgcaaaatcatcctcacgacagtatttgcggttgttcagtcgattctgtccatcgggaaatgatacctcgttttgaaaaagcagatgaagttggaaagtatcttgcacaagattccttagaacagctgaccgcagcaatcgatacgaccggattcccaaaagacagctttccatttgtcattgtaaatactgcaggaatggataaaactggtgaagcagaaataaccatcgaattagaaagaaaaagattcgctgaaggaatacctgaacaactatatcaagagttagaaaatttgcctaaacgtaagtatcatgtagaaacaaaaagtggggccactataccagctattttatctgaagaaactgtccaatttggttatgatttgccgaaagaccgtttccgtgtgccatatatggcaagaatgatcaaagtgactttaccattagaaaacatgccagcattttcttgggaaacattcgcgcttgtagaaggggaagcgaaagcagaagaaaaggaaacaatgattcatcagagtggacgaatcatcgaaaacggccctctacatttgacgattgaaaaaaatggtaccattacaatggaagatcgcaaaaacaaacgaaagttgaataatctgcatatttttgaagatatcggcgatataggaaatgagtatatctttaaacaacctttctgtgatcagccaatcctatccagtaacaaagaaaactctgaagtaaaagtattagtagatacaccggaaatagcaaaaataagtattctacaggaaatggaaatccctgtttctgcagacgagcgtttagaaaaagaacagcagatggttgtggaatttcgttatcgaaaagcagaacgatccaaagaaaaacgaatccttcaaataaaaacaatcatgacaatcagaaaagatagtaaaaaaatcgactttgaaacgactctcgacaatcagatgaaagatcatcgcttacgtgtcttgtttcctacaaagttacatgtggaacatcacgaagcagatagtatttttgaagtggtgaagcgcccaaaccatgtgtctaaaagttgggaaaaccccacgaatccgcaacatcagcaagcatttgtcaatattcatgatgaagagtacggtgtaacagtcggaaactttggtttgaatgaatatgaagtaacagaagacggacaaatcgcagtgacgctacttcgcagtgtgggagaactaggcgattggggatattttccaacaccagaagcacagtgtctaggtgagcatcggttcaattacagcattgaactacatggaccagaagaaaaattctctacttatttgcatgcatacgcagcacagattcctttttccactcaacaaatcaaacatcatgaaggaacattgatttcaaaacaacaatatttaacgataaaaagtgaaacgtttgcaattacagctttgaaacgcagcaagtttagtgataaagtagtagtaagaggtttcaatatgtctagtcatttagaaaaattggaaataactaaagacaatggaaaaactgtcatattgaatctgcttgaagaaccaacgaagcaagcggttgtcccaataatccaaccttatgagattcggacaatcggattcgaggaggaaaacgaatgtatggcggaatag

SEQ ID NO: 1631 - DNA (genomic), 612 bp, Enterococcus faecium; double-stranded, circular
  misc_feature (B) LOCATION 1...612
  hypothetical: NO
  anti-sense: NO
aagaaaaagaataaccaaaaagcaggtggaaaaatggtccatcgatacaacaaagatacacagcaaaaaattttgaaagaagcgactgacttgtttatgtccaagggatatctcggcacttcaacaagagagatcgcacaaaaagttgggatcacccaacccaatctctatcattatttcggtgataaagaaaaactatatacggcagttttagaaaaccacttaaaagatgttggaaaagctttgagagaaatcgttcaaacaagcgaaacgggatttcaagtaaccttgacaaaaatggcgcagtttttgattgagacacatctggtcgatttgtttctgatgcttcacgatcttgaaagcaatctttcaaaggaaacaagagatcatcttttctttctatggaagaaaaattatcgtgaaccttttgaagaaatcttttcagcaaaccaatctgtgctaagaaatgggatttcaaaagaaatcgcagcaaggcattttttcttagtgttagcaccttacatcactcggtcgaaaagacctgtggaagaaccgctaaatgtggcgcaattgatcgatttatatttgaatggtgtattaggagaagcgtaa

SEQ ID NO: 1632 - DNA (genomic), 213 bp, Enterococcus faecium; double-stranded, circular
  misc_feature (B) LOCATION 1...213
  hypothetical: NO
  anti-sense: NO
cacgaaaagaatttgaaatcccttttgctgctggtgcagaacaaaggcagaaccttaacccatgaaatcacttttgtccgcatatggggatatgactttgacggtgatggcagcacagtccacactcatatcaaaaatctgcgggcgaacgtgccggaaaatatcatcaaaaccatccgcggtgtaggttaccgattggaggaatcattataa

SEQ ID NO: 1633 - DNA (genomic), 387 bp, Enterococcus faecium; double-stranded, circular
  misc_feature (B) LOCATION 1...387
  hypothetical: NO
  anti-sense: NO
gaggaaaagaagatgagattaacagaaggtattgtcgtagattcaggtttaacatttgggaagttgcgtttttccgcattacgccgagaagtacggaagcaaaatgaggatggaacaattggtaatgaggtaaaagaacgaacctataatttaaaatcctctgcacaagggcgaatgattcaagttagtatcccggctaatgtacccttacgcgagtttgcttatgatgcagaggtagagttggtcaatccaatcgtggataccgttgccaattatgtttttcgagaaggaactaccgttaattggtttattaaagcagatgatttagtcttgaagcggcagccgaatcaaggaaatcctacgaaccaaaatgaaagaaagaaatag

SEQ ID NO: 1634 - DNA (genomic), 1887 bp, Enterococcus faecium; double-stranded, circular
  misc_feature (B) LOCATION 1...1887
  hypothetical: NO
  anti-sense: NO
aaaagaaagaaggaaaaaacaatggataatcaagcagttggtcgtcgtgtatgggaagcggtaggaggacaaaagaatgtcaaaagtttagtacattgtgctacgcggttgcgattcagattaaaagatgaatctttagcagatacgcaaaagttaaaagaagacccggacgtgatccaagtcgtacaaagtggcggtcagtatcaagtagtgattggcagtaatgtagcagatgtttatcaatcgatcgtggatgaggaaggtcttgcagtttcggaggatggaaaagaagagtccaaaaatattttgaatcgtctgatcgatattatctctagtatatttacaccttttctaggggcgatggcagccgccggggtattgaaaggattcttatcattggcaacggtgatgggctggctgacagctgatagcggtacttatcaaatattgtttgctgcagcagatggtgtctttaccttcttacctgtcatgcttgcttttacagcagctaaaaagttcaaagccaaccagtttttagcagtagcaattgctatggcacttgtgtatccagctatcacagcagttgctggtgcgggagaagctatcagtttctttgggatcccagtgattctttcaccatctggttatacttcttctgtcataccaatcattctagccgtatgggttcaaagtaaattagagccattcgtaaaaaaagtgattccgcaatttctgcaaatgattttagttccgcttgtcgttttagtagtgatggttccattaacatttcttgctttaggaccaatcgggacggttgccggtaatgctttaggcggtctcttcaactcgatttatggatttagtccaatcgtagcaggtctaatcatgggaagtttatggcaagtattcgtgatgttcggcatgcattggggattcgtaccgatcatgtttttgaatatcgaacaatatgggtttgatgtattgatgccaatgcttcttccagccatcttggcacaaggtggggctgctttagctgtagcattgcgaacaaaagatacgaaacttcgagcattagggatttcttctacagtgacttcgttatttggaatcactgaaccaactgtgtatggtgtgacattacctttgaagaaaccattcattgccgcttgtatttctggaggtattggtggagctattatcggattttccggagtaaaagctttctccagcagtttggtcagcttattgacgattccgactttcattaatacggtggatggtgtagagtcaaatgtgacagtagcagtaatagctacaggaattgcttttgttcttgcattcgtaggtacattgattttaggatttgacgaacaaacacaagacaatcaattagaaaacaaacatgcgaatgcaggagaaccgattacttcagcacggcataccttaaaaagtcctttaacgggtaaagtactgccattgagtgaagtaccagaccaagttttttcttctggcgtgatgggaaaaggtatcgctattgatccagaagtaggagaactagttgcacctgcagacggagagatcacgactatttttccaactggacatgctgtagggatcacaacgactgacggagcggagattttgattcatatcgggatggatacagtagaattaaatgggaatggctttgagatcttagtcaaacaaggggatctcgtcaaagcaggagatttattgattcgttttgacatcgaagcaattagagcagctggctatagcgtaatcactccagttgtcattacgaatactgatgcatttgccgatatacttgaattagaccaaaaagagattattgcaaacgaagatgttctggcaattgtaaaataa

SEQ ID NO: 1635 - DNA (genomic), 225 bp, Enterococcus faecium; double-stranded, circular
  misc_feature (B) LOCATION 1...225
  hypothetical: NO
  anti-sense: NO
aaaagaaagaaaaagaaagtattgaaacattgtgttattctaggaatattaggaacttgtctagctggcattggtacaggaatagacgttgacgcagctacttactatggaaatggtctttattgtaacaaagaaaaatgttgggtaaattggggacaatcatggtcagaagggttaaaacgttggggagataatctttttggtagttttagtggaggacgataa

SEQ ID NO: 1636 - DNA (genomic), 795 bp, Enterococcus faecium; double-stranded, circular
  misc_feature (B) LOCATION 1...795
  hypothetical: NO
  anti-sense: NO
gggggaaagaataacgtggatttcgtaatcattctagtcaaatcggtcattatcgggggattacttggttttgcagcatctgtcggggcagctcgaatgtttcatgcacctaatacacaaggtttaggagcttttagaacattaggcgaaatgaatgcctgcatgggtgatccagcttctcatttttcatttggtttaggctttttctttaatgcatgggcttcttcagttggtgctggtgcattcacacaagatgtgacgcatcgaatcattcccaattgggcagcggcagcacttctagcaaaaaacaaagatgtcacccagaccatgcatgatccgaaaaaaatggggatcattggagcggttatcggggcagtggtggtagccttcttaaacacaacagctgcagcaattccagaggcgttacaagtgacggcggtttccgttttggtaccagcagcgacgattctgatcaatacagtaatgccagttattttttggttggcagctttagacgcagggaaacgaactggtttttggggcactctttttggtggtatcgcgcaattgattatgggaaatgcggtacctggtgttgttctaggaatcttgattggtaaaggcgtcgatgagagcggttggaatcgcgtcacgaagagcatgatgatcgctattgttttattatttattttcagtggatttttccgtggatttgatatggaaatgatcaagagcttccagcttcaagtgcctaattggcttgataacttgcacaacatctttagtgtgaaatag

SEQ ID NO: 1637 - DNA (genomic), 300 bp, Enterococcus faecium; double-stranded, circular
  misc_feature (B) LOCATION 1...300
  hypothetical: NO
  anti-sense: NO
ttgatgaagaagatattgatttatttagttagaggatatcagcgctttatttcgcctgcatttccacctagctgccgttattacccaacctgttccaattatatgataaaagcaattcaaacccatggtgcactaaaagggacggtaatggggactgcacggatcttacgctgtcatccttttgtcaaaggcggtatcgattatgtaccattgacattccaattaacgcgaaataagaaagataaaaaagaaccagattataaaaaggttgtgaaaaatacgagtagcactgagcgataa

SEQ ID NO: 1638 - DNA (genomic), 894 bp, Enterococcus faecium; double-stranded, circular
  misc_feature (B) LOCATION 1...894
  hypothetical: NO
  anti-sense: NO
gtcgtgaagaaaagtaaaggattaggccgaggaatcgatgcactgtttcaagatttagaaaacttagagacggtggatgtaaaagatgataccgttgtccagctaccattgaatgagctgcgaccaaatccgtatcagccccgtaaaacatttgaagaagtatctttgcaggaactagctaattctattgaacaatcaggtgtctttcaacccatcatcgtacgccgttccgcagtaaaaggatatgagattattgcaggggagcgacgttttcgagcgtccaaactagctgaaaaagaaacgatccctgctatcgttagagactttgacgaagaagcgatgatgcaagtagcagtgctggaaaacttgcagcgagaagatctgaatccgttagaagaagcagaagcatatgagatgctgatgaaaaacctgaaactaacacaagcagaagtagctagtcgtttaggaaagagcagaccttatatcgccaattatttgcgcttgctttctttaccggatcttgtcaaggaaatggtacaagatcagcgtttatctatgggacaagcccgtacgctgttaggtttaaaaaataaaacattgatcttgaaattagccaatcgtgcagtaactgaaaatttaactgtccgccaactggaacagcttgtttctgagttaaatcaaaatgatggaaaagaaaagaaaaaaatcccaaggctagcaaaggaaaaaccatattatatccgagaaagcgaagatcgtttgatggataaatttggtacaagtgtagctatccaagaaaaaaatgggaaaggtaagatcgagattgaatatctttctcaaaaagatttgactcgaattcttgatatcttgaatattcaatttgatgaagaataa

SEQ ID NO: 1639 - DNA (genomic), 1002 bp, Enterococcus faecium; double-stranded, circular
  misc_feature (B) LOCATION 1...1002
  hypothetical: NO
  anti-sense: NO
aggccgaagaaatggaggagaataacagtcaattatgactcttgttcttcctcctttttacgtaaaagccttttaagtaaaataaaacggatagaaaagagaacatatatgaactattattcaaaaaataaggaaaacttttatcaaaaactgaccgatgatccgcttttttcttcattgaccgattatctatatgaacatcgagaacaagaaacgattctaagagaattgaaaaaagaattttcgcaaaataaattttcccattttcttgatttattgatcgatgcaggattaatcaagagggaagaacgaagatatcatttgaactttccaatatttgatcctaaagattacttgcaacaagccacttcggctgctgaaaccatagctgaacaattgaagagactctctgttgatgaacaaaaattagcgatgggagaagttatttgggcgtattgtttcgaagatgaacggaaagaagcgtatttttatggagtaagaaacagccgagagacagaattgctgaggacaactgcaggaaatgagaagtaccgttttatcacactttcctctatagaacacttcccgcttactttggctaattacttttttgtacagaagaatcagcttcctgtaacgaaggcattcaaagaattagccgaacttattggagacgtaaatgaatcgtacttttttgatcaaatagaagttatcgttgacaggatacgtaagaataaatataaaaatcgccggcctagtattttccatcagtctctacttgtgacgaatactataaaggaagaagaatcattcacattagaattacctattgtcgaaaaaaacaattttgagattgaattaccaacattggatccttcattgacaatggaggaaatggcctttcttaaacgacaaatcttttctgagctgagcaagaaatttataccgcatgcattttcttatatcaaagaatatggaacagttttagtgagtaaaacctaa

SEQ ID NO: 1640 - DNA (genomic), 240 bp, Enterococcus faecium; double-stranded, circular
  misc_feature (B) LOCATION 1...240
  hypothetical: NO
  anti-sense: NO
acaaagaagaatggcttccacagagtgaagaaatcacatcaaggattacttgatgaatttgttctggaaacaaaagaaggctggctgaacttgaataaaaactgtcaagtagcagggttaggcggagcagatcagcgagatggttcatatgcttactacatcagtgaaccaattatttgtaatgatcaaaaaggcgttggtgcattcttgcaagcattgattgaagtggaggcattataa

SEQ ID NO: 1641 - DNA (genomic), 237 bp, Enterococcus faecium; double-stranded, circular
  misc_feature (B) LOCATION 1...237
  hypothetical: NO
  anti-sense: NO
ggagagaagaaaatgaataataaaacgttcgaagtactaaaatggttcgcactggtaattattcccgcattagctactttcgtggggttagttggtaaagcgctcaattggcagtacacagatatctgtgttgtcatcattactggttttggcgcgtttttagggagtgtgttgggtgtatcaaatcgaacctacaaaatgttctcggctgaaagcgaagaaggaggaaacaaatga

SEQ ID NO: 1642 - DNA (genomic), 450 bp, Enterococcus faecium; double-stranded, circular
  misc_feature (B) LOCATION 1...450
  hypothetical: NO
  anti-sense: NO
gaaaggaagaaaaaaatgaatattgattcccttatgatcgatgagatttctgaattatataagagcgttggttggacgaattacacaaaagacactgcaaggttagctagagcatttgaacaatctgaatctctgataaagcgtaatggggaagggaagattatcggaatcgttcgttggatcactgattttgcgacgatcgcatttattcaagatatcctcattcatccgaggtatcagcgccaaggaataggcaaagtgcttttgaatgaagctttggagaagatcactagttatggaccagtccaaatcgaattattgacagatgatactgagaaaacaaaaaaattttatgaatcagtaggatttgttcaagtaaaggaaatgggtggtatttcttatgtcatagatactagaagaaaaaaggtgctttttggtaatgacaaataa

SEQ ID NO: 1643 - DNA (genomic), 1416 bp, Enterococcus faecium; double-stranded, circular
  misc_feature (B) LOCATION 1...1416
  hypothetical: NO
  anti-sense: NO
aggagtgagaacatggcaaaaggaatcaaaatcgctacgattggtggaggcagcagttacacccccgagttgatggaaggatttatcaaaagatatgaggaattaccgatacgagaaatctggctcgtagatgtagaagaaggaaaagaaaagcttgagatcgttagtcagatgtctcagcgtatgtgggatgcttctccgtatgaagtcaagatctatgcaactctggatcgggaagaagcattgaaagatgcggattttgttacgactcagtttcgtgtcggtcaattagatgcacgaatcaaagacgagcggatccctagttattatgggatgattgggcaagaaacaaatggtgctggcgggatattcaaagcttttcgtaccgttccagtcgttttggcaatcgttgaggacatgaagcgtttatgtccaaatgcttggctgatcaatttcgcgaacccaagtgggatggtgacagaagcagttatcagatatggcaaatgggataaagtgattggattatgcaatgtgccagtgatggcgatgatgacagaaccagcaatgcttggcaagaaaaaagaagagctgatctacaagtttgccggtctaaatcatttccattggcacaaagtagcagataataaaggaaatgaccgcacggcagaattgattgatcgtttatacgatgaagagaatggattaccgaaaaatatctttgatatcccgtttttcaaagaacaattaaaacaaatgaacatgatcccttgtggctaccaccgctattactatcgtgaagaagaaatgctggaacatgctttagaagaatatcaaacgattggtacaagagcgcagcaagtgaaagaaacagaagcagagctatttgaattatacaaagatccagaattagaccataaacctgaacaattgcaaaaacgaggtggcgcttattattcagacgctgcctgtgaaacgattgcttcaatctatggaaataaagaaacacagatcgtggtatctacaaagaatgatggagctgttcctgacctgccggcagattgtgtagtagaagtcactgcctatgttggcgcacaaggagcgagaaatgtagcgtttggttctcttcctgctgctgaaagaggctggttgcaagtaatgaagaatatggaattgctgacgatcgaagcagctgtgactggtgattatgggacagctttacaggcgtttacgatcaatccacttatacgatcaggaaagacagcaaaacggatcatggatgagttgtttattgcacaccagcagtatttaccgcaattcaaggagacaatcagccgattaaaagaagaaggaatcgaagttcaagatgaactggcaagagaattatcaggtaatacacatataatggaggaagtataa

SEQ ID NO: 1644 - DNA (genomic), 384 bp, Enterococcus faecium; double-stranded, circular
  misc_feature (B) LOCATION 1...384
  hypothetical: NO
  anti-sense: NO
gaaggtgagaagatgttaacacattaccggaaagaaaaccgtaaaattgctatgggactattgagtttccataagaaactgacaggtaaaacttctttgttgaaggagattgatacgtacgaatctgaagacgattatgaactttttttctttacgccagaaggttcaaccaacattcaagggattattggtatttactgggcaacgaacgatcagctgatcatccatgacatttctttgaatccgtcttatcgcggtgagaatatgggctttcaaatgttagatgaattacaggaaaagtacccggatgtctccatccgtgcaactgaaatcacagagccttacattggaaaatggctagcaaagaaaaagaagaaagagtga

SEQ ID NO: 1645 - DNA (genomic), 372 bp, Enterococcus faecium; double-stranded, circular
  misc_feature (B) LOCATION 1...372
  hypothetical: NO
  anti-sense: NO
aacggcgagaaaggcaatcgatttgcacatagagaatttaagaagggaaatccatcgattggaggaatgagcgtggataagaaagcagcaatgaaaagaattgctgaattaaccaagtcagaatcttggcaagaagacaaagaaatagttgcagaagtccaaaagctcggtaaatcaatgtggactgaaaagcccaaacggagaacgccgagaaaaattgcaatctggcatgatgaccgaattttagtaacaggtactgctgaacagttatctgaaattactggattaagcaaaaacattatctgggatagagctaggagcttatggattgattcaaaaggacgacagtttaggtatgtggaggagagataa

SEQ ID NO: 1646 - DNA (genomic), 582 bp, Enterococcus faecium; double-stranded, circular
  misc_feature (B) LOCATION 1...582
  hypothetical: NO
  anti-sense: NO
gtcaaagagaagagggaaaacatgaagattgtattagcatcccaatcaccaagaagaaaagagttattggctcatatcgtttcagaattcgagattgaacctgctgatatcgatgaaacgccatttccagacgaacagcccgtcgattatgttcgtagaatggctgaagaaaaagcacgaactgtctgggaacaagatgaaaaagaagaccatttagtgattgccagtgacacgactgttgttctcaatcaagagatcatgggtaaaccagaagatctggctgaggctgaattcatgctgaaaaaactaagcggggaaacacatactgtatatacagctgttgttttaaaaacaaaggaacgagaagaacggatactagcagaagcacatgtcactttttatcctttgacagacgaagagatcaaacgctacttggagacgggggattatgcggataaggcaggggcatacggcatccaaaatgctgcgagtgtattcgtcaaagaaatttctggagattattacagtatcgtaggatttccgattggtgctgtcaatcaggcactgaaaacattcatttaa

SEQ ID NO: 1647 - DNA (genomic), 696 bp, Enterococcus faecium; double-stranded, circular
  misc_feature (B) LOCATION 1...696
  hypothetical: NO
  anti-sense: NO
attggagagaaaatgaaaaaattaaagatatttccaaaaatgttcatacaaatattttctgttcttggaataataattatattagttcattcattaattttttttatctttcctaaaacatatttggagacgagaaaagaaaagattcataatatggcaaatgaaatttctagtaatatgaatggaaaagaaataaaatatatagaacaaactttggagttttattccaagagtagtgaaataaaagtattcataaaagaaaaaaataataagaatgaaatacaaatcaaagataatataaatgttaatttagaaagtgatagtaattctttgataattgaagaaagagaaataaagcttaatgatggtaaaaaaacaaatctacaatttgtttctacagctgatatgcaaaaagatgcgaaagatttaagccttaaatttttaccatattctttattaatatcaattttattttctgctattatttctttaatttatgcaaaatcaataaaaaataatatacaagaaataaaaattgttactgataaaatgatgaaacttgataaaaaaatgagtttaaaagttagctctaatgatgaagttggagaattaaaacaacaaattaatgatttgtattctactttattaagaacaattgacgatttggagggagcgtcaataattttgtgtaaataa

SEQ ID NO: 1648 - DNA (genomic), 735 bp, Enterococcus faecium; double-stranded, circular
  misc_feature (B) LOCATION 1...735
  hypothetical: NO
  anti-sense: NO
ttcatggagaattttttcagtattttaggcggaatgggcacgatggcgacagaaagttttgttcgcttgatcaaccaccgaacgaaagctacaaaagatcaagaatatttgaattatgtcttattcaatcatgcaacagttcctgatcgtacagcttatattttagatcgatcagaagaaaatccaatgccgtttctgctggatgatattgagaaacaaaatttattgcgaccaaacttcattgtgttgacttgtaacaccgcacactacttttttgaagagttacaagcggcaacggatattcctatcttgcatatgccaagagaagcagcaaatgaacttgtccgtcagcatacgacagggagagtagcgattctaggaacagaaggaagtatgaaagctggaatctatgaacgcgaagtcaaaaatcttggtttcgaaacagtgattcctgatactgcgcttcaagaaaaaatcaattacctgatctatcatgagatcaaggaatcggattatttgaatcaagagctctattacgaaatcttagaggaagcggtagagcgcctaaactgtgaaaaagtcatcctaggttgcacagaattatctttgatgcatgaatttgctgaagataatcattacccagtgatcgatgctcaatctattttagcggatcgaacgatcgaacgtgcattagctgaaagaagcgaggcattggatacagcatcggaaaagtaa

SEQ ID NO: 1649 - DNA (genomic), 444 bp, Enterococcus faecium; double-stranded, circular
  misc_feature (B) LOCATION 1...444
  hypothetical: NO
  anti-sense: NO
gtcatggagaaatttacaggttatgtgcgagaacctttttattatgaaacagatcaaatggggattattcatcacagcaattatatccgctggtttgaagaggctcgggtagccttattggtacatctagggtttccctataaaaaaatcgaagaatctgggatcatcatccccgttctggaagtaaattgcagctataaagaaatgatccattacggagaaaaagtgagcatccatccaactatccaaaagtatacggggacacggttggattttagctacgaaattgtgggaactgaagacaaaaaattaaaaactactggcagtagtaaacactgttttttactttctgattcgcaacgattagtgaagctgagcaaagtcaatccggagttagatcagttattccaagcgtacgcttctttggatgatgtaaattcttaa

SEQ ID NO: 1650 - DNA (genomic), 1407 bp, Enterococcus faecium; double-stranded, circular
  misc_feature (B) LOCATION 1...1407
  hypothetical: NO
  anti-sense: NO
ggagtggagaaaatgcctattaattcttatgacaattacccgttaacttggcgaccagacaaacaaaaattgaagcgtccttattatcgatcgttgattcaacaattagaacaagatattttaaagaataaattacagaaaaacactcagttaccctcccaaagagagctagctgattatttagatttaaattttactaccgttggcaaggcttataaatatggaattgagaaaggtttgctgtatacgaatattggaagtggcacatttatttctcccaatgtctttgagtccatcaccatctctaccaatgaagtaaccgaacatatcattgattttggtctggttagttcttttgaagaatgtaataaattcgttgtcccgtttattcaatcaactagtaataacccaaatcttgttggtttgcttaattaccaagatcccaaaggcacaaattttcaattgactactgcagcaaattggttaaaaactcaaggagtcattccgtccttagaatctctatctattgtttccggtgttcaaaatggattggctatcacactttctgcacttttctctccaggtgatagaatagcaacagaccgatatacatacgctaatttcattgaattggctcagttatatcatttagagatcgttccaattgattttgacgagcaaggaatgcgacctgatatattgattcaggaatgtagaaaaaagaagattcatggtgtctttcttatgccttcttgtaataatcctatagggtttcaaatctctcacaaaagacgagagcaattagccgaagtgattgaaaaagaaggtctatgggttattgaagatgatatccattcatttttaacaacttactatcaacatacgatcattcctcctttccaaaatttattacctaaccaaacaatctacttagctggaatgacaaaatttatttgttctggattgcgagttgcttatcttgtagttccagtacatgtccaaagcaagatagaacaagcaatttttaatataaatgtgaaaacttctggattagatgtggaagtcatcactcaaatcctccattcaaatgaagcaaataggatcttagaaactaaattaagtcttacaaaaagagccaatcagctttttgattctcttttcaaagtagaaaaaccaacgaatcgtgtcccttactatcgaattcttccagttgatcctgagattgaccctaagataattgagaatgactttcttgctaacggtatccgactttatcattccagacgctttactacacgtgcgcaaccagatgcattcgttcgaatttccctatcctctaataaccttgaaattttagcttctggactaagtatcgtaaaagaaaaaataaaaaaatatgaattataa

SEQ ID NO: 1651 - DNA (genomic), 1047 bp, Enterococcus faecium; double-stranded, circular
  misc_feature (B) LOCATION 1...1047
  hypothetical: NO
  anti-sense: NO
cttaaggagaataatatgattgtttttattttatcgctattttcatcaggacacaagctgcggattagttctctttaccaactccttgtgggaaaacgaacgacttcagtacttatttatggatttacccacgaacttttgtttatccataacagttttccagaattgaagcaggataagttttatcaaattttgcaaaaaattgcgcagcaaggttggatcgaaataaatgaaaatgaagcaaagctaacgcctgcaggggctgatatgttgtccgaacatcaaatagaacatactggtttgcgttttgaccgctatggcagaacaggggaaactagttggcggctcattaaatttgctgttcaagtaatttctaatctggcaacgggtattcaagactatcttccagcagagacaagtcctttttatactttccaactaaaaaaatggcttagtgaaagccaattgccacgtgaaattttgattgatactgcgtatgagagtttggtgcagctgttttcggagataccagaagaagcagcagattttttagctaaccaattatctggaaatgagcgaacagggctgcttccttatcagctggcaaaaaacaatgatgagtcagcggtttatctgcaacaaagcagatgtatccaccttttgttagcacaaatcgaaaaacggccagattcgctttggcacgctttgatcgattcattattacagcaaaatttcaatcaaagcatgatgatcaccaagcagatgtttatgaatggtcagacaattgaccagatcatggcaatccgtcatttaaaaagaggaacagtaacagatcatcttattgagtgggccttgttttttgatgattttccatacgagtggattctctctgcagaaacaatcgaacgtttggaaccaaataaggattccgtgcgagagtggcgctttagcgaatggaatgtagatggacaattagattatggagaatttcgtttgtatcaaatctatctattgagaaaggaagcgatacagaatgttaataaatga

SEQ ID NO: 1652 - DNA (genomic), 890 bp, Enterococcus faecium; double-stranded, circular
  misc_feature (B) LOCATION 1...890
  hypothetical: NO
  anti-sense: NO
tataaggagaaaagggggatacaaatgaaaaaattagttgctggtttattaacagccgttgcacttcttgctatgagcgcatgcggcgcagatcagaaaaatacagcgcagacaagttctagtacgaaggaatctgccgaagtatcatcaggcgcttctgaacaagtatatacagatccaaaagaaatgaaagaatcttatgatgtcgtgattattggagctggtggtgcagggatggcagcagctatcgaagcaaaagatgctgggttgaatccagtaattttggaaaagatgcctgttgccggaggaaacacatctaaatcatcaagcggtatgaatgcttcagaaacaaaatttcaaaaagaagaaggaatcaaagactcgaatgatgccttctatgaagaaacgctaaaaggtggtggaggaacgaatgataaagaaatgcttcgatactttgtcgatcactctgctgatgcggtcgattggctagatcaaaacggtatcaaactggacaacttaacgatcactggagggatgagtgaaaagaggacacatcgtccgtctgatggctcggctattggtggatacttagtggaggggttattgaataacgtccatgagcgggaaatccctatttttgtcaacgcagatgtgacagacattaagaaaaatggggaaacggtcaatgaagtgactgtacatgttcaaggagaagaaccaaaagaggtcaccggaaaagcaatcgtagttaccacaggcggttttggtgccancaaagaatttattgaaaaatatcgtcccgatttagctgattatattacgacaaatcaagaaggatcaactggagatggtatcaccatgattgaaaaattaggtggacaaaccgttga

SEQ ID NO: 1653 - DNA (genomic), 243 bp, Enterococcus faecium; double-stranded, circular
  misc_feature (B) LOCATION 1...243
  hypothetical: NO
  anti-sense: NO
acaaaggagaataaaaatatggaaaatccaacttttgaagagtcactgcaagaattagaaaaaattgtcatgcagttagaacaaggagacgttccattagaatcagctctagattcgtttaaacgaggaatggaattaagcaaacattgccaagatacattagctaaagcagaagagaccttgacgaaaatgatgacagaatcaaatgaagaagttgattttgacggaaacgaggaaagctga

SEQ ID NO: 1654 - DNA (genomic), 213 bp, Enterococcus faecium; double-stranded, circular
  misc_feature (B) LOCATION 1...213
  hypothetical: NO
  anti-sense: NO
tatgcttggaaaacagcaatacaaattcccattagcaaaacagaaataaagaaaaacggtaagatagaaattgtccctgtatttctagacaatgcatgcataccgccccacaaaaaaggaatcgccaaatcaggggcttttattttaaaacgacgatttaacgaaaataattttacaagaaattggcaaccaaacaaaacgattaccgggtaa

SEQ ID NO: 1655 - DNA (genomic), 432 bp, Enterococcus faecium; double-stranded, circular
  misc_feature (B) LOCATION 1...432
  hypothetical: NO
  anti-sense: NO
anaaattggaaaaatggtccccagcagaagtttaacgcgatcgtcaaagaacgaatcgcagtttttgttgtggaacaacagtgtccttatcaagaagttgatgacattgatggacaagcttggcatacgttttttcaagatactgatgggaagatccttgcctacacgcgagtatatgaagaagcggagagtatccattttggacgtgtccttgttcatcaggacaaccgtaaagatggtttaggaagaaagattgttcaagaaacgattaacatgatccagaaaaattttccagaaaaaccaatcgtgatcggcgcacaagaatacctacaagctttttatgagtcgtttggattcaaggcaatctcagatgtgtatttggaagatgatattccacatatcgacatgaaaaaggaacaagtagcaagttaa

SEQ ID NO: 1656 - DNA (genomic), 879 bp, Enterococcus faecium; double-stranded, circular
  misc_feature (B) LOCATION 1...879
  hypothetical: NO
  anti-sense: NO
tggaactggaaggttatatcagaaagatctgaaggaggaggacacatggaaacattaagtgtagtacaaagtttgttgattgctttatgggtagccgcggttatgtcccgctggttaggtggaggagccacgttgaccttacgtttttctcctttgatgactggattagtcgtcgggttgatcatgggggaagttgcacaagcgatgattgttacagccgctttgcaaatgatttatatgggggttttttctccaggaggatcaatgccagctgaaccatctattgcagcagctatcgcagtaccagtcgcattattaggggatctgtcgccagaagcagcgattgccgttgcggtgccagtcggattgctcggaagttacttgtatcagtttcgttttttcatcaatacttttttaggtaaatatacagacaaagctgtagaagatttgaatacaaaagctatggcccgatcaattattctttatccaacggttgcctcatttttattattcgttccgcttgttttcattgctttatatttaggggcgccattgatcgctgatgtaatcaaagctttagagggaacagtcgttatccacattcttgaagtagtaggtggagggttagcggcaatcggtatcgcgacaactgtatacgttatcggtcgaaaagattatctggtctttttcttccttgcttattttatgagtgttgttttgaaatctttagatattacgatggttacttatgccatttttgggattattatcgctttgatctttgtccagtcgcaaaaagggaaacaagtacagcctgccacaagcaataacaattcagcatcttttgatgacgaagatgactatgatgacggattttaa

SEQ ID NO: 1657 - DNA (genomic), 723 bp, Enterococcus faecium; double-stranded, circular
  misc_feature (B) LOCATION 1...723
  hypothetical: NO
  anti-sense: NO
cgtcgctggaatccaaaaatgaagaaatatatcttcacagaaagaaacggaatctacatcattgacttgcaaaaaacagttaaattagtagatgcagcttatgattacatgaagagcgttgctgaagaaggcggcgtagcattattcgtaggtacaaaaaaacaagcacaagaagcaatcaaagaagaagcaactcgtgcaggacaatacttcgttaaccatcgttggttaggcggaacattgacaaactgggatactatccaaaaacgtatcagccgtttgaaacaaatcaatgcaatggaagaagatggaacttttgaagttctacctaaaaaagaagttgctggtttgaacaaagaacgtgaacgtcttgaaaaattcttaggcggtatcgctgatatgccaagaatcccagatgtaatgtacatcgttgacccacgtaaagaacgtattgctgttcaagaagcacacaaattaaatatcccaatcgtagctatggttgatacaaactgcgatccagatgaaatcgacgtagtaatcccttcaaacgacgatgcaattcgtgccgttaaattgattacttcaaaaatggctgatgctttcatcgaaggaaaccaaggtgaagatcaagtagttgaagaagatttcacagaagaaaacacagcaacatcaatcgaagaaatcgtagatgttgttgaaggcgacaattcttcagcagaataa

SEQ ID NO: 1658 - DNA (genomic), 564 bp, Enterococcus faecium; double-stranded, circular
  misc_feature (B) LOCATION 1...564
  hypothetical: NO
  anti-sense: NO
acaaggtggaaacagatgaaaaaaatcgtaatcaaaggaaaccgacctttagctggtgaagtaacgatcagcggtgcaaaaaatagtgcagttgcattgattccagctgcaatcttagctgattccccagtgatcttggaaggtgtgccggacatacaagatgttcattcattaattgaaattttagagatcatgggcgcaactgtccatttttccaacaatatactagaaatcgatcctcgagaaatcgtatcgattccgatgccgcacggaaaaatcaatagtttgcgtgcttcttattattttatgggaacactgcttggtaaatttggcgaagcggtagtaggcctgccaggtggctgttatttaggccctagaccgattgatctacacgtcaaaggatttgaagctctaggtgctgaagtgacaaatgaacatggtgccatgtatttacggacagaaaataaaggattgcgtggcaatcggattttcatggacgtggtttcagtcggagcaacgatcaatgtgatgttagctgctgtaaaagcaaaaggacggacacct

SEQ ID NO: 1659 - DNA (genomic), 1365 bp, Enterococcus faecium; double-stranded, circular
  misc_feature (B) LOCATION 1...1365
  hypothetical: NO
  anti-sense: NO
gcgtctcggaaacgctggaagtgtaggcagaaaatggcgacaaaacatgatttgattttagaatatattgaaagtttacctgttggcaatcgaatttctgtaagaagcatcgcaaaagaattgaatgtcagtgaaggaacagcgtaccgtgcaatcaaagatgcagaaaatgtcggactagtttcaacaattcaacgagtagggaccatccgtatcgaacgcaaattaaaaaaacatattgaacgtttgacatttggcgaggtcgtcaggatcattgaaggggacgttttaggcggggcggcaggattagacaaggtcttgaataaattcgtcatcggcgcgatgactaaacatgccatggaacgctatattacgccaggatcactaatgatcgtcggcaaccgggcggaagtccaaaaattagcattggaagatggcgccgcagtattgatcacaggaggattcaatacgactgctgagattgcaaagctagctgatgatcttgaaatgccgatcttacgcacctcttatgatacatttacagtcgcaaccatgatcaaccgagcgttaagcgaccaattgatcaaaaaagatatcatgcttgtcagtgatatctatatgccagctgaaaagactcattatttgcagcagacagatacgatttctgattatcagcgtttgtcagaagaaacgcagcattcgcgttttccagtcgtcaaccgccatcatcgtttgatggggattgttacggcaaaagatgttttagggaaatcgccaaaccagatcatcgatcgggtgatgacgaaagaaccaatcagtgtaaagaaaacaatgagtattgcctctgttagccatcaaatgatctgggatgggctagaagtcatgccggtcgtttccgatgacttgacattggaaggcttgattacccggcaagatgtaatgaaagcgatgcagcttgtccagcgacaaccgcagattgcagatacgatttcggatcagatatctggaaatatccatacgattgatactgaccgtgaaggaaatcgtttggaaaaccctaagttcaaattcgtagtagcaccacaaatggtcaatggcgttggaaccatttcttttggcgtacttagcgaaatcatttctgatgtcgcacaaaaaacaatggtgatgaaccaaaaacgaaatatcttgattgaacaagtgaacctacattatttgcggctgatccaattggaaagcgaattagacattcgtccacgtgtattggaaatcggcagacgttccgctaaactggatatcgaagtgtttattgaaaacaccatcgtttccaaagcaatcgttgtttgtcaagtaatggaacgttcttag

SEQ ID NO: 1660 - DNA (genomic), 1623 bp, Enterococcus faecium; double-stranded, circular
  misc_feature (B) LOCATION 1...1623
  hypothetical: NO
  anti-sense: NO
agttgtcggaacgatggccggtgtagatacattcattattatttgccgctcagaagaagaagcacagcgatttgcagaaaagctggaaaaaatgagggaataaatgaggaggacttttatatgaaagatatgaaagcgctgcaaaatggatcggatattcgaggaatcgcattaccagttgaaggatatgaagtaaacttgacgacagacatggtaaaaaagatcggctggggactagcaaactggataaagaaaaagaagaaatcaaccgatccaaataaaaaatggacgattgggattggtcatgacagtaggataagcggaccagcactgaaagaggcgttgatccaaagtctgaaagaacaagggatacatgtcatcgatttcgaattagctactacgcctgctatgtttatgtccactcaatttgaacagttctcgtgcgatgctgcggttatgctgactgctagccatcttccctattattataatggaataaaattctttacctcagaaggaggagcagaaaaagaagatattgcttttatcctatcacagcagcaaaaaataaaaagcgaacaaactggaagcgtagaaaaagcagaccttttgacaccttatgcgcaagatttagtcacaaaaattaaaaaggggattggaacactagaaagcaaaccactaaatggttggaaaatcattgttgatgccggaaatggtgctggtggattctttgctgaaaaagtattgaatagcttaggtgcggattcaacaggttcccaatttttggaaccagatggccgatttcctaatcatatcccaaatcctgataataaagaagcgatggaaagtatcaagcaggctgttttagcaaatgaagcagatcttgggatcattttcgatacagatgtggatcgttctgcagttgtcagtgcttctggaacagtgatcaatcgaaataatttgatcgcagtattaagtacaatcgtattaaaagagcatccaggaacaagaatcgtgacgaattcccctacttcttctcatctacaaagattcattgaagaaaaaggaggcatccaagttcgttatatttccggctatcgaaatgtaatcaataaagcattagaacttaaccgtcttgggaaagatacacagctagccatcgaaacaagcggacacgctgcattcaaggaaaactattttctggatgatggtgcatatgtcatcgcaaagatcctgatgcttttgccagaattaaaaagaaaaggtatcacattagatgaacaaatcaaagagttgaaacagcccgtagaagtacaagaaatccgattaaaattgttcagcgatgaaccacgcgaacaaggaaacaagatattagaagaaatgaagcgactgttggaagaagaaaaagggatgaacttcgacccggaaaatgaagaaggtattcgatatgatctagaagagccatacggaaacggctggtttttgatccgtttaagcttacatgagccgttactagtattacagatagaaaatgatgaattcggaaagaacaagttggcgttagtaaaattagcaaaattattcggacatttttctgatcttgaatcattaacagcagaataa

SEQ ID NO: 1661 - DNA (genomic), 774 bp, Enterococcus faecium; double-stranded, circular
  misc_feature (B) LOCATION 1...774
  hypothetical: NO
  anti-sense: NO
ccttttaggaacaaaggagagaaaaacatggtacgttacaaagcaatcattgcgtacgacggaacaaattttaatggattccaaaaacagccaaatgggcgtactgttcaagaagaagtagaaaaaacattacaaaaaatggcaaatggaaaagaaatcacggtctttggttcgggaaggacagatgccggagtacatgcgatcgggcaagtaatccattttgattatccagaggagcgtccgttagaacgaatgcgtttcgcgctagatacccagtcaccagaggatattgctgtaagacaagtagaaattgtttcagaagacttccacgcaagatatttggtcaaagaaaagacgtatcaatttcgagtggatatagggaaaccacgcagtccttttcgacgccattatgcaagttattttccttacccacttgatttggaaaaaattcagcgggcgcttcctgatttattagggactcacgatttcacctctttttgtgcatcaggaagctcgatagaggataaaatacgtacgatctacgaggctaagatggaggtaaatgaaacaaaagacgaattgttgtttacatttaggggaaatggcttcttgtataagatgatacggatcttagtaggaacgcttttgaaaattggcaatggccgattgcctgaagatagtatcccagatattattgcgaaaaaagatcgtaatgcagcaggacctacagcacaccctgaaggactttatttgtatgaagtgaaatatgaataa

SEQ ID NO: 1662 - DNA (genomic), 189 bp, Enterococcus faecium; double-stranded, circular
  misc_feature (B) LOCATION 1...189
  hypothetical: NO
  anti-sense: NO
ggggccaggaagatcactttccatcaaatttatcctaaaagcaaaatattcagcatggtgtattccatgtatctcgtaacatcgctcataaagtacgtgtcaaagaccgaaaagaaatctgtgatgacttttaaggctgtttatcaagctaactcaaaagaagaagcgatactttcttatccggcatga

SEQ ID NO: 1663 - DNA (genomic), 1548 bp, Enterococcus faecium; double-stranded, circular
  misc_feature (B) LOCATION 1...1548
  hypothetical: NO
  anti-sense: NO
aagaacaggaaggagttacaccagttgaataatgaagaagaaaaggaaaaacggctgacagaagaagctgagctaacagccgattctcccaaagtagagaaagaaaatgaaaaacaaccaacagacggcaaaactatttcaggctatgcgttgaaattcgggcaaccgtcaaaagatttaggcggctttgtagaagtgattacacccgaagcattaaaagaggtggatttatcaaatgtgttcttattatatggacacgattattcaaagccactagctagtgtcaaagcaggtacgttgaaattgaatgtcgatgatacaggattacattttgaagcagagctaaccgacacgacctattcaaatgatgtgtatgagaatatctcaaaaggggttgttgattctatgtcctttgggttcgtgcttggattagattcattcgacaaaaaagaagatggcacaattgaacgatcaatagataaaatcaaagcacttaatgaaattagtgtcgtgaccgttcccgcttatgattcatcaaatgtccaagtaaataagcgttcttacgaatcgtttatgagtaacaaccaagcaaaacaaacaaacaatagcttagaatccacttctaaagcacaaaaggagagtaataacatggaaaaaactttaatcgataacgaaaaaacagaattgcgtgggtatgaagaatatatccgttcacaaggcgaagtgcgtgatggagtcactactgtaaatgcagcggcagttgttcccgaagaagtaatcggtgaagtctttgatttgaaacgttcaaattataacttagctcaatatgcaacagtaaaaacagtatcaaatggacaaggtaaatatccagtagcaactaaccaacaagcagtgttagcaacaaaagctgaacttgctgaaattggtgatattgacgctgaaatgtttacttcagttgattataaagtagaaactcgtgctggtaagattgccttatcaaatgaggttgtggaagattcagcagtgaatattgtacaagaggtcaaagatcagttagcgaaattggtagaaaacactgacaataagcatatcatggatttattaaaaacattcactaagaaaacggctgctacgttggacgatttgaaacaactatacaatgtggcattagacccagcattaaataaaatggtaattctaaaccaaagcggatattaccacctagatacattgaaagattcagatggacgttacattttacaacccgatgtgacagcacctagtggtaaatcattattcggtatgccagtagtattgattgcagatacattgtttgccaatcctaaagctggaacattccctatgattatgggggatattgcacaatctatctttgttgctcgtagaaatcaagtaacgactcaatgggaaaaattcgattactactcacaaggacttgcagtgatcgttcgcaacgattataagaaaattgatcaaaatgcttcagtgtatattgagtttacgccagttgtaacaccaaaagtatag

SEQ ID NO: 1664 - DNA (genomic), 1155 bp, Enterococcus faecium; double-stranded, circular
  misc_feature (B) LOCATION 1...1155
  hypothetical: NO
  anti-sense: NO
acacaaaggaatgatttttttaggaggggtacgtttatggcaaaaaaggataaagaactactgtcacaattgacttcagaaggcgctaaaggaccgttcgtcacgatcatgctgaatacgcatgtcgcacatcaagatgtggaaaaagatcaaatcaaattcaaaaattttgcaaaagaagcaaagaaacgttttgaaaaaaaatattccgagcatgactggtccccgttccaagaaaaaattgaaaatttgttaggagatccttcgttttggcgtagtgcaactacgagtgtagcggtcattataactgctgatcaaacctatatccatcgtttgagtatcccggtagacgatcaatattatgtaagtgatcttccttatttactggccattatcaaaaatggacagttcaactattcctattatctgttgggattgaaccgcgactccatgaaattgtatgaagtcagcaacaaacaagtaaaagaagtgtctctacctgaaggggcaccggtcgatgttgttactgcattgggatctgaactgacaggtggcggtttgaacttctcttctaatggagggggcggtgcccgagatggcgttactttccatggcgtgaatccaaaagatgaagaagtagagatcgattgggtcaactattaccaagcagttgatacgtacttgaaggattctttcgaaaatcctgaacaatggccgatttatttattcgctctaccagaaaatcagacgatgttcaaaaaaatcgccaaaaatccttactattgtgcagacgttgcgatttctgcttctccagcacaactatcctttagagatatcgaagaaggagcgaagaagctgtcaaatgaactagcagcccaagaatcaaaagagtacaataaacttttagataagaaattcatcgatcagttagttgatatcgttccagctgcgaaagaaggaaaagtatcccatttgtgtatcgctacgtcaaacttagctgatggtttcggaaaagatcctgaaacagaatatgatcggcgtcaagtgctgaatgctttggcagacgatgtgattattaatggtgggaaagtgtttattttggatcaaaaagatgcgccagatgaaaagagtctgacagcgattcttcgttattaa

SEQ ID NO: 1665 - DNA (genomic), 795 bp, Enterococcus faecium; double-stranded, circular
  misc_feature (B) LOCATION 1...795
  hypothetical: NO
  anti-sense: NO
acgaaaaggaatcccgaaccacgctattttgatgttcctttagggagtatcaattctatgggacttccaaacttaggtttttcttattatctagagtatgctcttgcgtatgaaaaagtgcaggaaaaccaaaatcaaccgttatttttttccattgccgggatgagtgtccaggaaaacttggaaatgcttgagaaaatagaaaaaagtgggtttaatgggatcactgaattaaatttatcttgtcccaatgtgcctggaaaaccacaactagcttacgattttgaggccacttatgaaacactgaaagaagtattcagcatcttttctaagccgctaggaatcaaattgcctccttattttgattttgctcattttgatcagatggctgatatcttgaatcagtttccattgacctatgtcaatgctatcaacagtgtgggcaatggtttgtatatcgatacagaacaagaagcagtagtcatcaaaccaaaagaagggttcggcggcattggcggagagtatatcaagccgactgctttggcgaatgttcgcgctttttatacacgtttgaaaccagaaatccaaatcattggtacaggtgggattcggacaggacaagatgcatttgaacatctgctatgtggcgcaagcatgttacagattggtacagagcttcataaagaagggccggaaattttttctagaatcataaaagaattaacgcagattatgtcagaaaaaggatatacgtcaattgacgaatttaaaggcaaattacgcaccatttcatag

SEQ ID NO: 1666 - DNA (genomic), 1299 bp, Enterococcus faecium; double-stranded, circular
  misc_feature (B) LOCATION 1...1299
  hypothetical: NO
  anti-sense: NO
ttagaaaggaaagaaacagccgtggaagaatggcaatccgtctttgaagaatggtttccaaaagaaatcagcaaaagctatcccatcaaaatttctaaacaatacacaagcagtcaacgttgggagatctatgcaaaattaacgaaaaaacagcgggaactagtcgataagcaccgccgatatctaatcagctctcgttttatggaagaacattatttagctgcaacagattgggtgttttctgacttcaagatcaatccgttttttcgaacaaaacgaagccagcaaaaattgtattgtgagtgtggtagagaattaaaagtgcaatacatcgttaaatcgccaaaaaccggaaagatcctaaaactaggcatcaaccactttgccgatcacctgcatgtctctccgacagtggcagcttcgatccatcagggaatgacaaaagttgatctggccttagacgaattattatggcttaagcagaagaatatcgattttcctgaaggactatggcaaaaatactgttttgtcttgtaccaaaatcgtcggatgaaacagccatatttaccggatataaaattagctcagcggctcgcagaatttcgccaagtagaaatgccgatttacatagcggattatcaagcattggaaaatgaaatcaagaaaataagtgaacacatcaatgggcagtcaaaaaagcgacagataaaaaaagaactatttgacgactttgcagaagaattagtaaaggatgtagaagaattcttgatcaactatcgcgcatttttacgtaaagattggcaatccatcgtatatgaagaagtgccagtacatcctaatgcttattttgaaacatttatttccgtgttgagaaagacaaaacgtcaacgaacaccagaagtcactgctcagatggaatattttgcgaaaaaccaacgattcatccaaccaaaaatctatctatttatttggaagcaatattgtcgctatggttttacagaagggttcttcgacagcattcctcggatagtcagaaatggttttttaaaagtattgcgtaaagaacgagaagctatacaatctgctgataagaaagaccgtacagtctcaaaagaaaaatggcaactagtagtgaaagatatccaatctggaaatgtgcaagagacaatcgacaaatggaaaggaaaacattatcgttttactgaagctcagaaacaagcgttggaatattatcagaagttagaagaatcactgcgtttcaatgatgaggcaagaaagtatctgaaggaattactataa

SEQ ID NO: 1667 - DNA (genomic), 408 bp, Enterococcus faecium; double-stranded, circular
  misc_feature (B) LOCATION 1...408
  hypothetical: NO
  anti-sense: NO
aaagaaaggaaactgacgcttatggaaaagaacatgaacgcatttaaccgcaacctgcacaacctcctgaccatcagcggcacggatgccgctgaactggcgcagacccttaacgtggaactgccggagatcaaccgctggctgaacggctccgccgcgccggatgtgtaccagcttcaggaaatcgccaagcggttcgggatgccctactcctacttttttgagagtgagcagagcctgcccaatgtgccgaaagtagcggcatggctgggcttgtcggaggaaacggtggaaaccctgctggcaatggccgataccgagccggaggatgtcatggacgcgctggacgatgccatttatgcaatggctaccgctgtcagtgctgcgggggaggtggatacggaatga

SEQ ID NO: 1668 - DNA (genomic), 273 bp, Enterococcus faecium; double-stranded, circular
  misc_feature (B) LOCATION 1...273
  hypothetical: NO
  anti-sense: NO
ggagaaaggaaagaaacgctgttgaaaacacaacacaaattattgactgtaaaagaagtcgttcaaattttggtggacaaagaagtcatttctgaaaaagtagcagaagctttatttattccgcggtactggacgatagaaacccctttagtagaggatgcaccgactatgctatttcaagacctagtgaagattgcaggatgtgaactgcattatcaagaaaacttggaaacttatgaaaacgaatattggttaaccaaattagagaactaa

SEQ ID NO: 1669 - DNA (genomic), 1686 bp, Enterococcus faecium; double-stranded, circular
  misc_feature (B) LOCATION 1...1686
  hypothetical: NO
  anti-sense: NO
aatagaaggaatcatttccggacttgcgatatgcgtcaacggaatattgaccgttttattgctaccgttattctttcagccttttgctggcttgttttgatgcgaaaaccactattttatgctacaataaccaaaacgttcgagcataaaaaaggagggaaagacgtgtatttgtcttccgagtatcttaaacaatttgataaagatctatattataagattctcctcctagaaagttttgaggatcaagcttggcataccgctgcacaattagcgcaagttgttcagctggatgcccgcagcgtgtcgaaatacctgaacgagctgtctaaaaactatcagcagtttagcggtaagacacaccctttgtttacaaaaaatcaccgttctggttataacttttatgatacgctcgattcaattgaacatgagcgttttttgatctatctcgtgcaaagtacgctgaaattccagttgctgcacgacattttttttgaagaattccatacaatgtaccaatttgcgcaaaagcattacattagtgaatctactgctcatcgaaaaatcaatgaatggaaacagcaactgcaaacttacggaattcggctgcaacgaggtacatatatcgctcaaggcgaagaagaaatcattcgactttacttgcatatgacattctggcagttgtttcgagggaaaatctggccatttgaaacgatttctcaaatggacgtaaagaatatggcagaacatatcatggctttttttaatgttcgtctgaacgagatcaaaaaaagacgattggaatatatgctaggtgccttttttttaagaaaatcacagaagcattatgttgtattgaatgagaaaaaaagacggctgatttctgacaatctgttgttccagcgattttgccaggtcatggagccggtatttcctaattattttcaagtagaagacgagttaggcgcattatttcttgtactgatgactcgtgaagaatattatagtgatcctaagatacggaagaaaatttttgattttcatcaacaagcaaaaacaccgccctttacagccctttcagaagcaaaagccgctctttctctttatcaggaagagcaggggctgccagcagaaaatctaaccttcgaggcagaaaactatttattcagcagtcattttttcgcctatctttttcctaatgcgaaagaaacgattgatggcaatagtagtgattttattaatcatttagttattgaaaacaaggaattgaaacaatggctcgtacatttttttgaaagtagacacaaacatcccaatcatctggcatttaaaaatcatgcgtttttgatggggcggtatctgactgtgtttaaaacattaggagcctttactccacagcttccaaagatcacgatccttttaatgacagatttcccattatttgaagagcaactgttagaggagggattacggacatttttccgtaatgagtatcagctgatttttctgccaacagattatcgggggagagaagttgatcttctgatttcgacaagtaaagtccaccgcaaaccatgggcggatcttgactattttattgtgactgaagaactaaaattaattgattacatccaactatctcaaaaatttgaaatgattcaaaaacaaaaactattaaaacaataa

SEQ ID NO: 1670 - DNA (genomic), 327 bp, Enterococcus faecium; double-stranded, circular
  misc_feature (B) LOCATION 1...327
  hypothetical: NO
  anti-sense: NO
ggaagaaggaaaattatgagtttaagaggaaaacaaaagcgttttttacgtagcaaagcgcatcatcttcagccgatttttcaaatcggaaaaggtgggatcaattcagcaatgatcgttcaaattgaagaagctttagaaaaaagagaactgatcaaagtatcgttacttcaaaatacagatgagattgcagaagaagcagctcaagtattagaaaaagaaatagattgcgaaatcgtccaaatcattggacgtgttattgtattatacaaaccttccacaaaagaaaagtatcaaaggctatcaaaagaagtaaaagcaatataa

SEQ ID NO: 1671 - DNA (genomic), 852 bp, Enterococcus faecium; double-stranded, circular
  misc_feature (B) LOCATION 1...852
  hypothetical: NO
  anti-sense: NO
ttgggaaggaaggaatttatgttttttgcaaatattatcaaagcagtgattctcggtattattgaaggaataacggaatggctgcccatcagtagtactggtcatttgatcctagcagatgaattcatcaaactggatgccagttcacaatttatgtcgatgttcaatgtcgttatccaattaggggcgatcttggctgtcgtcgttctttattttcacaagttaaacccattttctccaagtaaatcaacggtagaaaaaaaagatacgtggacactttggtttaaagtgatcgttgcttgcataccagccatcatcattggtttgcctttggatgattggttagaagcaaatttccacaagttcttaccagttgccattgttttgatcgtttacggtattgcctttattattgtcgaaaaacgcaacaaaaacaaaacacctcgttggacttctctgaatgactttacgtaccaagcagctcttcttgttgggttattccaagtcttggcacttgttcccggaacatcccgttctggcgcaacgatcctaggatctatcttgattggtgcttcgcgttttgtcgctacagagttttcatttttcttagggattcctgtcatgtttggcgcaagcggcttgaagatcgtcaaatatttagctgaagggaattcattcaaaatggaagaaactgttgttcttcttgtaggaacattcgtatcttttgtggtttccgtcttagctatcaaattcttactaagctatttgaagaaaaacgactttaccgcttttggctggtatcgtattatccttggtatcattttgattggttattggtttattgcaatgtag

SEQ ID NO: 1672 - DNA (genomic), 1056 bp, Enterococcus faecium; double-stranded, circular
  misc_feature (B) LOCATION 1...1056
  hypothetical: NO
  anti-sense: NO
gaggtgaggaagatgttaacaaagcgacaaaacgacattttacgtctgatcatccaacactatacgagtagtggcgtgcccgttggttccaaaacattgatgtctgagggagtcaaggccagctcagcaacgattcgcaatgatatgaaagcattagaagatgaaggattgctgttgaagactcactcttcttctgggcggattccatctgctttaggctatcgttattacgtggatcatttgttaaaacctgctcgcgtagcagaagatgatttgctgctgattcgtcagtctctaagcagagaatttcatgaaatcaatgagattattaagcaatctgctgagatattatctgagctgacaagctatacgactttttcattgggacctgaaataaaagaccgccgactgactggctttcgtatcgtacccttgaataatcgacagattattgctatcgtcgtaacagatatggggaatgtagaaagccaagtgttcactcttcccgaatatatgggaagtcaggaactagaaaaaatggtacagattgtaaacgaccgtctagtcggagatcctctgatgacggtgtaccataaacttcgtacggagattccgatgattcttcataaatatttccaaacgacagaagggatgtctcagttatttgacaccgttcttggtcatgtttttgaagataaggtttatgtcagtggacaaatgaatctcttggattatgagccccgtcaagatcttgatcagttcaaatcgatgttttcttttatgaaagactcagacggacttacacaaatgatcactccgatggatagcaatattcatatcaagattggtgctgaattaggcaatgatttattgcagaatatgagtatgattcaagcaagttacgagatagatggtcatggaagaggtacaatagccttgttagggcctactagtatgccttattctcggatgttcggtctagtcgatgtttatcgaagagaactagcagctaaacttgctgattactaccgttcgcttgacttgtcaaactcgtaa

SEQ ID NO: 1673 - DNA (genomic), 1311 bp, Enterococcus faecium; double-stranded, circular
  misc_feature (B) LOCATION 1...1311
  hypothetical: NO
  anti-sense: NO
aaatggaggaataaaatggcaatagaagccggattagtgttattttttgtatttgttgtgttgcttgtattagggatgccgattgctataagtattgcattctcatcgatgatgactttattgttagttataccgtttgatgtttctgcttttagttcagctcgaaaaatggtgggaagtatcaatagtttttcgctgatcgctattccgtctttcgttctctcgggcattatcatgaataatggagggatagctaataaactactggattttgcgatgttgttcgtcgggcgcgtgccgggggctttggctcatactaatgtgttaaggaatgctttatttggttccatctctagctcggccattgccgcttctaccgcgattggcggagtgttgatccctcagcaagtggaagaaggatatgaccggaagtttgcgacagcggtcaatatcgcgtcagctccgacaggtatggtcattcctccaagtactgcttttatcatgtattcacttgttgctggtggtgcttcgatctctgctttgtttatgggaggttatctcgtaggcgctttgtgggcgctaggaatcatgctagtagcattcatcgttgctaaaaagaataaataccctgttgtcgaaaaaggacagatggctcatgctggaaaaataataaaagaggcgattcctagccttctattgattgtcatcattatcggtggtatcttgacggggatatttacagcagtagaagcttcagcgatagctgtcatttactccctgttgattgctatgttttactataaaacggtaaaactaaaagatatacctaatatgttgtttcaatcagtagcaatgtcagggacgatcatgttcttattggctacttcttccatgatgtctttcgccatggcgtttaccggtattcctcaggcaattagttcgttgattatgggcgtaacggataataaatttattattctgttattagtcaatcttgtgttattactggtgggtatgtttatggatgtggcgcctgctatcttgatttttacaccaatatttttaccaatcgtcacaagtgtaggggttgatcctgtacattacgggttgttttcaatcatgaatctgtgtgtaggctccatcacgccgccagtaggtacaggactatatgtcggtgcaagtgtaggaggcgtaaaagcagaggcaatgctgaaaccgcttcttcctttttatggggttatcttagtcgtcttgtttttgattacttacttcccgcaaatcgtcatgtggctacccaatatgctgagttag

SEQ ID NO: 1674 - DNA (genomic), 234 bp, Enterococcus faecium; double-stranded, circular
  misc_feature (B) LOCATION 1...234
  hypothetical: NO
  anti-sense: NO
tttaggaggaaaacaattatgaattatatctcagcagcaatcgcaatcatgggagcagcaatcggagccggttatggtaacggtcaagttatctctaaaacaatcgaatcaatggctcgccaacctgaaatgtctggtcaattccgtacaacaatgtttatcggggtagctctagtcgaagctgttcctatcttaggggtagttgtcgccttgattctagtttttggtgtttaa

SEQ ID NO: 1675 - DNA (genomic), 339 bp, Enterococcus faecium; double-stranded, circular
  misc_feature (B) LOCATION 1...339
  hypothetical: NO
  anti-sense: NO
ttaaggaggaatgtaagtatggcatggatggaattaatcatagcaggaattttggaagtattctggtcaacgatgatgaaatggagtgatggtttttctaaaatcaattattctttttacacagtgattggcatgattgctagtttttactttttgtcaaaggcaatcaaaagtttgccgatgagtctctcttatcctatctggacagggattggcgcagttggttcggtcataattggtgtggtcttgtttcatgataagctgaatctttccacttggttctttgtggggatgctactcatcagtatcattggcatcaagattactagcggccactag

SEQ ID NO: 1676 - DNA (genomic), 369 bp, Enterococcus faecium; double-stranded, circular
  misc_feature (B) LOCATION 1...369
  hypothetical: NO
  anti-sense: NO
gaaaggaggaagcaaatgtttaaaggggtattgtttgatttagacggtgtcattaccgatactgctgaattccattatcgtgcttggcgaaagcttggtcaggaaatcggcattacgatcgaccacacattcaacgaacagctaaaaggcgtcagccgagaagactcactctctttgcttttagcttatggcggaaaagaacactctttttcaaaggaagaatttgcagaattagcgaaaagaaaaaacgattattatttagagatgatccagacgatcgaaccaaaagatgtcttccccgggggtcgtgcctttactggattctttaaaagaagaaaaaatcaagattgctcttgcttctgcaagtaa

SEQ ID NO: 1677 - DNA (genomic), 1527 bp, Enterococcus faecium; double-stranded, circular
  misc_feature (B) LOCATION 1...1527
  hypothetical: NO
  anti-sense: NO
aacgggaggaattggccgtttaggaatctatctagtagggatgattggttgtgcgttttctatttggtatctttttttgaaaaaagaaagagggggcagctaaatatgaaaaaacttggttggcttagtatgtgtctcttcttgttactatttaaaccagcttttactcaggtagcaacagaaacagaaacagaaatggttcagattactttacacaaattgcttttcccaaacgggcaactgccgaaaaatcatccaaatgacggacaagaaaaagctttattacaaacgtatcgaggattaaatggtgtcacattccaagtttatgatgtcacagattctttttaccatctacgggaaaagggcaaaacggtagaagaagcacaagcagagatcgcaaaaaacggtgcgtcttccggtatgtttaccgcagaagcaacaactacaactcttaacaacgaagatggtatcgcttctttttctctggccgctaaagatcaagaaaaaagagataaagcgtatcttttcattgaatccaaagtaccagaagtcgtcaaagaaaaggcagagaatatggtagttgttcttcctgtacatggacaaaacaatcaaaaactttcaactatccatttgtatcctaaaaatgaagaaaacgactaccctgatccaccttttgagaaggtattagaagagcctagaaatgattttacgattggtgaaaaaatcacttattccttgcatacgacaattcctgtaaatatccttgactatcaaaagttcgaattgtcagatagtgcggatgaagcattaacgtttttacctaatagtttaacgatttcatcgaatggagaaaagctgacagaaggctttgtcatacacaagaaacctcacggatttgatgttttattttcgatcccttcgttggaaaaatatgctggaaaaaaactgaccatttcttatcagatgcagctaagcagtacagcacaggcgaacaaggaaatcaacaacaacggaacactggattttggttttggtgtcagtacaaagaaagtctctgtatatacagggagtaagcaatttgtcaaaatcgagacaaataaaccagataaacgattagctggcgcagtattccttattaaaaacaaagcaggaaattacctccagcaaacagccaacggatacaagtggacaaagaacgaatcagatgcgcttcacctgatttccgataaaaatggcgctttttcaatttccgggttgaaaacaggaagttatcgattaaaagagatcgaagcaccttctggttatattttaagtgaaacagaaattccgtttaccatttcaacttttctttctgaggataaagaggcggacagtatattgaaagtagtcaataaaaaagaaaatagccgtccatttcttccaaaaacaaacgaaacgaaaaatacacttttaggcgttgttggtatggtattcgcaagctttgcaatctggttgtttatcaaaaaaagaacaggagtgaaaaaatga

SEQ ID NO: 1678 - DNA (genomic), 504 bp, Enterococcus faecium; double-stranded, circular
  misc_feature (B) LOCATION 1...504
  hypothetical: NO
  anti-sense: NO
gatagtgggaatcttttaagtataggaggaaaaagaatgttacgtttttttccgcaaaaaaacaaatatattcaagaaaaaagcgaatttcaatttaataccgatggaccaattcctcagcacattgccatcatcatggacggcaatggtcgttgggcgcaaaaccgtcgtttgccacgagttgctggccataaagaaggcatggaaacagtaaagaaagtcacaaaaaaagcatcaaggcttggagtgaaagtgttgacgctttatgccttttcgactgaaaactggaagcgaccaaaagatgaagtaagttttctcatgcaactacctgtcgacttctttgatacgttcgtaccagaattgattaaagaaaatgtcaaagttcatgtcatgggttatgaaaacgtattgccagaacatacgcaagatgctgtaagacgtgcaattgagcaaacaaaaaacaatactggaatggtattgcattttgcactgaactatgagtag

SEQ ID NO: 1679 - DNA (genomic), 276 bp, Enterococcus faecium; double-stranded, circular
  misc_feature (B) LOCATION 1...276
  hypothetical: NO
  anti-sense: NO
aatggtgggaaagtaatgaaaagagaagagacagataaaataaaatggacagtcgctctttgtggtacacttctgctatttctatatggactctttactcagaatatcatcatcaatctattggtcatttttttcgcactagtgatctataaatatggaaatcacgttttattcagagagtacgatgaaaaaagaaaacggaaaatagaagaatcaatgaaaataaaagaagctaccaaagaaatattgagagaaaaaagttttataaaaagataa

SEQ ID NO: 1680 - DNA (genomic), 1140 bp, Enterococcus faecium; double-stranded, circular
  misc_feature (B) LOCATION 1...1140
  hypothetical: NO
  anti-sense: NO
agttgcgggaaccctaggggcaagattttggctgcatggttagctcgggtattaggtggcggcacagcggcaaaaaatattgcaaatatcattgtgctggctattttgacctatgtatcgattgtttttggagaattgtaccctaaacgtattgctttaaataaatcagaagaagtcgcaaagttcacttcagggctgatacgcttgattggtgtagtagctaagcccttcgtctggctgctttctgcttccacaagtttattggcgcgtatcacgccgatgacttttgatgatgaagattcaaaaatgaccagagatgaaatgcgttatatgcttgaaaacgaaggcgtattgaataatgaagaattagaaatgctccaaggggttttttctcttgatacgaaagttgcccgagaagtcatggtcccacgaacggatgcatttatgattgatatcaacgacactgtggaagaaaatgtgaatgaagttttatccgaaaactattcaagaatccctgtttataacgaagacaaagataaagtagtcggaatccttcatacaaagaatttactaaaagctgcccataaattcggctttgataatttagatatcaagaaaatcatgcaggagcctttattcgttcctgaaacggtctttattgatgatctgttatatgaaatgaaaaagacgcagaatcagatggctattttattagatgaatatggcggcgtcgttgggttagcaacactagaagaccttttagaagaaatcgtcggagaaatcgatgatgaatcagatgaagttgagaatctttatgaaaaaatcgatgaacacgaatatatcatccaaggacgtatgctgattgatgagttcaatgaagcttttgacagtgatctgcatatgagtgatgtagatacgatggctggttatttgattacagcattaggcatgattccggatgaaggcgaaaagttatcgtttgatgtcgataatattacgctggtttctgaagaaatggaaggttctcgaatccttaaaatccgtgtcatttttcatgatccggaagaaacagaagcggaacctgaagaagaacgaagatacttcagaaaagaattcgaagatgacgagccaagaagataa

SEQ ID NO: 1681 - DNA (genomic), 768 bp, Enterococcus faecium; double-stranded, circular
  misc_feature (B) LOCATION 1...768
  hypothetical: NO
  anti-sense: NO
agggtagggaaagaaatgaacaaaatagtcgaagtacagaatgtaacaaaagtatacggaaaaaacaatgagaaaaagacgcaagcattaagcggcatcagcttcgatgtagaaaaaggcgaatttattgggatcatgggcgcttctggttctggtaagtcgacacttttgaatattttatccacattagataaaccaacagatgggcatatccgaatcaatcaaaaagatgtgaccacattaaaaggaaatcaactagcagattttcgtgcgaatgagattggctttattttccaagatttcaatttattagaaagcttgacagcacaagaaaatatcgctgttcctctttctttacaaggcgtcagaccaaaagaaatcaagcaacgtgtccaaaaaattgcagaacgtttatccatctctcatattttggaaagctatccttctgagatttccggtggacaaaaacaacgggtcgccgccgcacgtgcattgatcacacaaccaacgattctattaggggatgagcctacaggtgcgctggattccaaaagtgcccgggatcttttagatacgatggacgaattgaatacaaaagatcatgtatcgattcttcttgtgacgcatgatccgttttctgcaagttattgccaacgtattttattcatcaaggatggcggtatccatcaagaagtgaaacgtggagatcaaagccgtgattccttctatcgagaaatactatctattcttggaaacttggaacagtag

SEQ ID NO: 1682 - DNA (genomic), 375 bp, Enterococcus faecium; double-stranded, circular
  misc_feature (B) LOCATION 1...375
  hypothetical: NO
  anti-sense: NO
caaaaagggaaagcagaacccgaagctaaacaaaagatcgccaatgccttcaaggaatatggcgaagcacctgtcttgagtatggttatcgatatgataccgccaatgatgcgcgaagcagcacagccgctaggacatatcgaaaaaatctctgttgtcgatacaggaagcagttcaggagaaaccagtggagcgaaccgagtgacaaattatgccacaaatttgctttgttatagtcaagaaacactaaaagcgacaacaggacttgacttgaaggaaatcgtagagaatttgtcgacacgtgggactactagccaagtaaatatgtatgaagcgccaaaagaggcagaacaaaactcgatgaaggaagaataa

SEQ ID NO: 1683 - DNA (genomic), 531 bp, Enterococcus faecium; double-stranded, circular
  misc_feature (B) LOCATION 1...531
  hypothetical: NO
  anti-sense: NO
aaagaagggaacgtgaataagatgggtgtagtcaatttagcgcgtgtggatgagcgtttgatccatgggcaagtaatggtaacgttatctcaaaaaagtggagtgaattccatttttgttgtagacgaagttgtagcaaaagataaatttatgagagatctttacaaaaatgcaggaagccgtacaggacaaaaaacaattgtcattacaccagagaaagctaaattctattgggatgaatatcaatttaaagaatacaattgtattttgatcgcaaaaacagtccaaacgatttacgacttagtaaaacacggaatccccatggaagaattgaatattggagggattgctcaaaaaaatcctgatacagatcttttagtgacgaaatctgtttatttaaataaatcagatgctgaaaaattgaaagaaatgaatgaacaatatggcgtaaagaatatttattttcaagccactccatctgcacctaaaacaggattaaaagatgtattgaacaagtttgatttgtcataa

SEQ ID NO: 1684 - DNA (genomic), 507 bp, Enterococcus faecium; double-stranded, circular
  misc_feature (B) LOCATION 1...507
  hypothetical: NO
  anti-sense: NO
aaaagagggaaatcaatgaaacgtgcattattcccaggaagttttgatccttttacaaaaggtcacttagatacggtggaacgtgcggctaaattattcgatgaggtagtaattggtgtttttatcaatacttcaaagaaaagtttgtttcccccagaagaaagaatgacattgatcacaaaagctgtttctcatcttcctaatgtaaaagtcatgcatcaagaaaatcaattgacggtagaaacagcaaaagagattggtgcagatgcgttgatcagaggcatacgaagtatcaaagactttgaatatgaacgagagattgctcagatgaatcatcatctatatgatgaattggaaactgtcttcttattagcaaaaccagaatatagtcacgtgagttccagtattttaaaagaagtactgcactttggcggagatgtgagcagctacttaccgccagtgatcaacgaagctttagctggaaagcgtgaatcaaatgaaagctaa

SEQ ID NO: 1685 - DNA (genomic), 732 bp, Enterococcus faecium; double-stranded, circular
  misc_feature (B) LOCATION 1...732
  hypothetical: NO
  anti-sense: NO
ttaggagggaaaaacgtggcgattaaaaagtacagacctacctcaaatgttgttcgtaacatgacaggttctgattttgctgaaatcacaacatcaacacgtgaaaaatcattgttacaaccattgaaaaaccatgttggaggtaacaacaacggccgcatcactgtacgtcatcaaggtggcggacacacacgccaatatcgcgtgatcgacttcaaacgtaacaaagataacgttgttgcaactgttcaaacgatcgaatatgatccaaaccgttcagctaacatcgcgttagtacactatgaagatggagtgaaagcttacatcttagcacctaaaggactagaagtgggtatgaaacttgtttcaggtccagaagcagatatcaaagtcggaaatgctcttccattagaaaacattccagttggtactgttatccacaacattgaaatgaaacctggtaaaggtggacaattgatccgttctgctggtacaagtgctcaagtacttggtaaagaaggcaaatacgtattgatccgcttgaactctggtgaagttcgtatgatcttagctgcatgccgtgctacaatcggttctgtaggtaacgaacaacacgaattaatcaacatcggtaaagctggacgctctcgttggatgcgtaaacgcccaactgtacctggtagcgtaatgaacccttatgataagccctcttacaccacgagatgccccccc

SEQ ID NO: 1686 - DNA (genomic), 705 bp, Enterococcus faecium; double-stranded, circular
  misc_feature (B) LOCATION 1...705
  hypothetical: NO
  anti-sense: NO
aaggaggggaaatacatggattttagcggcgctttttcatggatgaatatccgttttttattggaaggattaaaggttactgttgaagtttcattgttttcgatcatttttagtttcttgatcggtggtctgacaggtgtgattcgttttgcgaatatccctttcttttccaaaatccttggtgtagtgattgatattatacggaatcttccattattattgatcattttcttcacttactttgccttacctcaaatcggcattcagatgaacatcttctggtccgctgtcgcagcattaacgatttttgagtcagctatgttgtcggaaattttccgagctggactcaatgctgttccaaaaggacagatggaagcaggattatcaacgggactgacttatgtagaatcgatgcgaacgatcgtgttaccgcaagcatttaaatcaatgatcccggcaattgtgagccaattgatttcactgatcaaagatacttcattagcagtaatcatttctttacctgaactttctcatcaggcacgtattatttatggacagaacaccaattatgtgcttccgatgttcatcatcatgacacttatgtacttcgtggtatgtgacgcgctttctctgctttccggttacttggaaaagagacggtacagttataaatacatgatccttttagcggttgtggcaaactaa

SEQ ID NO: 1687 - DNA (genomic), 507 bp, Enterococcus faecium; double-stranded, circular
  misc_feature (B) LOCATION 1...507
  hypothetical: NO
  anti-sense: NO
gcattgctttttctaaagaaaatatgttattcttattgcaagaagaaaacggagaaagtagtgatagcagtgatcgttaacgaagagctgtttcaactggaggatcaatgcctccaagtcgctgaaatgataaaaaagagtaaaacgatggcttcttatcttgaacataaacagtcaatggaagaatctgcaaaagtttgccagttgaaagaaccgttcttgtctaagaaagaagcatttgaaaatgtaccggcatatggtgagtatgcacctgattatcgtgaaaaaaaacgagctgttcgaaaagcaaaaagacagcttgatatggatgagcatgttgcagctttccgatatagtgaaacacagctgcaaagtctgttggatcaaattgtccaagtacttgccgaagaagtttctaatgaaatcaaagtagatgcaggtagcccgttttttgaaacgaaaaaacactttggatgcggaggtaattgtcatgcaattagacaatag

SEQ ID NO: 1688 - DNA (genomic), 213 bp, Enterococcus faecium; double-stranded, circular
  misc_feature (B) LOCATION 1...213
  hypothetical: NO
  anti-sense: NO
tcaaatcgtttatgtggcttacgctggggatctagagagcgcggagaaggcaaaacggcttttggaagagcagataaagatgaaagatgtgaagctttatcccttaggaccaacgatcgccagtcacacaggctatggctgtatcgcgattttttcgatgggaatcagtcgataaaagcagtaactcattctgtaaaaaagcccagaaattga

SEQ ID NO: 1689 - DNA (genomic), 186 bp, Enterococcus faecium; double-stranded, circular
  misc_feature (B) LOCATION 1...186
  hypothetical: NO
  anti-sense: NO
caccgtcgtttccaactttttccattgcatcagcaatcaaatgtccaactttatcagaacccgaagaaacagctgctacttgtgcaatggcttcttttgaatcaacaacagttgagatattatgcaattcttcgactgctgcttttgttgccaattcgatcccgcgacgaatgcctagaggattag

SEQ ID NO: 1690 - DNA (genomic), 318 bp, Enterococcus faecium; double-stranded, circular
  misc_feature (B) LOCATION 1...318
  hypothetical: NO
  anti-sense: NO
agcttgcacctaagtgggtctattattctggaggtgacggcaaatgatggattatttcaaaaagaccagtgtgaatcggcaaacaaaaaaaatactaagttatgtcctcatgacagtaataggaatcattttgatcattccattgctttggatggtgtttacttcattgaaaccaatggaagaaatcgttcgttatcctccgacctttttcccagaaaaaatcgtatgggaaaactatctggatacgattgccgcctttcctttttggcgctatgcaagaaatacattattcatcactgtgctagtagtgatcggtaa

SEQ ID NO: 1691 - DNA (genomic), 246 bp, Enterococcus faecium; double-stranded, circular
  misc_feature (B) LOCATION 1...246
  hypothetical: NO
  anti-sense: NO
caaatgcacctcaagatatacttgagctatcaagaagtctggaggttttctatgtataaattaaatgagattgttcctgtccaattaggaaacgaaaagagtgcaccagaaaaaggtaaacccgcggctgccaagttagcgatgcgcatcaaaagagagaatggttctgaagttttgatctataacggtattaacaattatattcttcaagctattttgaaagaactgttgtccaatgctttatga

SEQ ID NO: 1692 - DNA (genomic), 246 bp, Enterococcus faecium; double-stranded, circular
  misc_feature (B) LOCATION 1...246
  hypothetical: NO
  anti-sense: NO
caaatgcacctcaagatatacttgagctatcaagaagtctggaggttttctatgtataaattaaatgagattgttcctgtccaattaggaaacgaaaagagtgcaccaaaaaaaggtaaacccgcggctgccaagttagcgatgcgcatcaaaagaaagaatggttctgaaattttgatctataacggtattaacaattatattcttcaagctattttgaaaaaactgttgtccaatgctttatga

SEQ ID NO: 1693 - DNA (genomic), 189 bp, Enterococcus faecium; double-stranded, circular
  misc_feature (B) LOCATION 1...189
  hypothetical: NO
  anti-sense: NO
aatctttttgatcaatcaattaatcaatgtaagataacaaaaaatctgagccagaatgtggttcattctgactcagatttgattttgcacaactcatcagtccttattgacaaagagcccatttttggcacaaatacaaaacaaacccctgtaccgcaaaggatacaggggttatttatacgttcctga

SEQ ID NO: 1694 - DNA (genomic), 231 bp, Enterococcus faecium; double-stranded, circular
  misc_feature (B) LOCATION 1...231
  hypothetical: NO
  anti-sense: NO
aatctttttgatcaatcaattaatcaaagtaagataacaaaaaatctgagccagaatgaggttcattctgacccagatttgattttgcacaactcatcagtccttattgacaaagagccatcattttcagatctgaacggttttttttatctattcatcaagatcaaatttcatttttcaatgattcaatcaattcgccctctgcttcatgactatgttttcggccattaa

SEQ ID NO: 1695 - DNA (genomic), 285 bp, Enterococcus faecium; double-stranded, circular
  misc_feature (B) LOCATION 1...285
  hypothetical: NO
  anti-sense: NO
aatctttttgatcaatcaattaatcaatgtaagataacaaaaaatctgagccagaatgtggttcattctgactcagatttgattttgcacaactcatcagtccttattgacaaagagcctttatttctaagtaaggaatcagggatcacctgttttttatttttccaaataaaactcaaaacgatttcctacgtattgcgtacgcacatactcaaacggcgtaccgtcttcaaaataagaaatctggcgcaaacgaagaactgcatctcctcgttttacctctaa

SEQ ID NO: 1696 - DNA (genomic), 783 bp, Enterococcus faecium; double-stranded, circular
  misc_feature (B) LOCATION 1...783
  hypothetical: NO
  anti-sense: NO
tgggattttgatcattgtcgcaatgctaggcggattgttttcgatacgtacgataaccaaagtagacccaattacagcaataggaggttaataaaaatgaaaaaaatattaacgatgaaaaaagttaccaaaacatttggttctggtcatacaaaggtctcagctttgaaagcaattgatttttatgtaaaggaaggagaattcgtcagcatcattggtccttctggttcaggtaaaagtactttccttaccatttcaggaggattgcaaacaccgacttccggagaaatagtgatcaacggtcactcactaactgagcttccagaaaaaaaacgagcagatttacgctttaaagaaataggatttattctccaaagctctaatttgattccttttttaacggtaaaggaacaatttgaactagttgaccaagttacttcaaaaaaagaagattcaacaaaaatcgattccttgctgcaatctttagatatccagtcacttaaaaatagttatcctaaagacctttctggtggagaaagacagagagtggcaattgctcgcgctttatataatgagccaagcttgatcttagcagacgaaccaacagctagtttggatacagatcatgcatatgaagtcgtcaaattactagttaaagaagctcatgagaaacaaaaagcgactattatggttactcatgatgtccgtatgattcaatggagtgatcgcgtttatcgaatggaagatgggtacttgacagaagaagagaaaaagaaggaatga

SEQ ID NO: 1697 - DNA (genomic), 207 bp, Enterococcus faecium; double-stranded, circular
  misc_feature (B) LOCATION 1...207
  hypothetical: NO
  anti-sense: NO
tcatcctttgatttcaaagcaccgatattgatgaccatatcgacttcatctgcaccgttattgatggcatctgttgtttcaaatgcttttgtctcgggtgtgtttgctcctagaggaaacccgattactgtacatacggctactggctcaccttgtaattgttctttcgctagcgcaacccatgctggattgatgcagacagaataa

SEQ ID NO: 1698 - DNA (genomic), 1356 bp, Enterococcus faecium; double-stranded, circular
  misc_feature (B) LOCATION 1...1356
  hypothetical: NO
  anti-sense: NO
ctaatgtttgattttttgcagaaatacctgatgggacctatggggaaaattgcgcaacttaaaatcgttcgggctgtcatggcagcggggatggcttctattcctttcacgattgtaggctcgatgtttttggttttaaatattttgccattaccgttcccatttttagaaggattttttaatgcaacttttttcaaagttagtgacttgtacatgatcgtcaatacaatgacgatggggattttatctatttactttgccattgtgtttgcttatgaattaacgtcaattgaacgagatgaacaaaaattaaatgttaatccgctcacgggggcattactatctgtttttgcattctttatgtgtatccctgaattgatcatgactgatggtaaaatcagcttgattgcttctatcaatgagacagaaactgtagtaaatggtattaggatgggctcttttgtcgaacgtttaggaacttcaggaatctttacagctattattatgtcgattattgcggtcgaattgtattgtatgtgtgtcaagagaaattgggtcataaaaatgccagatgttgttccgccaggagtttctcgttctttcactgctctgatcccaacatttgtcattgcgtttgtggtgatgatcatcaatggattattagttgcactaggaacggatatcttcaaaatgattgctatcccatttgggtttgttacgcagttgacgaatacatggcttggtgtcatggtgatttatttcttgatccatgcattgtggatcgtagggatccatggagcgaatatcatcacttctttcttgaccccgatcgtattagctaatatggcagctaacgcacaaggcgcaaattatccgttggcaggagaattcaacagttcttatgtaaccgttggtggatcaggtgcgactttaggattgatcatctttattgcattcctcgcgaaatctgatcagctgaaagtgttaggaaaagcctcacttgtaccaggattattcaatatcaatgaaccaatcattttcgggatgccaatcgtctacaatccctatttagcggttccgtttttcttagctccgatggcttctgctacactcgcttattttgccattcggctggaaatcgtcaaaccgatgcttgcacagatgccgtggccttcaccagtcgggatcggagcatttgttggtagtggtggtgattggaaagctgctgtgttagcagtcatttgtgcaatcatcgcattcattatctggttcccatttatcaaattctatgataataaattattaaatgaagaaagagaaaaggcagcagaattagctagtgaaaagttaaaatga

SEQ ID NO: 1699 - DNA (genomic), 228 bp, Enterococcus faecium; double-stranded, circular
  misc_feature (B) LOCATION 1...228
  hypothetical: NO
  anti-sense: NO
tccgttcttgacacaattgctgattgtcagaaagttgtcccacaactacataatatggagaagaaaaatcaagctcaattaagtgagggtggtatcgactatgtacttgatatcatcaatgaaccgatggtactttcttatgcgatggaacaggtagagcgattgcttgtttgtgcaggaaaacaagcgatgcggctgatacgattaggtgagaaaataagaagataa

SEQ ID NO: 1700 - DNA (genomic), 273 bp, Enterococcus faecium; double-stranded, circular
  misc_feature (B) LOCATION 1...273
  hypothetical: NO
  anti-sense: NO
tgcagtcttgactttgccaaatctagatccagcgatctgcggaacagcctctcttgcaacgatctttttgctgcagcaagttttgtattttacagcaaaacagctagtccaggacacaagtggaaaatagttatccacatgttgacaaagttccttaaaaaaataatgttccacataaaaatggagcgtttgaaaaaaagaaaacgattattaatgaggattaacaacgactactttttttgttttagttattttaagatggatcatctttga

SEQ ID NO: 1701 - DNA (genomic), 849 bp, Enterococcus faecium; double-stranded, circular
  misc_feature (B) LOCATION 1...849
  hypothetical: NO
  anti-sense: NO
caaatacttgaacgaggagagaaagcaccaatcggattgtacagcggagcaatcaaaggaaaaaacaaagaaaatgttacagttttcggcacaacgaaagaagcatttttattaccaaaactcacgaaagggcatgaatttaaaacaaagaatgaaatcatcatctctcaaaatctggctgattcaggctataaaattggagatacgatcaaaattggcagttacgacgatcctttgacgattgtcggtatctttcctgaaacttattacacagtttctcccgtcatctatgcgtccctagatacgtggactgctttgaagtatggacaacagccgtttgcttctgaagaagaacagccgatcaatgggatcgtaataaaggattcagctaaaatttcgaaagaaaaagcatcgaagggtctacagttattaactattgggacattcattgaaagtattcctggctattctgcccaaaatatgaccttaaatgcgatgatatactttttgttcttagtggttgctgccgtggtcggtattttcatgtacgtgatgacacttcagaagactgctatttttggagtaatgaaagcacaagggatcaaaaatttcttcatcgctaaatctttagtagcacagtcctttattgttggggtggtaggcgttctgcttgctcttttgtttgcttatttgactagtctgattttaccaagcgcgatgccttttgctgttttttggtcacaatggttgctatatagtgggattttgatcattgtcgcaatgctaggcggattgttttcgatacgtacgataaccaaagtagacccaattacagcaataggaggttaa

SEQ ID NO: 1702 - DNA (genomic), 513 bp, Enterococcus faecium; double-stranded, circular
  misc_feature (B) LOCATION 1...513
  hypothetical: NO
  anti-sense: NO
tcgcgacttgagaccatttggtggtatacattgctgatttgtgcaggattggcagtcctattgattatttttggagatgtattcgattttgatggcccgcttgatccgatgcttattatcccttggttaactttcacaagcttatttggttttctaggtgagcgtttaacagatcaatcatctttatttttatttattgctagtggaggcatatcgatagtgttggtatttttgcttaatttctatatattgatgccgatgaaacatgccgaatcaacgatgtcgtcttctgaaaaaactctggaaggacaagtagctgttgtgatcacaccgatccctgtacgaggtatgggagaaattcagttgaaaagtgttaccggttccattagtcgtccagcttgtttttacagcccccaagaacagacagctgagcggggaacgaaagtattgatcattgagatcaaggaaagaatctgttatgtcatgccttatgaaagcatgataaaagcttaa

SEQ ID NO: 1703 - DNA (genomic), 321 bp, Enterococcus faecium; double-stranded, circular
  misc_feature (B) LOCATION 1...321
  hypothetical: NO
  anti-sense: NO
aaacagcttgaaagaggtgtgtgtatggatgtttcaatcagaggaattgatccacaatatgtaaaagagattgataaaaaagttaataaaattcaagaacgtaccggaaaaaagtttagtaggaatgactattttttagcaatcattcgccaagatagcgagatcgatttgattgactataaaaagtcagaatttgatttagtagttgaaaaacttttattgtcaaatgaacaaatggtagaaagtattagcgagttaacttcagtttatgaacgcttattcaattttttaattagcgaaaggagtgatttaaataaatga

SEQ ID NO: 1704 - DNA (genomic), 189 bp, Enterococcus faecium; double-stranded, circular
  misc_feature (B) LOCATION 1...189
  hypothetical: NO
  anti-sense: NO
aatcgtattgatgattttacggatggtttttatttatttgagaaatcttttttcaacgtgaattcattatctacatcatacgggttgattctagaatggggagtggcaaaaaatagtgtgatccattttttcagcatcaagatcgcctcctttgatttgaatcaaaggtacaaagcgaaacttagataa

SEQ ID NO: 1705 - DNA (genomic), 1434 bp, Enterococcus faecium; double-stranded, circular
  misc_feature (B) LOCATION 1...1434
  hypothetical: NO
  anti-sense: NO
aatagtattgagattggaggaaaaaagatgagttcaggcaagattgttcaagtaatcggtcccgttgtcgacgtggaattttctttagaccaatccttaccagatatcaacaacgcattagttgtttataaaaatgacgaaaataaatcaaaagttgttcttgaagcagcgttagaattaggggacggagtgatccggaccattgcgatggaatcaacagatggtttacaaagaggaatggaagtcattgatacaggcaaagcaatctctgttcctgtaggtaaagaaacattaggtcgcgtattcaacgtactaggagatacgatcgatttagaaacacctttcccagaagatgcggaaagaagcgaaattcataaaaaagcaccagcctttgacgaattaagtacaagtacagaaattttggaaacagggatcaaagttatcgatttgcttgccccatatttaaaaggtgggaaagtcggactattcggtggtgccggtgtnggtaaaaccgtactgatccaagaactgatccataatatcgcccaagaacatggtggtatttctgtatttaccggtgtaggtgaacgtactcgtgaaggtaatgacttgtattatgaaatgaaagattcaggagttatcgaaaaaacagccatggtgttcggacaaatgaacgaaccaccaggtgcacgtatgcgtgttgctttgactggtttgacgattgcggaatatttccgtgatgtagaaggtcaagatgtactgttgtttatcgacaacattttccgtttcactcaagctggatctgaagtatcagccttgttaggacggatgccttctgcggttggttatcaaccaacattggcaacagaaatgggtcaattgcaagaacgtatcacatctacgaaaaaaggttcgatcacatcgatccaagcaatctatgtgccagccgatgactacactgacccggcgccggcaacagcattcgcccatttggatgcgacaaccaacttggaacgtaaattaacagaacaagggatttatccagcggtagatccattggcttcttcttcaagtgctttagcacctgaaatcgtgggagaagaacattataaagtagcaacagaagtccaacacgtattgcaacgatatcgtgaattacaagatatcattgctatcttaggtatggatgaattatccgatcaagaaaaagtgttagtttctcgtgcccgcagagtccaattcttcttgtcacaaaactttaacgtggctgaacaatttactggtcttccaggttcatatgtccctgtagaagaaacagtgaaaggattccgcgaaatcttggaaggcaaatacgatgatcttcctgaagaagctttccgaagtgttggccgaatcgaagacgtcgtagaaaaagcgaaaacactaggctactag

SEQ ID NO: 1706 - DNA (genomic), 1209 bp, Enterococcus faecium; double-stranded, circular
  misc_feature (B) LOCATION 1...1209
  hypothetical: NO
  anti-sense: NO
ttcttcattgaaaatagaaaaagaggtggcaccatgattgaatttcaaaatgtgtcaaaaatttataaaggtggaaaagtcgctgtacaggacgtcaatctttcatttgaaaagggtgagttcatttgttttatcggtacgagcggaagcggaaaaacgacgacgatgcggatgatcaaccgaatgactgatccatcacaagggaaaattttgattgatggaaaatccatccaagaaattgatccagtggaattgcgacgtcagatcggctatgttatccaaagtattggattgatgcctcacatgacgatccgtgaaaatatcactcttgtccaaaaattgttgaaagtcagtcaagaagaacggaataaaacagctgaaaaaatgattgatcttgtggaattgccccgtgagatgttagatcgctacccacatgaattatctggtggtcagcagcagcgtattggagtcgttcgtgcccttgcagcgaatcaagatatcatcttgatggacgagccattcggtgcgcttgatccaatcactcgtgattccttgcaagaccttgtcaaagatttacaagagcgtttgggaaaaacgatcgtatttgtaacccatgacatggatgaagcgattaaactagcaagccgtatcgccatcatgagtgaaggccgtgtgatccaatttgatacaccagaaaatattttacgtcatcctgcaaacgatttcgtagaagagttgattggagaagatcgcctactacaagccaagccaaatgcgacaagagtcggcgaagttatgctaaatacagcaatcacgattacaccggaaaaatcattacaagaagcaatcaaactgatgagggaaaaacgtgtagatacgttgttagttaccgataattcgaatgtattaaaaggatttatcgatgtagaaacgttgaataaaaaacgaggaaaagtatccagtgtcggcgacattttgaataaacatgttttttacgtaaaagaatccgcctatcttcgtgataccttgcaacgcattttaaaacgcgggctgaaatacgtgccggtcgttgatgaacagaacaaagtcgtaggtatcctgactcgtgcatcattagtggatatcgtctacgatgtgatttggggagaagatcccgcaactactgatgttgcagagtcagctactcctgaagaatctaaggaggtctga

SEQ ID NO: 1707 - DNA (genomic), 249 bp, Enterococcus faecium; double-stranded, circular
  misc_feature (B) LOCATION 1...249
  hypothetical: NO
  anti-sense: NO
gaattaattgaatatcttcgtaatcaaatactttcattacattatcctcctgatgttcacatccagcaaaacacgaacattattaatttaatcaaggctttttttagcgccctatgtaatttaactcaattaagcaaaaaaatcaagagcaaaaagagaatttatacgaatggtaaaaaaacatatattatttttagtctatacaaacgaaacaatgaatgttcgcttttagcgaaaaaaagactgtga

SEQ ID NO: 1708 - DNA (genomic), 681 bp, Enterococcus faecium; double-stranded, circular
  misc_feature (B) LOCATION 1...681
  hypothetical: NO
  anti-sense: NO
aagttaattgaaattatatggtacttctttcttgggagggtaggtgcagtgaaggaaagatatggtcaccttactgttgttgaggagattactcataatggatataaaaaatatcgttgcctatgtgactgtgggaatgaaacgattgtatatcgatcaaacttactatcaggtagaaccaaaagttgtggatgtggaaattataaaaataggcataaatataaaaatttgacaaataaaacttttggtaagttagttgcaatcaagccaactaaactgcgaagtgaaggaactgttgtttgggaatgtcaatgtctgtgtgggagaaaaaagttagtatcggcaaagcgacttctaaaaggtgatgtaaaaagctgtggatgtttgaaatcaaaaaagcatcacattgaaaataaaaaattcggattacttactgcaaagtatcctttggacaataactgttcatggaaaacaaaatgggtttgtcattgtgagtgtggcagtatgtgtgagataagttatagtaacttattttttggacatactcaaagttgtggatgtttaaaaaggcaagaaacaaggacatgtgttgaagggacagtaatagagtgtctaacgtcaaaattaccgaaaaataatacaagtggtgttaagggagtttatcgttctaaagagaaatag

SEQ ID NO: 1709 - DNA (genomic), 1521 bp, Enterococcus faecium; double-stranded, circular
  misc_feature (B) LOCATION 1...1521
  hypothetical: NO
  anti-sense: NO
ggagggaacctagtgaaaaaaattggttttgattcagaaaaatatattgaagagcagtcagcgtatattttggaacgagtgaaccactatgacaaattatatttagaatttggtgggaagttagttgacgacaagcatgcgaaacgtgtacttccaggatttgaagaagatgcgaaaatcaaattgctgcaaaaattgaaagatcaagctgaaatactgatttgcgtctatgctggagatattgaacgtaataagatccgtggtgattatgggattacttatgatatggatatcttgcggttaatcgatgaattacgtggttatggcttattaatcaacagtgtcgttatcactcgctatagtggacagcctgccacgaaagtctttatcaataaactagaaagacgaaacatcaaggtctataaacactcagaaatcgaagactatccagtcaacgtagaaaaaatcgtctcagaagatggttttggaaaaaatgagtatattgaaacaactaaaccaatcgttgtagtgacagctcctggcccaggaagtggaaagctcgctacttgcttgaaccaactgtatcatgaaagccaaaaaggacatgcagctggttactccaagttcgaaactttcccagtatggaatgttccgttgaaacatccgctgaacattgcttatgaagcagccacagtcgatctaaaagatgtcaatatgatcgattccttccactttgatgcctacaataaagtagctgtgaactataatcgggatgttgagacatttcctgtaatcaaacgtattattgaaaaaattactggtaaagaatctgtttatcaatctcctactgacatgggtgtgaatcgtgtaggatttgggatcgtggatgataccgttgtccaagaagcctctaaacaagaaatcatccgtcgttatttccaaacagaatgcgacttcaaaaaaggattgatcgacgaagaagcagttaatcgaatcaaactgattatggaagaagtcggtttacgtcctgaagaccgaaacgtggtagtccctgcccatgactatgcagataagattcaagcgcaaagtcctacaaaagatccttctgctgtgattgcaatcgaattaccagatgaagtcatcattaccgggcgtacaagttcattgatggatgcgtcagcggcagttatcttaaatgcagtaaaacatttagcccatatcgcagatgacattcctttattgtcaccattagttcttgaaacaatacaaggattgaaatcaaagacacttcattcctctttggatgcactaagcatcaatgaagtcttgatcgctttatcaatcagtgcagtaacgaatccaatcgctcaagttgcttatgataaactagctgaacttgagggagcacaagcccactctactgtgatggtcaataaaaatgatgaacaaacattgaaaaaactaggaatcgatattacctgcgcacctgtctacccttccgaaaatctatattaccaatag

SEQ ID NO: 1710 - DNA (genomic), 192 bp, Enterococcus faecium; double-stranded, circular
  misc_feature (B) LOCATION 1...192
  hypothetical: NO
  anti-sense: NO
tgtaaaattgagaaaaaagacagagagggcagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcacactacgatttatcgttgggtataa

SEQ ID NO: 1711 - DNA (genomic), 351 bp, Enterococcus faecium; double-stranded, circular
  misc_feature (B) LOCATION 1...351
  hypothetical: NO
  anti-sense: NO
tgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttatcgttgggtgcaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttatga

SEQ ID NO: 1712 - DNA (genomic), 717 bp, Enterococcus faecium; double-stranded, circular
  misc_feature (B) LOCATION 1...717
  hypothetical: NO
  anti-sense: NO
tgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttatcgttgggtacaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgctttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaa

SEQ ID NO: 1713 - DNA (genomic), 234 bp, Enterococcus faecium; double-stranded, circular
  misc_feature (B) LOCATION 1...234
  hypothetical: NO
  anti-sense: NO
ggaacgattgaaacagttacgtgcacaagtggatgttttgactctgactgcaacaccgattccgagaactttgcatatgtcgatgttaggcgtgcgggatctttcagtaatcgaaacaccgcctgcgaatcgttatccgatccaaacgtatgttatggaaaaaaatcctggggctattcgcgaagcaatccatcgagaaatgggacgaggtggacaagtattctatttatataa

SEQ ID NO: 1714 - DNA (genomic), 294 bp, Enterococcus faecium; double-stranded, circular
  misc_feature (B) LOCATION 1...294
  hypothetical: NO
  anti-sense: NO
atggagattgatgaaacttgtttgagtaactcttataaaagtatgaatgacttttttgaggaaatggaactggattcagaattgctctatcaattttatcttgcttttcgagggcaacagatttcttttccaatgaaaatgtacgatcgtgagttagttagaaaaagaatcgaaaacatgatagaacaggaaaaaactgtagatatccgtcaattgacagaagtttatggtttctctgcaagatggattcaaaaagtaattaaacaaaaagaaaggagacgagtacatggctaa

SEQ ID NO: 1715 - DNA (genomic), 1167 bp, Enterococcus faecium; double-stranded, circular
  misc_feature (B) LOCATION 1...1167
  hypothetical: NO
  anti-sense: NO
agaggtgttgaaatgaaaatagggattgatcgtctttccttttttattcctaatttatatttagatatgacagagttggcagaaagccgtggggatgatcctgcaaaataccatatagggattggtcaagaccaaatggcagtcaatcgtgcaaatgaagacatcattacactaggagcaaatgctgccagcaaaatcgtaacagaaaaagaccgtgagctaatcgacatggtcatcgtcggaacagaatccgggattgatcattcaaaagcgagtgcggtaattatccaccatttactgaaaatccaatcttttgctcgttcttttgaagtaaaagaggcttgctacggtggcaccgcagctttgcacatggcgaaagaatatgtcaaaaatcatccagaacgaaaagtactagtcatagcaagtgatattgctcgttacggcttggcaagcggtggtgaagtgacgcaaggtgtcggtgctgttgcgatgatgatcactcaaaacccgcgtattttatcgattgaagacgacagcgtatttctgacagaagatatctatgatttctggcgtccagattatagcgaatttcctgttgttgatggtcctttatctaattctacgtatatcgaatcattccaaaaagtttggaatcgacataaagaattgtcgggtcgaggactcgaagattatcaggcgattgctttccatattccgtatactaagatgggaaaaaaggcattgcaaagcgtattagaccaaacagacgaagaaaatcaggaacgtcttatggctcgctatgaagaaagcatccgttacagccgacgaatcggtaatctttacactggttcattatacctggggctaacttctctactggaaaattcgaaatcactacagccaggagatcgcatcggtctattcagctacggttctggtgcagtaagtgaattttttacaggttatctggaagaaaactatcaagaatatctcttcgcacaatctcatcaagagatgctagattctcgaacacggatcactgttgacgaatatgaaacgattttcagtgagacgcttcctgaacacggagaatgtgcagaatatacttcagatgtacctttttcgattacaaagatcgaaaatgatattcgttactacaaaatataa

SEQ ID NO: 1716 - DNA (genomic), 339 bp, Enterococcus faecium; double-stranded, circular
  misc_feature (B) LOCATION 1...339
  hypothetical: NO
  anti-sense: NO
cggatcgttgattttggcaaatcaaatagttccgatacttggccaatcgtatacatttttttcattttttctcacctctttttcagtttattcttttttctattgaccttcaagttacttgaaggtatagaatcgaaaagtatcaggaaaaaaaggaggaataatatgtctatcttaaaaacattcttacagaaaaacaaaggactcgctctccttacctttgtgatgatctgtttacaaatcgccggtacattaggtgtaccaaaaattagtagcaaagctgatcgacacaggtatagcaagtggcgaagcctcagttataaaaaaaattggagttga

SEQ ID NO: 1717 - DNA (genomic), 1422 bp, Enterococcus faecium; double-stranded, circular
  misc_feature (B) LOCATION 1...1422
  hypothetical: NO
  anti-sense: NO
aaaaacgttgaaaagcgaatgaaacgtctatataatttgaaattgttcgatggatttgccctattttacttattttttattattatagttttccatcagaaaaaaattcagggagtggaactttttatggaaaagtttttcggtttaaagaaaaacaatacaaatgtatcaactgaaataatggcgggagtaacgacattctttgccatgagttatatcttattcgtaaatccgacgattttgtcagcatcaggtatgcccttccaagcagtatttctagcgacaatcattgcatcgattattggtacgctggtaatgggattgttcgcaaatgtaccatatgctcaggcacctggtatgggattgaacgcatttttcacttttacggtcgtttttgggcttggttattcttggcaacaagccttggcaatggtgtttatttgcggattaatcaatatttttattactgtcacaaatattcgaaaaatgattattcgggcgattcccgaaagtcttcaacatgcgattggtggcgggatcggtattttcgttgcgtatgtcggaatcaaaaatgcaggattcttatctttttcagcagaccagtcagctatttcgagctctgtcgttgaaggcggaaaagcgacaaatgttacgataaatggtggaatcgtccctgcgttagccaactttgacaacgctcctatcttattggctgtgattggtttggtactgacagccattttagttgtaaaaaatgtccgtggggctattcttatcggtatcgtagcgaccacagtccttggtatttttatgggtgttgttgatttaagttccattgattggcaaacgaattcgttaggtaattcatttaaagaattaggaacaactttcggtgcagcatttggttctgaaggcatgcaatctttattcagtgattcttccaagattcctcaagtattgatgacgatcatcgcattcagtttatctgatactttcgatacgatcggaacatttatcggtacaggacgccgcacaggtattttctcaaaagaagacgagatcgcgttggaagatggtcgtgggttcaaaacaaaaatggataaagcactatttgccgatgcgatcgctacttctgtgggggctatctttggtacatcgaatacaacaacttatgtcgaatctgcagctgggatcggggccggtggacgtactggtttgacttcagtagtagtggcagtgctattcgcattaagtagtttattctctccactgatcgccattgtaccaaatcaagcaactgcgccagcattgattttagttggagtaatgatgatggcttcttttgcagacatcaaatggctagatagtggaagaagctctaccacccttctttgcatcgatctttatgggattgtgctatag

SEQ ID NO: 1718 - DNA (genomic), 588 bp, Enterococcus faecium; double-stranded, circular
  misc_feature (B) LOCATION 1...588
  hypothetical: NO
  anti-sense: NO
caccgagttgatacgtttttttttatgcaaaaatcaaattgtcagaaaatagaaacgaacataaatatgagaggaatgatcctgatgaatcatatcgttttatttgaaccattaatccctgcaaacactggaaatattgcccgtacgtgtgcagccacgaatactccgcttcatttaatcgagccactaggtttttcaactgatgacaaacatctaaaacgggcagggttggattattggaatgatgtaaatattacttaccacagtaatttagaagcttttttaacatttttaggtaatcgtaaactacatttgatctcaaaatttgcccataaagtatatagtgacgaaaattttgctgatggagaagagcacttctttttatttggaaaagaaacaaccggtttgccagaaacatttatgcgtgaaaacgaagaaaagtgtttacgcatccctatgaatgatgagcatgtccgctcattgaatttatcgaatacagctgcaatgatagtgtatgaagcacttcgccagcaaggattccctaatttagaattgacgcatcactatgaaaatgacaagctggattag

SEQ ID NO: 1719 - DNA (genomic), 270 bp, Enterococcus faecium; double-stranded, circular
  misc_feature (B) LOCATION 1...270
  hypothetical: NO
  anti-sense: NO
ccctgctctgacggctctataggagcctttggctctcttgttacggtgtccataaaaacctcccttgctgtgaaaagagccgcaggctattcccgtctgcggctctatgtaagttttacatcagcccttaaagcggtagggcagtttgtgtccgccccgctgctggctgttgtacttttccagaatgacgcgggcaaagcgcagggcggctttattggtggagaagtccatcttgccgcgccggatgatttcttccgggtcaaccgctga

SEQ ID NO: 1720 - DNA (genomic), 423 bp, Enterococcus faecium; double-stranded, circular
  misc_feature (B) LOCATION 1...423
  hypothetical: NO
  anti-sense: NO
agaattcctgaacatattggttcagtcaacaatatagagtatactataagaagagaatttaggagggaaagaatgatttttttcagtattggtatcttattcttaataattggcagtctttttcggattctgccctcaaaaggaaacctgcctttttatgggtaccattcgcctcttgccgcaaaaacagacgctcattggcgactagcacaaaagacaagcgggaactggtttttccttatgggcttactgatgacattgatcggttattatttaaagacatctggacatacgaattattttttgatcgagatgctattattggtatttccaattatgcccatttttattatgacagaaaaaaaattacagagatatgacctggaaactggagggaacgataatgaatattttaatgattga

SEQ ID NO: 1721 - DNA (genomic), 576 bp, Enterococcus faecium; double-stranded, circular
  misc_feature (B) LOCATION 1...576
  hypothetical: NO
  anti-sense: NO
accccccctgaatcccccaaccataacccagaggagttagtcgaatggtgtttagacgagacgcntggtgtaccgttagaagtgatagatattgggacagggactggagcaattgctattagtttgaaagcagcaagaaaaaattggcatatatctgctgtggatctttcagaagaagcattagaagtagcgaaagaaaatgctcagaaagaaggaacgaaaatcagtttttatcatggagatacattaggaccagtaatggatcagcaatttgatgtgattatttctaatccgccgtacatcagtcggaatgaatgggaactgatggatgaaagtgtccggtcattcgaacctaaaatggccctttttgctgagaacgatggattagctatttatgaaaaaatagcagttgaagcaccaagcgtactaaaatcaaatggaaagatttttttagaaatcggatttcgccaaggtgaagcagtaaaaaaaatatttcagcaagcatttccagataaaaaagtggcgataaaaaaggatctttttggcaatgaacgaatgatccaagtttatggttga

SEQ ID NO: 1722 - DNA (genomic), 252 bp, Enterococcus faecium; double-stranded, circular
  misc_feature (B) LOCATION 1...252
  hypothetical: NO
  anti-sense: NO
tgttaccctgaaggtagatcaataaacaaactaagaggaggaagcacaatggcagatttaaaaggacgttctaaagatatgaaagataaagtagtcggtgaaggaaaagaagcatacggcaaagcaacagacgacaagagcaaagaaacagaagggaaagcacaatcactaggtgctgacatcaaagaaaaagctcgaaatttaggcgacgaagtcaaagacaagttttctcgaaaagacgaaaaaaaataa

SEQ ID NO: 1723 - DNA (genomic), 312 bp, Enterococcus faecium; double-stranded, circular
  misc_feature (B) LOCATION 1...312
  hypothetical: NO
  anti-sense: NO
atgacgcctgaacaagtgactgaagaattgctaatagctgtgaaggataatatttacgttacctggaacgaagaagatgagtcaattaaaaagatgatagctaaaaatgctgtttatcttcaaagtaaagtgagtacaacactttctttttctcctgaaagcttagaatacggattgctaatcgaaagatgtagatacgactggaatcgtgctttagatgagtttgaacaaaatttcgctagtgagttattaggtttcattcaacattatgcgctacaagaatatattgcaggtgatgtgaatggcgaataa

SEQ ID NO: 1724 - DNA (genomic), 264 bp, Enterococcus faecium; double-stranded, circular
  misc_feature (B) LOCATION 1...264
  hypothetical: NO
  anti-sense: NO
cacattactgatcctatatttatattatctcaaggaggaacaaccatggcacaagaattttcatatgaaatcgtagaagaaatcgctatattgtcagaaaacaacaaggggtggcgtaaagaactgaacctagtcagctggaatggtcgcccgccaaaattcgatcttcgagattgggcgccagaccatgaaaaaatggggaaaggcctgacattgacgaacgaagagtttgaacaactgcaaaaagcaatagaaaatatgtaa

SEQ ID NO: 1725 - DNA (genomic), 246 bp, Enterococcus faecium; double-stranded, circular
  misc_feature (B) LOCATION 1...246
  hypothetical: NO
  anti-sense: NO
aaaattactgaccttataaaaggtgatggagggattcttatggaaaatgaacaattgtttgaagtcggcgaaacatatgcatttaaatctgatttatttgaatcaccaataaaaggaaaaatagaaaaaatctatgaaaatagtgtgatgatacgtgtcatgaaatgcgcagtagaagacaatgataccgctcataatctgcactggcagttagttgtacgcaaatcaagtacaatagaagaataa

SEQ ID NO: 1726 - DNA (genomic), 378 bp, Enterococcus faecium; double-stranded, circular
  misc_feature (B) LOCATION 1...378
  hypothetical: NO
  anti-sense: NO
ctaaaaactgataaaaggaggccaatcattatggctaactaccgtgaccgccgagtcggtcaagaaatcttaaaagaagtcaatgatattttgcgcaaaaaggtccgtgaccctcgtgtggagaacgtaacgatcacagatgtgaaagttacgggggacttacagcaagcaacgatctattacagcattttatctgacttagcatcagataagaaaacagcacaagatggattgaataaagcatcaggattgattcgtcgagagttagggcacaatctaagtatttataagacacctgaattgttctttgaacttgatgaatcagttgtctatggcaaccatatcgatgaattgcttcgcgacttgaacaaagactaa

SEQ ID NO: 1727 - DNA (genomic), 240 bp, Enterococcus faecium; double-stranded, circular
  misc_feature (B) LOCATION 1...240
  hypothetical: NO
  anti-sense: NO
atgaaaactgaaatttggaacggacacattataagatttgtcgatattaatgatgaatggtgggcagtggcgaaagatgttgcggaagcgttaggtcttaaacaggttactagagccattcactctttgcctaaagatggggttactactactaaggtcatcgattcattgggcagaacacaagatgtaaacatcatcaacgaaaaaaaatatttaccgcatggcattcaaaagccgtaa

SEQ ID NO: 1728 - DNA (genomic), 576 bp, Enterococcus faecium; double-stranded, circular
  misc_feature (B) LOCATION 1...576
  hypothetical: NO
  anti-sense: NO
atcatgactgaaaataaagctactcaagaaagaacaccccaagaaagattgcaagaagaacaagaacacaaggaacatgttcatcatacgaaaattaatgcagcggccattgcggatcatcttttaggcaacatgcatacattacatgtgaaactgcaccaatatcactggtatgtaaaaggagccaatttctttacgttgcatgaaaaatttgaagagttgtataacgaaaatgaaaaatggttcgacaaacttgcggagcgtctaattacttctgggcataaacctgcttcgacaacggttgaatttgaaaaatattcgatgctttcggaagatgcagttaataaatacgctaaagcagaagacatggttgaaaatattatcgaggacttcagaagcactcgtgacctaactattcgcgcgattcgtttagctcaagacgagggtgacgatgctttagaagatacattgattgctttcaaaaatgacttagacaagaacatttggatgctgcaagcgttcattggtaaagaagcattagaagatgatgacgctcttgatgaggatgaagattaa

SEQ ID NO: 1729 - DNA (genomic), 963 bp, Enterococcus faecium; double-stranded, circular
  misc_feature (B) LOCATION 1...963
  hypothetical: NO
  anti-sense: NO
ctaatgactgaaacatttcaacactatacagtcatgttgaaagaaacggtagatggattgaacatcaaaccggatggcgtttatgtagactgtacactcggcggtgccggacatagtgaatatttattaagccaactaagttctaaagggcatctgtatgcgtttgaccaagatcaaaaagcaatcgatcacgccaagctgcgtttagcttcttatgtcgaacaaggtatggtcacatttatcaaagcgaacttcagagaattagaagaacgcttgagtgagcatgtagataaggtagacggcattttgtatgatctaggggtttcctctcctcagctagatgaagcagaacgtggatttagttatcatcaagatgcaccgttggatatgcgcatggatcagtcagctcctttatccgcttatcacgtaattaatgaatattcctaccatgaattagtaaagattttcttccgctatggcgaggagaaattttccaaacaaattgctcgtgaaatcgaacgagtacgaaaaacaaaaccaatccaaacaactggtgagcttgtcgaaatcattaaacaagtcatcccagctcccgcaagaagaaaaggcgggcatcctgcaaaaagaatttttcaagctgtgcggattgcagtaaatgacgaactcggtgccgaagaggcctctttagaacaggcaatccggttattgaaagtcaatggaagaatcagcgtaatcacattccattcattggaagacagaattgtcaaaagtatgtttaaagaatatagtacggtacaagatctaccaccgggacttcctgtcatacctgacgaattccaaccagaactgaaagtcattactcgtaaaccaatccttccttcagaggaagagctaacagaaaacaatcgatcacgcagtgcaaagttacgtattgcagaaaaaataagaatgaaagaggagtag

SEQ ID NO: 1730 - DNA (genomic), 1026 bp, Enterococcus faecium; double-stranded, circular
  misc_feature (B) LOCATION 1...1026
  hypothetical: NO
  anti-sense: NO
gaaagcgaccttagacaagtaacgattattaatgaagctggagaacaagaaacgatttcttatattgatctagaaagaggaaaaacggcttcttacacgatcacagcacctattccttatttcatcgattctgtccttgaaaacggaagcgctgttatcaaaaattacaaaatcacagatacgcctacagttggtctaacttattatgatcaggaaatagaagtgcgagccggcgagacgattttaacaaaaggacaagattatatagtagaagtagtaagcaacgggtttgtcgtgacgattttgacagaagaaaatggagtagccaaagtagatactttaggtagattagcagatgcacgtggaggagatttaacgatcacgtataatttgaaggtttccacagaactagaagcggatgatttccataacaacacagcggttattgaaatcggacgaaatgatgaatttgattatgaagaaggagtagagccgccagagaaagtcacaacaggtggaagaaagtttgaaaaatatgatgcatcaagcagtgaattgcttaaagatgcaagattcgaattgtggaatgaagaccgttctgaatacgcaatattttataaaggggagtcgcctttagctgtttatgaatcaggagcagatagaattgagtgggcaacaagcggacaagcaacagaatttgtcgcagatggaaatggatactttgaggttcaagggttagattatggaacctatcaaatgaaagagaccatggcgccagaaggttatgtacttccaacaggtgaggcagcctttactgaatttatcatctcttatggaagctataatgaagaaattcagatcgtaggagtagaaaatccagggccagaaagagtaccgaatatgaaacgcgggtcacttcctgctactggtgggaacgggctcttggcattcttactaatcggaataagtttgatgattggagcgtacagctggtaccgtaaatctaaaatgaagtctgaagtataa

SEQ ID NO: 1731 - DNA (genomic), 1746 bp, Enterococcus faecium; double-stranded, circular
  misc_feature (B) LOCATION 1...1746
  hypothetical: NO
  anti-sense: NO
cctttttatgacgtactggtatacttgaagaaaaaggagagcgcgatggagataaaaaaagtttacttttcacagaaaatgtcgctgtattcgcctatccagcaagcaaaacaaccccttccattttttcaaagtcatcaagaaagtagagacgctttttggcgttctgcaaaaaagcaatgtgcttttaaagcagtatcgaaaaaatataccgtctattttactattgctaaaagtagaggagatgttatttttaataatctgttgattgaaggtgaaacttttgaatggaaaaaattttttcggtatatggaagcttgcgctcgtttttttattaaagaaaactgttgttttttatttcaatctcctctatcagaagaatggttgcgtatttttcataaaaacggctatcaaggaaccacacaattaaataaaaagctggtctatcatacagcacttgttttaggtggaggaggagcacacggtgcttatcagattggtgtgtggcaggcgctgaaggaacatgatatcaactttgagattatcacaggtacctcggtaggtgcgttgaacggcgcattgattttacaaggagatatgaaaaaagctgtgaatttatggaaaaagctgtcgacaagacaagtgcttgcgttaccagaaatggctgcagttgaagaccttcgtgaacgcttctatcgagaaagacgccaaatgacgaaaacagcactaattgaaggcggggtttcttctgctccattggaaaagatggtcaaagacaatttggatttgtccttactcaaacataatcccaaaatacgtttatatacggtgtctactaaactgccagaactagcggaagtagtgactgatatccaacagacaaaaacagaagaaataccagattggatactcgcctctgcttcattttatcccgctatggcttatcgaaagatcggaaaaaataaatatgcagacggtgggtatcgcaacaaaatacctattgatattgcgattaacaaaggagcaacagaggcatttgtcgtagatgtgcaagggccaggcccagcgaaaaaaattcgtatgccagacatttttatccattggaaatgtcaaacattgtggacactaggcagctttctgctttttgatagccaaaggaaccaattaaatttacaattaggctatctggaaatgaaaaaacgattaggctattactatgggaactggtatacatttcattctgttaaacctgcaagaacatactggcgaggatttttgtcttacttaacaaaagaaattcagttagaattatcttttttcaaaagcataaaattttggcaaaaactgcgtaatttatataagaacagggtcgtaccagagacatgcggattggcgatgctagaacttttagcaaaaaaacattttttactgcccaatgaaatctatcaagtagacatgatgattcaaatgatctgccaacaagatataaaaagtatgccggatgatttattggcacaaattggtcaattaagtactgaagaatggcgaaggtatcgaaaataccagcaaaaaatacaaaatgagcgcacgaaaactgtttattttgattatctgctacaaggaaaacgcaaggatcgtttgcagcatgaattgcttaagcaaccagttgacacattactgatcctatatttatattatctcaaggaggaacaaccatggcacaagaattttcatatgaaatcgtag

SEQ ID NO: 1732 - DNA (genomic), 861 bp, Enterococcus faecium; double-stranded, circular
  misc_feature (B) LOCATION 1...861
  hypothetical: NO
  anti-sense: NO
cagtattatgaaaaatctttttataaaaatggaggaatcgatttgatggaagatcagtatgtacaagcaatgacgatcgcaggatcagatagcgatggaagcgcagggatgcaagcagatatgcatacattctttacaagaaatgtttacggtgtttctgtcatgaccgcatgtgttgcaggtaattcttacggaatcggagcaagtgtgacattgccaacagattttatcgacaaagaatttgaactgattgcgaaggactttcaaatacgtgcagctaaaacaggtatgctagcagattcaaagttgattgagacagttgtaaaaaattaccaaaaatatgattttggaccattagtcgtggatcccgtaatcgtaacgaaacatggaaatcttttactagaagaatctgctttgcaaagcttgaaagaaaagcttgtccctttggccgaagtactgacacctaatttttatgaagcagaaaagctgactggacggacattagcagctgaagaagattttgtgcaagcagcaaaagaactgcaagatatgggtgcaaaaaacgttatgatcaaaggacatcatgctaaaaatgcgcagcaagaaacagtcaatgactacgtattgttcgaatcaggaaaatcattttggttaaatgcaccattttatcctaccgaccggatcaacggaactggcgattcgctatctgcatgtattgcagctgagttagcgaaaggaaaaacagttgaacaagcgatccgattggcaaaagactatgtaaaccgtgcaattcgtgaagaaataaatgtagggcacaaatatggccccatcaatcattgggcagctggtgaattagagtaa

SEQ ID NO: 1733 - DNA (genomic), 243 bp, Enterococcus faecium; double-stranded, circular
  misc_feature (B) LOCATION 1...243
  hypothetical: NO
  anti-sense: NO
ggaggctatgactattcaatgaaatcggataaatataaaaacaggaaacatacttcctggaaaacttttcgagaaatcatcggatcttatctcgctgtagttgtatttttgcctttgctttatatggctatgacagaacaaactcgttttattggcgtagatacgcaatatatagccgaaacaggatttttattcatctttatcttgatttttgcgttctataaatccttccatacaaaataa

SEQ ID NO: 1734 - DNA (genomic), 336 bp, Enterococcus faecium; double-stranded, circular
  misc_feature (B) LOCATION 1...336
  hypothetical: NO
  anti-sense: NO
tcacaatatgaatatagaaatgggggaaaacatttggatacaaaagaagaacagctacttattgatttaacttctgcaaaaggagtacctggaaatgaagaagaggtaagagaagtattcagagaatatgccaaaccattcgctgatgatattttttatgacggtttaggcagtgtgattgccaaacatggtgctggcggaggccccaaggtctttatttctggacatatggacgaagttgtttttatggtaacaaaaataaccgaaaaaagattcttggaattccaaactcttggaagtgggtgggggcaagttcatgcttgctcagcaagttga

SEQ ID NO: 1735 - DNA (genomic), 438 bp, Enterococcus faecium; double-stranded, circular
  misc_feature (B) LOCATION 1...438
  hypothetical: NO
  anti-sense: NO
cacggatatgacattcaatttcatttctgcgatggtttatacgcagatgttcaacgtcctgtgcgacaaggcgctggaaaatggaggcgcactgaaaacccatgttacctgcctgctggacgagtttgcaaaccagaaaatccccaacttccagcacctgatttccgttatccgaagccgggaaatttccgcgcatatcgtggtgcagacgcagagccagttaaaggctgtctacaaagaccatgcggaaactatcatcggcaactgctcctgcgtcctgtttttgggcggcaaggagcgcagcaccctgaaagagatttcggaaacgctgggaaaggaaaccatcgaccttttcaatacctccgacacgcggggaagccagcgcagcatgggggtaaattaccagaaactcggaaaagaactgatgtcaaccgatga

SEQ ID NO: 1736 - DNA (genomic), 300 bp, Enterococcus faecium; double-stranded, circular
  misc_feature (B) LOCATION 1...300
  hypothetical: NO
  anti-sense: NO
atcatgtatgatgctaatagagagaaagggatggaaatattggagaatcaaatagatatacaagaacaaacaaatgaagaaacaaaggggaaaagttcagcgctagttgtagcagctacctgtatgatcgcttttatgggagtgggtctagtagacccaatcttaaaaacgattgctgcacagttaaacgctacgccagctgaaacgaccctgttatttactagttacatgttagtcactggtgtggtgatgctatttacaggtttcttatctagtcggatcggtttgaaaaaacattga

SEQ ID NO: 1737 - DNA (genomic), 258 bp, Enterococcus faecium; double-stranded, circular
  misc_feature (B) LOCATION 1...258
  hypothetical: NO
  anti-sense: NO
aaaggacatgagaaccatcaacagatggagatctcgtgtcctttttctaacggggccatttctgagagtacgtcagaaatggagaaagcgtctcgcatgagcgaaattaactttggggtatactcttgttttttggggaaagcaagaaataagctaatatatgctattaaaagagacacatttcaaagccagtatagcatagaaacttttaatgagatagttttttttacaattatgagaatttattttgttatttaa

SEQ ID NO: 1738 - DNA (genomic), 363 bp, Enterococcus faecium; double-stranded, circular
  misc_feature (B) LOCATION 1...363
  hypothetical: NO
  anti-sense: NO
atttttaatgagcatttgtcaatggtgggattgaaacgtaaagaactagcgggtcgcagatttacacgtattgtttcggtgggaggaggcgcgaaaaatcttgcatggctacaaatccaagctgatattttcgatgcaacggtctattgtttaagtgtggaggaaggacctgcattaggcgcaacaatgattgctgcactagggttagggtggttcgacacacctgaaagttgttgtcagaattttatccaatatacagatgcagcggaacctctcttacaaaatgtagaaaagtatcataaaatctatcaacaatgccggaaaatctatccagcaacgaaggaaatttgtcatgacttataa

SEQ ID NO: 1739 - DNA (genomic), 735 bp, Enterococcus faecium; double-stranded, circular
  misc_feature (B) LOCATION 1...735
  hypothetical: NO
  anti-sense: NO
aaaaataatgaggtattttatatgaaaaagttaggttttattttattgttggtctctttattccttgtaggatgtacgtctcctagtaaagaaaatagtgatccatctgcgaccacagacaaaagttcaatcagacaaaccagttcagctgaaaaatcaagtactcagaaatcagcttctactgaaacgaatacatcttcaacaagcagtaaagtctcagagcccaatacttcttctacatctagtagtacagttgagacaaatatttcttcttcaacaatagacacaacctcctcacagtcttctcagtcaatagatccgttagcaggatattctgatctacaaattgagtacgcacgtgtttggctagctattagaggtaatacttttagagatacatcgggtgatttcgaattacatgttattcattatcctgcaggaacacctatcgccccttatgatgcagggagtgcagtctatccgaaagatgtggttatgctcactgggaaatacagttaccagggagttttagtgtattcaagtaaccatgacgggacaatcactagttatccagttccttcacattggcaaatgcctgcagatcaaacatcttatccagcgttcattagagaaacaactcaagaaatcattgataatgcatctgtagtagctattcctacaggaaatcccaatgacgtgaaacagttaatcgatgtgacagttatagataattag

SEQ ID NO: 1740 - DNA (genomic), 345 bp, Enterococcus faecium; double-stranded, circular
  misc_feature (B) LOCATION 1...345
  hypothetical: NO
  anti-sense: NO
atggataatgatcgatcagctaaagcaacggcaaaaacagttcgcacttcacctcgaaaagcccgtttagtaattgaccttatcagaggtaaaagtgtcgcagatgcaatttcaatcttgaaattcacaccaaacaaatctgctggaatcattgaaaaagtattgatgtcagcagttgcgaatgcagaaaataactttgacttagatgttgaaaacttggtagtaagcgaagcttttgttaacgaaggacctacaatgaaacgtttccgtcctcgtgcaaaaggatcagcttctccaatcaacaaacgtacaagtcatatcacggtagtcgtatcagaaaaataa

SEQ ID NO: 1741 - DNA (genomic), 324 bp, Enterococcus faecium; double-stranded, circular
  misc_feature (B) LOCATION 1...324
  hypothetical: NO
  anti-sense: NO
aattgtaatgaataccaaatggacacagaaagggcgtctatttatctacgaattactaaaaaaagaaggatattaccctcaaatggatttagaggaaattggttagaaaggagttttagtatgactgacattgcagaaatcactcaacgagatagagaaaaaatcaaagaatatgtcgaaagttcaaagttcttaacttacaccatgcttgctgaaagatttggaattagcaaaagctacttatctttaattttaaacggtaaaaagacttctgcagaagcaaacagaattatagattcgattatcactatgtacgaattgtaa

SEQ ID NO: 1742 - DNA (genomic), 324 bp, Enterococcus faecium; double-stranded, circular
  misc_feature (B) LOCATION 1...324
  hypothetical: NO
  anti-sense: NO
agttgtaatgaataccaaatggacacagaaagggcgagtgtttatttacaacttattaatcgcagagggctattaccctcaaatggatttagaggaaattggttagaaaggagttttagtatgactgacattgcagaaatcactcaacgagatagagaaaaaatcaaagaatatgtcgaaagttcgaagttcttaacttacaccatgcttgctgaaagatttggaattagtaaaagctatttatctttaattttaaacggtaaaaagacttctgcagaagcaaacagaattatagattcgattatcactatgtacgaattgtag

SEQ ID NO: 1743 - DNA (genomic), 741 bp, Enterococcus faecium; double-stranded, circular
  misc_feature (B) LOCATION 1...741
  hypothetical: NO
  anti-sense: NO
aggagtaatgatatgattcccatttatatttgtgaagacgatccaaaacaattagaagttttatcaacggtgatcaaaaatagaatcatgattgaaaacttagacagttatgtccatatttctacctctgatccggaagaacttctcaatgcagccaagatcagaacttcttcttttggtatttactttttagatatcgaactagaagacagtgaaatggatggtgtagcgatcggtaaattgatccgtgaattagatcctttaggaaaaataatctatgtgacttcccatacggaaatgtcgatgaaaatcttaaaaagcaacatcgaaccgactgattatatcgtcaaagaagatctttatgatttaaaagaaaatgtcgagcatatcctgagcaaaattttcgaagattttcaaatgtcccaaatccaaaaagatatcttcaaaatagagtttaatgatgagatcaaatttttaccgatcaaagacatccaatatttttctacttcgctaggagcgccacataaactggaagtccatttgactcatgcccaattacaattctatgagaagatcaaagaaatcgagaaaatgcatcggaattttatccgttgtcataaatcctatgttatcaatacacaaaatgtgcggtcgattaataaaaaaaccagagaagtcacgttggcaaacggcgagaccatcccagcctctatccgtggattaaagaaattgatttcataa

SEQ ID NO: 1744 - DNA (genomic), 900 bp, Enterococcus faecium; double-stranded, circular
  misc_feature (B) LOCATION 1...900
  hypothetical: NO
  anti-sense: NO
ataatcaatgatagaattggagggaaaagaatgaagcagaaagatttattcaaaaacgggcatgcttttttaatcttgccagtcattttgatatcaatcatggtttttattccgatggttttggctttgatcacgtcttttcaaagtggtccccctgtcaatatgacatttaacgggttaggtaattatcagcggatgttgacagatgcaacttttaaaaaagctttttttaatacattcctgtatttacttgtacaagtaccgatcatgttgtttctagcactttttatttccaaccttttaaatgataaaaagttgaaatataaagggttgtttcgaaccgctatctttcttccatgtatcacttcgatggtcagttattctctgatcatgaaaagtctattttctcaatctggccttgtaaacaacttgttgttgggcattggtatgattgacacaccgattggctggttgactcatccaatttgggcgagagttctgatcattctttcgatcacttggcgttggactggatacaatatgatttttttcctttcaggcatgcaaaatattgattcggagatttatgaagcagcatctattgacggtgcttctaaatggcagcagtttatcaaagtgacgatcccaaatttaaaaccaatcattttgtttacttccattacttcgacgatcgggacattgcagctttttgatgaagtacaaaatattactggcgggggaccagcaaatgcaacgaccaccctatctcaatacatctataatttgagttataaattcacgcctaattttggatatgcggcagcagtttcctttgttattgtttcctttattgtgatattgtcgataatccaaacgaaagtaggaggagaaagtcgatga

SEQ ID NO: 1745 - DNA (genomic), 627 bp, Enterococcus faecium; double-stranded, circular
  misc_feature (B) LOCATION 1...627
  hypothetical: NO
  anti-sense: NO
accttaaatgaaagaagtttttttatgagaaatccaaaaccaaaagaatggttagcaaaagactacagccaaaactatattgctgactacaaaccgtttaattttgtcgatggtgaaggtgtccgcaacagtctttacgttagtggctgcttatttgcctgcgaaggctgcttcaacaaagctgcacaaaatttccgatatggcaaaccattcacacctgaattagaagaacaaatcatcgctgacttgcgcaacgattacgtgcaaggtttaactttacttggtggcgaaccttttttgaatacagatgtttgtctgcaagtcgtacgacgtatccgaaaagagttcggtacgacaaaagatatctggtcatggacaggctatacctttgatgaattgctacaagattcagaagataaattagaactcctttcgcaaatcgatatccttgttgacggacgctttgaattaagcaaacgtgacctaaaactacaatttcgcggaagtagcaaccagcggatcattgacgtccaaaaatctttagaatccaatcaagttgtgatttgggaaaaatgtacggatgcaacagaaacctatgaacaaatcaaaaagcaagacttgatataa

SEQ ID NO: 1746 - DNA (genomic), 1125 bp, Enterococcus faecium; double-stranded, circular
  misc_feature (B) LOCATION 1...1125
  hypothetical: NO
  anti-sense: NO
ctaataaatgattgtcgaaacggaggaaaaacgatgcaaaaacgtgtcattactttgctgatgatcattgtcggcgcaagcttgggtatttcatttttaccctcagcttggcaggcaatcggtcaacagtcaaacggatggctgaataatacatttaccaacagcctgttaggcgcacttattttctttttattatctttgctgttggccaaacatatctcagctattatcaaacaagtagaacaaaaactaagtgaggtcagcttgacttatcttctcttcggtgcgatcggtgcgatcatcggattgactttaggtgttgtgatctcgacccctctttacaatatggaaattccattcgtcaatagtgtattgccgattttactgatgatcatcttaggctatctgggattgagaatgggaacgacacgaatcgaagaatggaagaaagtttttggttcacggacccaaaaaatcgagcaagaaacaggtagtcaagttgagagtcaactgttagaacgaaaatcaggagaaaatttccatagaaataaattcttggatacaagcgtgatcattgacggtcggatttatgatataacaaagactggattcttagaaggaacctggatgatccctgattttgttctttacgaagtacgatacatcgcggactcaggggatagtttgaaacgtgtgcgtggtcgtcgcggattagatatcctagatgccttgcaaaaagaagagggtatatctgtcgaaatgtacgatggagactttgaagatatcagtgaagtagacagcaaattgatcaaattggctaagcttttagatggtgtcattgtaaccaatgactataacttgaataaagtctctgaattccaaaatgtacctgttcttaatatcaatgcgttggcaaatgccgtaaaaccagtagtcatccctggtgaaacgatgaatgttgtagtagtaaaagccgggacagaacgccaacaaggagtagcctaccttgatgacggcacgatggttgtcgtagaagatggacagcattacatgaatgaacgtatcgaagtcgttgtaacaagtgcccttcaaacagctgctggacgcatgatctttgctaaacct

SEQ ID NO: 1747 - DNA (genomic), 633 bp, Enterococcus faecium; double-stranded, circular
  misc_feature (B) LOCATION 1...633
  hypothetical: NO
  anti-sense: NO
gaaataaatgagatgaaaaagtatttcattcttctggctggtagtcctggtacaggaaaaacatatcttatgaataaactacgggaacgatttccagatatgtatgccatcacgctcgatgaaatcaaggaatactatgcagaatccatcgggtttaacaatttggaagaacgggcggaacaagaaaggacgaaagtttatcctttctattacaaagcacttgatttgtatatggaagcaggaaagaaagtgattgtgtccgagtatccttttagtgataagcaaaaagcacgactccaagaattagcagatagatacggatatcaggtgatcacgattcgcctaacagcagactttgaagtgttatggcaacgtcggtacaaacgtgatcgtgaatcagatcgtcatttgagctatatcatggatcattatcactatggtgacgtattggaagatcgaacgaaagggaccaatcatattacgaaagaagcattcaaaaagatcatcgccgaccgaaaatatgacaaattccagttaggaacactatatgaatttgatgtaacagactatactcaagtggattacactccactattggataaattagaaaaagaaatcaatgacaataagtaa

SEQ ID NO: 1748 - DNA (genomic), 279 bp, Enterococcus faecium; double-stranded, circular
  misc_feature (B) LOCATION 1...279
  hypothetical: NO
  anti-sense: NO
gcttcaaatgaggtgaactgtatacaacgagttattttggccccggacgagccccttatgagtatgggtagggaagaaaaaatattgaggaaggatgtttattttcgggggggattctccgaagcaattcctgggggtttccaagataaaaaatttgttggggggcgggactgggttgggtattcccatccaagagggtgggaacaggtttacaagggtggaggattgagaaaaatttctatttgtgggcggaagaaagccaaaaaatacttttgttag

SEQ ID NO: 1749 - DNA (genomic), 981 bp, Enterococcus faecium; double-stranded, circular
  misc_feature (B) LOCATION 1...981
  hypothetical: NO
  anti-sense: NO
ttctcaaatgaatataatagaaagaaaaaggaggaagaatcaatgaaaatagcaattgcaggcgctggcgcaatgggaagtcgctttgggttaatgcttcaccaaagtgggaacgaagtattattaatcgatggctgggcagaacatgtccaacaaatcaaagagcatggattacaagcaaattttaatggtaaagaggtagaagcaaaactaccaatcgttcttcaatccgaagtagaaaaagaagatcaagttgatctgattattctatttaccaaagcgatgcagctggaaaaaatgctgcaggatatccaatcattaatcaaaaaagatacagaggtcttatgtctattaaatggtatcgggcatgaagatattattgagaaatttgtaccaatggaaaatatctatattggaaataccatgtggacggcaggtcttgaaggtcctggtcaggtcaaattatttggaagtggttcagtagaattacaaaatttaggtgatggaaaagaagcagctgcaaaaaaattagcagacaaattgtctgaatcaggattaaatgctcatttttctgacaatattcactattctatttatcgcaaagcatgtgtgaacggaacaatgaacggactatgcacaatcttagacgttaatatggctgagctaggaaaaacatcgactgctcataaaatggtggcgacgattgtcaatgagtttgccaaagtagcagcagtagagaagattgaactagatgtcccagaagtcattgcacattgtgaatcttgttttgacccggaaacaattgggttacattatccttcaatgtatcaagacttgattaagaaccatcgattaacagaaatcgattatatcaatggcgcaatttctagaaaagggaagaaatatggtgttgcgacgccttattgtgatttcttgactgagcttgtccatgcaaaagaagatagtttgaacgtaaaataa

SEQ ID NO: 1750 - DNA (genomic), 744 bp, Enterococcus faecium; double-stranded, circular
  misc_feature (B) LOCATION 1...744
  hypothetical: NO
  anti-sense: NO
ttcaaaaatgagaactttaccagcagggttagctttatttacagggcagaacatttctttttatggacctgtaatggctggaacggttatttcaatgctgccattactagtggtttatatttttgcacagaaatattttgttcaaggaacagctatgtctggaatgaaagagtgaggaagatgaaaatagttgagactaaactttatggacagttgattgtggtttctgattacatcttattaggtattctctgggtaatcgtgtgtttgcctgttattactatcgtgcctgctacatgtgctgttttttatgtaatggcgcaatggaaaggtgagggatcaggaaatatcatttattttttctttcaaggaataaagcaacattttggtaagaacttgttccttagtctgttaacgatcattatttattttcttgttaatcaattattagaagaacagacaatcgtactttcaattagtggatatgtagttttacttatttattccatgtttcttttatcctggatatatgtgatttctgaaaacaaagatatcacatttttacaaatttttgaacaaagtgcatggaaagtattttttgattttttgagaaatattctttgttgcgtattgttattaggatttgtactgctcatatttcttttccctccttttatttttatctttgctggtggcgtatggaaacttgtatctattatcttgactataggaaatgaaaggtag

SEQ ID NO: 1751 - DNA (genomic), 1218 bp, Enterococcus faecium; double-stranded, circular
  misc_feature (B) LOCATION 1...1218
  hypothetical: NO
  anti-sense: NO
agaatgaatgataaaaactttatagaagaattaagacaaaagcgtgaagaatatggagtaacacaaagaaaacttgctgttgcctgtggtatcagtcgtacatattttaaccagatagagaatgggactgttgttccctctgctgaactaaaacaaacgatagaaaaacagattgagcgtttcaatccgcaagaaccactatttctgttgattgattacttccgtgtccgctttcctacgacagacgcattaaagattattcgtgaagtattacaactaaaagccgattatatgctttatgaagattttggaaaatacggatatgaaagcaaatatgttttaggcgacatcaacatcatgtgttccatgcaagagcatttaggtgttttattagaactaaaaggcagagggtgtcggcaaatggaaagttatctattggcacaggaacgctcatggtatgactttatgctggattgtttaacggcaggtggtaagatgaaacgacttgacttggcaatcaatgataaagcaggaatattagatattccaaagttaaaggaaaaatacaaggctggcgaatgtatctcctactttcgtatgcagaaagattacagcggtacggaaaaatgtggtagcgatttaccaaagaatacaggagaaaccttatatctcggttcaaccagtagtgagttatatatgtgtgcctatcagaaaaattacgagcagtatgtcaaaaatggcatagaagttgaagatacagaaatcaagaaccgttttgaaatacgcatgaagaatgaacgagcctattatgcggttgtagatttactgacctatcgggacgctgaacgcaccgctttttctatcatcaatcattatgtccgctttgttgatagagaagatgataaaccgaaaagtcaatggaaaacaaatgatgattgggcatggtttataggggaaaatagagagccgatacgattaacgactaaaccagaaccttatactttacaaaaggcattacattggttacaaagacaggttgcaccaaccataaaaatggtacaagcattagacagagaaaatcatacaacgatactgaaagatatgattgagcaggcagaactcaaagataagcataaacacttattacaattagaaaaatcaaccatagaagaacgcatagataccgctgtcccacaagagaatgacggtattttttaa

SEQ ID NO: 1752 - DNA (genomic), 201 bp, Enterococcus faecium; double-stranded, circular
  misc_feature (B) LOCATION 1...201
  hypothetical: NO
  anti-sense: NO
cttgctgatgaaggagggatttcattaggaatgtccacaaataaaatagcacagcttagcttattgtctgctgcttgtgtagcaggtaggatcgcttttcaatttattccgaatttccagccaatgactgctatttttttatttatagtactttacttaagcttaaaagatgccttaattgtcattcttacaccactaggt

SEQ ID NO: 1753 - DNA (genomic), 360 bp, Enterococcus faecium; double-stranded, circular
  misc_feature (B) LOCATION 1...360
  hypothetical: NO
  anti-sense: NO
accagtgatgaaaaaagacatttttcttatcaattgatgatccgacagcctgactttgttacagaagcgatagcacaagaagccattcagcgttctagcaaacttccggaagaattgaaagaacaagtagtattcaaaaagatggaagaaagtctttgtgcccaaatcttacacgtcgggccctatgccgaagaaacagcaacgtttgagaaattagaagcattcatcgcaaaagaaagctatganagagcttctaaagaacacaaagagaattacatcagcgatccaagaagatcagcacctgaaaaaatgaagacgattttgcgtgttaaaataaaacaacgtgagcaacctgaatga

SEQ ID NO: 1754 - DNA (genomic), 645 bp, Enterococcus faecium; double-stranded, circular
  misc_feature (B) LOCATION 1...645
  hypothetical: NO
  anti-sense: NO
ctaggtgatgaaatgaagcgaaaacgattatctattatccgtattcttttttacatgatcattctgacggttattggtgcggtgttgtttttaggaggaagaacttatcgttcggtaaaacgagtggaaagctatcaaatagaaataacaacagctgcaaaaaattatcatatggaaaactacgagaatttgatcaaggcgataatattgaccgaatcaaaaggaaaagggacagatctcatgcagagctcggaaagtctgcatggagaagctgagatcattgataatccagctgacagtattgatcaaggtgtcaaatatttggcggaaatgatagtagaagcaaagaaacaaggatgcgatttatggacagctgtccaagcatataattttgggaaagattatattgcctatgtaaaaaatcatggcggagaaaacacagtagaattagcagaagcgtattctaaagatgtgctgagcccacttttaggaaatgaggaagggaaacaataccgatattggcggatccagtccttgctttacaatggcggctatctctatcataatggaggtaacatgttttatcctgatattgtcaaaatgaatgaaaaaataatagagacctatgaaaaagtctttaagtaa

SEQ ID NO: 1755 - DNA (genomic), 270 bp, Enterococcus faecium; double-stranded, circular
  misc_feature (B) LOCATION 1...270
  hypothetical: NO
  anti-sense: NO
aaaaaagatgaaggcaacgaccatatcaataatatgagtgatgagaaaggtttctttgctatggctatgttaatcatgcttataactatctataaaatatatatgaatttgccgtttggagatactggtgcaatcccattatcttttttatcttttcatagctttaatcgttataagcaaacgaaagaaaaagataccttggtatatggtattgttactggttttattggaattgcgttcttagtttggtatgtgatcgaaacaatatga

SEQ ID NO: 1756 - DNA (genomic), 1221 bp, Enterococcus faecium; double-stranded, circular
  misc_feature (B) LOCATION 1...1221
  hypothetical: NO
  anti-sense: NO
tggaaggatgataaacaaatggtagttggagattttgctgtagaattagatacagttgtaattggtgcgggacctggtggctatgtagctgccatccgcgctgctgaaatgggacaaaaagtagcaatcattgaaagagagtatattggcggtgtttgtttgaatgtcggctgtattccttcaaaagcactgatagctgcaggacaccattatcaagagtcactagattctgaaatgtttggagtaactagtgaaaacgtcaaactagattttgcaaaaacacaagaatggaaagaaaacaaagttgtccatacgttgacttctggtgttggtttcctattaaaaaaacataaggttgaaacaatcgaaggagaagcgttcttcgtagatgatcacacactacgcgtcattcatccagattcagctcaaacttattcgttcaataacgcaatcatcgcaacaggttcccgtccaatcgagattccaggatttaaattcggaggacgtgtgttagattctactggcggattagcattgaaagaagtacctaagaaatttgtgatcatcggtggcggtgtgattggtgccgaattgggcggagcgtacgcaaacttaggagcagaagtaacgattcttgaaggctcaccacaaattttaccaacttacgaaaaagatctagtaaaattagtagaagatgatttcaagaaaaaaggcgtaacagtcgtaacgaatgcaatggcgaaagaagcagtcgataacggtgacagcgtgacagtgaaatatgcagtggacgggaaagaagaatccgttactgctgattatgtgatggtcactgtaggtcgtcgtccgaatacagatgatatgggcttagaacaagcgggtgtcgaagtaggagaacgaggattgatcacggtggataaacaaggacgtacgaacgtacctaacatctatgccatcggtgatatcgttccaggggcggcattagcacacaaagccagttatgaagcaaaaatcgctgctgaagcaatctctggcaaaaaagtagctgtagattataaagcaatgccggcagtagccttcactgatcctgaattggcttctgtaggtatgacgatcaaagaagcaaaagatgctggtatcgaagcaaaagcatataaattcccattttcagggaacggtcgggcattatcgcttggtaaaacagaaggatcatccgtctag

SEQ ID NO: 1757 - DNA (genomic), 465 bp, Enterococcus faecium; double-stranded, circular
  misc_feature (B) LOCATION 1...465
  hypothetical: NO
  anti-sense: NO
aggtgggatgaaatggctgaaatccttcgagacatcggaatgattgcccgagcgctagattctattagcaatatcgaattcaaagaagtcgatttaacaagaggacagtatctttatttagtacgtatttgcgaaaatcctggaatcatccaagaaaaactagcagaaatgatcaaagtagatcgtacaacgactgcccgagcaatcaagaaattagaatccaatgggatgatcgaacgtttggaagataaagaaaataaaaaaatcaagaaactctatccgactaaaaaaggagcagaaatctatcctttcatcattcgagaaaacaactactccaatgcagtcgcattaaatggtctttctgacgaagaagcaaaacaattggaatatcttttaaataaagtatgcaagaatgttagcgaagattggaattttgtcaaaaaaggcaataaaaggatctattga

SEQ ID NO: 1758 - DNA (genomic), 198 bp, Enterococcus faecium; double-stranded, circular
  misc_feature (B) LOCATION 1...198
  hypothetical: NO
  anti-sense: NO
agagactgtgacaaaagtcgtgtcacagtcctttttttccgaataaacgatgttctcctgtcaactcctcggtcacaagtcaaaatattcaacaaacatgagaagctgttttttgaaattgttccttgtgactcggagatgaacggcaggctcacgacctcttggaaaacggtgttcaaaagcttgcatctgcggtaa

SEQ ID NO: 1759 - DNA (genomic), 195 bp, Enterococcus faecium; double-stranded, circular
  misc_feature (B) LOCATION 1...195
  hypothetical: NO
  anti-sense: NO
aggagctgtgactttgttgcggctctttttatttttatagagaatattgtttctttcagtagtttaacccaggataaaaagtatgatagaataaagaagcaatttttagcagaaaagaggcattttaatgacggaaaatttgaaccagacgatcattcagcttgtacaaaaagaactttcagactatcgtcctaa

SEQ ID NO: 1760 - DNA (genomic), 753 bp, Enterococcus faecium; double-stranded, circular
  misc_feature (B) LOCATION 1...753
  hypothetical: NO
  anti-sense: NO
aaaggatgtgaaaaaatgactgattgtatacattctataatcgatggatttcctgattatttgcataaattggctttagctgaaagaccaaccataccttctccaaaaagacagagagttgaaacttctgttttaggtaggttaggtggcttagtacaagattactcgtttgaagatatgtcgtttacattgcactataactatttagaggatgtggaagaccatcaagcgttcaagcaatcgttttatatcatgcgtcattggttaaactatgcaaagaaattagaattctctgacgatcccaacgtctattacgttatccagactatcgatattggggatgcagaaaacgatattgttgaatggggagagttcgatgtaaatattactgcgaaaccattcgcaagagttcaagaagatgtacctataaccgtagataaaccacagtcatttaacttgctgaataatagtttagaagaaagttttccaaagattatcatcactccttcagctacttcatgccagttcatcttaaatgattatgtgtttagtttcgaaggcttagtagcaggaactgatgtagtcattgatagtgatttgatgctttgctacgaagagcaatcggacggagatattttagatcggtccaacaaaatgaagaccatgcaatatccgacattgcaagtggatatcaatcattttaattgcactggtttgagcaaaatacaaatttatcgtaacgggttaaggtag

SEQ ID NO: 1761 - DNA (genomic), 270 bp, Enterococcus faecium; double-stranded, circular
  misc_feature (B) LOCATION 1...270
  hypothetical: NO
  anti-sense: NO
aaggagtgtgataacatgggaaaagaactaaaggttagaaagatcggcaatagcgtgggagtgatccttccaagctctcttggattaaaaagcggagacactatccaagccaaacaagaaggcaacttattcatattagatactactcaaatagcaaaagaacacgatcgcaaattgattgaagaaagtttccaagactttgagaaaggtttaacagtttcagaaattgaaatggtaaaagctttcggaaaatacggctggagtgaatag

SEQ ID NO: 1762 - DNA (genomic), 330 bp, Enterococcus faecium; double-stranded, circular
  misc_feature (B) LOCATION 1...330
  hypothetical: NO
  anti-sense: NO
tatactagtgatagaattttttcaggaggggatttagtgagtatcacagtgaatattttgtatacaagtacaaatggacaagccagaaaatttgcagaagaaatggtcgaaagaaacattgtcaaagcgattcgtgcagaagaaggaaacgagaaatatgactattactttccactagaagatccagaatctcttttactgatcgaccgttggaaagatgaagaagcaatcgaaaagcatcacaaatccgaaatgatggctcaaataaacgaactccgtaaaaagtataaattaaaaatgaaagtcgaacgtttcactgatttaccgtaa

SEQ ID NO: 1763 - DNA (genomic), 300 bp, Enterococcus faecium; double-stranded, circular
  misc_feature (B) LOCATION 1...300
  hypothetical: NO
  anti-sense: NO
ttgttcagtgaatatttggaatatagatttcctgcttcaactgtatcatcaactagccctgtcgcctcggctaccgtaccaactaaactcaatagaactatcagagtgagtatgctaataaaaacgattcccacaatccgaaaaagtttctttttcatcccctcactccattctctcttgaacaggtggacgggtatcaaaggcatggaagagttcttcaaagactggatgtacctgaaccacgcctacccgaccatacaaatcctgcatcaagcattggccattttccaaatctcgtag

SEQ ID NO: 1764 - DNA (genomic), 852 bp, Enterococcus faecium; double-stranded, circular
  misc_feature (B) LOCATION 1...852
  hypothetical: NO
  anti-sense: NO
tcatccagtgaactttcttatcgatatgtggagcgtccgctagcacgttttgattatggtcgtacattccaagtgatgaaaggatggttcagcaaaccgatcatcagtaagagcaaaccatgggttgttccaggcacattacttgtagcaattgcactcgttggtttcgttacggcaccgaaaaacgctgtaacagccgatcaaaaacaactgcaggcaaaaatcgctgaaagtaaaaaattagcagaagaaaccagaaacaattcagaaaacaccactagttcggttgaccaagcgatccttgataagtacgagttgtccaaggcacaagggaataaggcacaaaaattagaactaacggcatttggtgattcagttatgttggatgctgcaacggatctacaagaactttatccaaaagtagtggtagatggagatgtcggacgacaattatatgccagtgtaccgtacattgaaaaattaaaggaacaagatttgttgaaagacactgttctgatcggactaggaacgaatggctcattctcggaagctcagtttgatagtgtgatggatgcaatcggtgatcgaaaagtatactgggtcaatgtccgagtaccgacgaagcgctggcaaaatgacgtgaatgcgatgcttgaacagatgacgaaaaaatacgacaatatgacgctgattgattggtacagctacagtaatgaccatagtgactggttttatgatgatcaagtccatccaaatcctgaagggatgacacattacattcacttagtcagcgaagccttgctaggaggaagttcaagtacgaacagcagtgagacaaacgtgacagaatga

SEQ ID NO: 1765 - DNA (genomic), 717 bp, Enterococcus faecium; double-stranded, circular
  misc_feature (B) LOCATION 1...717
  hypothetical: NO
  anti-sense: NO
atgaacagtgatatgactcaaatcatgggggagtttattgggacactgatcctagttttgcttggagatggtgtgtgtgcggctgtgaatttaaacaaaagtaaagcacaggcttctggctggattgtcatcgcatttggttggggactcgctgtaacaatggctgtctatatttctggattcatgggcccagctcatttgaatcctgcagtctctctagctatggcgatgacaggggcaattagttggaatcttgtcgttcctttcatcattgcgcaagttttaggagcttttgcaggggccattcttgtttggctttcttatttgccacattggaatgcaacgaaagatgaaagcgcgattttaggaacgtttgcaacaggtcctgctatacggaattatccagcaaatgtgatcacagaattaattggtacatttgtattagttcttgggttgctagcttttggacaaaacgaatttgcacctggaacgaacgtattcgctgtaggtggattgatcttagccatcggtctttcattaggagggccaacaggatatgcaatcaaccctgctcgggactttggtcctcgattagcacatgcggtattgccaatagctaataaaggaacttcagattgggcatattcatgggtaccaatcgcaggtccaatgatcggagcaattatcgcggtaggtgtctattcattaatggtgtaa

SEQ ID NO: 1766 - DNA (genomic), 723 bp, Enterococcus faecium; double-stranded, circular
  misc_feature (B) LOCATION 1...723
  hypothetical: NO
  anti-sense: NO
atgttaagtgatgctcattgtcatttagatgggagtcagagtttagcactccttcagcaggaacacacgattttgacgatcatcaattgtgattcgccagaagaatggaaggaaaacagacagcttgcagcaagtaagactcaagccttaagttacggtatccatccttggaaagcagatagctatacgtttgaacaagttgagccttttttgaaaaaagcaaggatcatcggtgaaatagggttagataatatttggacgaatgtaccgatgactacacaaaaaaaagtatttgagcgacagcttgcttttgcagccataaatgagaaacctgttgtactgcacacaaaaggatgcgaaaaagagatcttaaattatatccaagcttaccctaatcactatttgatccattggtattcttctttggactatcaacaagactatattgatttaggctgttatttcagcattggtcttgatttgaaaaagaatccagcagtctggcaactagctaaagcagtcccaatcgaccacttacttattgaaacggatggactacatgcagcagagtgggctttaggggggattttttcagaaaaagattatgtctcactgcttgaagaacagttaaagacaatcgctgagatcaaagagctatcagttgaagaagttaaaaaaaatacttatcaaaacttggaacgtttcattagattaggtaaataa

SEQ ID NO: 1767 - DNA (genomic), 1047 bp, Enterococcus faecium; double-stranded, circular
  misc_feature (B) LOCATION 1...1047
  hypothetical: NO
  anti-sense: NO
aaagtgagtgacgatatgttcacaacagaagattttgatttagacttgccggaagaattaatcgcacaaacaccattaaaagaccgcgatcattctcgtttacttgttttggatcggaaaactggagagatggaagataaacatttccatgaaatcattgaagagttacagcctggtgatgcgctagttatgaataatacacgagttctgcctgctcgtttatatggagaaaaaccagatactggtgcgcatttagaagtccttcttctaacgaatacacaaggagatacgtgggagacattgatcaaacctgcgaaacgtgccaaagttgggacaagaatctcttttggtgatggcagattgcaagcagtagtgaaagaagaattggaacacggcggacggatcattgactttgagtatgaaggaatttttctagagattcttgaatcattgggagaaatgccattgcctccatatatcaaagaacgtctggaagacccagatcgctatcaaactgtctatgcgaaagaaaatggttctgctgcagcgccaacagctggattgcattttacgaaagaattacttgatgagatcgaagcaaagggtgttgaattagtctatctgacactacatgtagggttaggtacattccgacctgtcagcgtagataaaattgaagaacaccatatgcatagtgaattctaccgtttgacggaagaagcggctgagcgattgaaccaagtacgtaaaaatggcgggaaaatcgtggctgtcggaacaacttcaattcgaacattagaaacgattggaacgaaatttaatggagaaatcaaagcagacagcggatggactgatattttcattacgcctggctatgaattcaaagtggtagaagctttctcaactaatttccatttgccaaaatcgactttagtcatgttagttagtgcctttgcaggaagagaattgactttatctgcttaccagcatgcgattgaagagcgctatcgtttctttagttttggagatgcgatgttcgtgaaataa

SEQ ID NO: 1768 - DNA (genomic), 744 bp, Enterococcus faecium; double-stranded, circular
  misc_feature (B) LOCATION 1...744
  hypothetical: NO
  anti-sense: NO
atgacgagtgatacgctagatctgacgactcggcagcgtgacacgactgactatagggcgaataattcggatccgtttattgtgcttaacgatgccgatctggaactggcggtgaaagcggcggtagccggacgttatcagaataccggacaggtatgtgcagcggcaaaacgctttattatcgaagagggaattgcttcggcatttaccgaacgttttgtggcagctgcggcagccttgaaaatgggcgatccccgtgacgaagagaacgctctcggaccaatggctcgttttgatttacgtgatgagctgcatcatcaggtggagaaaaccctggcgcagggtgcgcgtttgttactgggcggggaaaagatggctggggcaggtaactactatccgccaacggttctggcgaatgttaccccagaaatgaccgcgtttcgggaagaaatgtttggccccgttgcggcaatcaccattgcgaaagatgcagaacatgcactggaactggctaatgatagtgagttcggcctttcagcgaccatttttaccactgacgaaacacaggccagacagatggcggcacgtctggaatgcggtggggtgtttatcaatggttattgtgccagcgacgcgcgagtggcctttggtggcgtgaaaaagagtggctttggtcgtgagctttcccatttcggcttacacgaattctgtaatatccagacggtgtggaaagaccggatctga

SEQ ID NO: 1769 - DNA (genomic), 1041 bp, Enterococcus faecium; double-stranded, circular
  misc_feature (B) LOCATION 1...1041
  hypothetical: NO
  anti-sense: NO
tgtaggagtgatcaaagcatgttcaaagataaaattttattaatcacaggcggcactggttcttttgggaacgcagtgatgaaacgttttttagattcagatatcaaagaaatacgtatcttttctcgtgacgagaaaaaacaagatgatatgcggaaaaaatacaacaatgacaaattgaaattttacattggagatgttcgggacatcaacagtgtcaaaaatgcgatgtatggcgttgattatgtcttccatgcagcagcacttaaacaagtaccttcttgcgagtttttcccaatggaagctgtgaaaacaaatatcataggaacagataatgtcgtaactgcagcaatcgaaatggggattcaaaaagttatttgcttgtccactgataaagctgcgtatccaatcaatgctatggggatttctaaggctatgatggaaaaagtatttgttgctaaagcaagaaccgttactgacgaacgcacgatgatttgtggcacacgttatggaaatgtaatggcttctagaggatcagttattccattattcattgaccaaataaaaagtggtaaaccattaacagtgacagatcctggcatgacaagatttttgatgagtttggaagaagctgtagagttggttgtttttgccttccaaaacgcaaaagcaggggatatcatggtacaaaaatcaccagcttctactgttggtgacctagcacaagcaatcaaagaattattccatgcagacaatgagattcatattatcggaacacggcatggcgaaaagcgttatgaaacactattgacaaaagaagaatacttagttgctcaagatatgggtgatttctatcgtgtccctgcagacacacgtgatttgaattatgataagtatttcgttgaaggaagcaaagagctgacacaagaaggagaatacaattcagataatacacaacgattatctgtagaacaaatcaaagaaagacttcttgaactggaatatgtaagaaaagaattgaaagagtggcaaaatcaatga

SEQ ID NO: 1770 - DNA (genomic), 915 bp, Enterococcus faecium; double-stranded, circular
  misc_feature (B) LOCATION 1...915
  hypothetical: NO
  anti-sense: NO
agaaggagtgaagaaatgttagaagtcaaggatcttgttaaaacttttgggaactacacagctgtcgatcatgtctctttccaaatccccgatggaaaaatcatggggctaattggccaaaacggggctgggaagacaacgacttttcgtttgatcttggattttttgacacaagaccaaggagaagtgttatggaatggccatcatcttggggagaaagattatgatgtcatcggttatcttccggaggaacggggactttatccgaaagtaacgattcaagaccaactgctttattttgcagaacttagagggaaatcaagaaaagagattgaaccaaaaatcgatttttggatggaaaaatttcaggtaaaagggaaaaagacggataaagtaaaatctttgtctaaaggaaatcagcaaaaagtccagctgatcgccacgttaatccatgaacctaaattgatcattttggatgagccattcagcgggttagatccggtaaatgctgaattgctaaaagatggaatattggaattgaaaaaacatggttcatgtgtcattttttctagccacaatatggataatgtagaaaaaatctgcgatcatttgatcatgttgcgaaacggaaaaatggttttgaatggaaaagtacatgagattcgtgaatcatttggccgtacgaagttattcttggaatctggtttaagccaacaggaaatagaagaaatcgaaggcgtgaaaaaagtgatccttcatgaagacaatacgttagagattaccttagaagatcctgaagctgggaaagaaatctttactcgtgcgactcagttcggctacattcctatgtttaaccagcaaccgccaactttggaagagattttcaaattgaaagcaggtgaaatcgatgcgtaa

SEQ ID NO: 1771 - DNA (genomic), 996 bp, Enterococcus faecium; double-stranded, circular
  misc_feature (B) LOCATION 1...996
  hypothetical: NO
  anti-sense: NO
atgtatggtgatattaagatcgtaagaggaaacggcgggtatggaggtcctttgattattaggccgacaaaagataaacacaagttcatctatgtcacaggtggaggtgagaggccaatgatcgtaaataaaataaaagaactgacaggtatggagtctatcaatgggttcaaaacatcaatacctgatagtgaaatcgcgcttgcaatcgttgactgtggagggactcttanatgtggaatttatcctaaaaanaggataccaaccatcaatatcgtttccacaggaaaaagtggcccattagcacaatatatcactgaagatatttatgtttcagcagtagggttagaacaaatacagccactaatggaaactgatgataaccaagaaacagtaaatactgcatctccagataaaaagtacaaatatgatacttctaaaaagataaccgagcaaaaagcagagcagcaaaactggatagcaaaaattggaatgggcgcgggaaaagtagttgctacattcaatcaatcagcaagagaagcagtagatacgatgatccggacagtgatcccttttatggctttcgtttcccttttgattggtgtgatacaaggttctgggatcggtaatgtatttgctaacattatggcacctttagcaggaaatgcagttggattaacaatcattggctttatttgttcactgccatttttatctcctttgcttggtccaggggcagttattagccaagtgattggaacattgatcggtgtagagattgggaaaggaaatattcctccccaattagcattaccggcactatttgctatcaatactcaaaatgcatgtgattttattccagtcggtctaggtttggaagaagcaaaagctgagacagtagaagtaggtgtaccatcagttctttattcaagatttcttaacggcatcccacgagttatcattgcttgggtagcaagttttggattatatagctga

SEQ ID NO: 1772 - DNA (genomic), 978 bp, Enterococcus faecium; double-stranded, circular
  misc_feature (B) LOCATION 1...978
  hypothetical: NO
  anti-sense: NO
aatgatggtgatatcatgacagacaacagcaaaacacgcgttgtcgtagggatgagcggcggtgtcgactcatctgtaacagcacttttgttaaaggaacaaggatacgacgtgatcggaatattcatgaaaaattgggatgacacggacgaaaacggtgtatgcacggccacggaagattataaggatgtagcgaaagtagctgctcaaatcgggattccttattactctgtgaattttgaaaaagaatattgggatcgtgtatttgaatatttcctagccgaataccgcgcaggacgtacacctaacccagacgtgatgtgcaacaaagaaatcaaattcaaagcattcttggattatgcaatggatcttggcgccgattatgtagctactggacattatgcgcaagtcactcgcgatgaaaacggcgtggtccacatgcttcgtggagtagacaataataaagatcaaacttacttccttagccaattatcacaagaacagctttcaaaaacgatgttccctctaggcggcatggaaaaatcagaagtacgggcaattgctgaacgcgcaggccttgcgactgctaagaaaaaagattcaacgggaatctgctttattggtgaaaagaacttcaaacaatttttgagcaactatctgccagcaaaaaaaggaaatatggtcactcttgatggtgaagtcaaaggacaacatgctggcttgatgtattatacgattggtcaacgtcaaggactagggatcggtggcggaggagattcgcaagaaccctggtttgttgtaggaaaagatctagcgacaaacacattatatgtggggcaagggttccatcatcctgcattgtatgccacaagcttggatgcaagtgaaatccactttacgacgaatgaaccaatgccaaaagaattcaagtgtacagcgaaattccgttatcgtcagcaagacgttcgagtgccatgt

SEQ ID NO: 1773 - DNA (genomic), 2202 bp, Enterococcus faecium; double-stranded, circular
  misc_feature (B) LOCATION 1...2202
  hypothetical: NO
  anti-sense: NO
agcagtggtgatttgatggcagcagcagaaaccaaaatggacacattcgtcattacaggtatgacttgtgcaaattgttctgctaggatcgaaaaagagctgaacggacaacctggtgttgtcaatgccacagtcaacttggccactgaaaaagcaagtgtcaaatatgaagggacgaccactgaaaaattaatccaaagcgtagagaatatcggctatggtgcgattttgtacgatgaagcccataaacaaaaaattgcggaagaaaagcaagtatatttgaaaaaaatgctattcgatcttgtattgagtacgattttgactttgccattgatgctgtcaatgattgccatgatgttggggagccaagcggcaattgttcacttttttcatctgccaatcgttcagttagttctgtctacacctgtccaattttatgttggtgctcgtttttataaaggggcgtatcatgcaatcaagacgaaagcaccaaatatggatgtactagtagcaatcggaacatcagctgcttttgcattgagcatttacaacggatttttccgtggacatccccaagatctttattttgaaagcagcagtatgatcatcacgttgattttgctcggcaaatatttggaacatacagcaaaaacgaaaacaggtaatgcaatcaaacaattgatgtctcttcaaacaaaaacagctcaagtaataagaaacggtaaagaagaaacgttagcgattgaagaagtcttcgttggcgatcagctagtcatccgtcctggtgagcagatcccagcagatggtcgaatcatttcaggaagtagtgcgatcgatgaaagtatgcttactggcgaaagtcttcctgtagaaaagaatccagatgacacactctttggcggaacaatcaatacgaatggtctgcttcatatggcagtcacacaagttggtaagcagacagttttagctcaaatcatccaaatggtggaagacgctcaaggaagcaaagcaccaattcaaaaaatcgcggatcgaatctcagggatttttgttccgatcgttttagtcattgcattcatcacgctagtggcgacaggattgatcacgggtgattggcaacttgcattgatccatagtgtctctgtattagtcattgcgtgtccatgtgcattaggtttagcaactccaacagctatcatggtaggaacgggtgttggcgcacgaaacggaattttaattaaaggcggagaagcattagaagcagctgctcacttagacagcattgttttggataaaactggaacgattacagaaggaaagcccaaagttacagatctagtcggttctaaagaagtcctatctattttttatactttagaacaagcttctgaacatccactaggtaaagcaatcgtggaatacggaaaactgcaagaagcagcaacatacgatatgatcgattttacagctcatccaggtgctggaatcagcggtacgattaacggagtacgctattttgcgggtacacgtaaacgattaattgaattgaacctatcatttgatgaataccaagaacacgcgttagaattagaacagcagggaaaaacagtcatgtttttagctgatgaaaagcaagtaatcgggctgattgccgtggcagatcaaatcaaacaagaagccaaacaagcaatcaagcagttacaggataaaggattagatgtctttatgctgacaggagacaacaaactggcagccgaaacgatcggtaaacaagtgggtattgatccaatgcacatctttgccgaagtacttccagaggataaagcagcctatgtggaaaaactgcagaaagatggcaaaaaagtcggtatggcaggcgatggaatcaatgatgcgccagctctcgcattagctgatgttggtatggcaatgggaagtggaacggacatcgcgatggaaacagcagatgtaacgctgatgaatagtagtttggcatccattgctcaaacaatcgagttgtctagaatgacattgagaaaaatcaaacaaaatcttttctgggcttttgtctataatacgattggcattccttttgctgcattaggctttttgaatccaatcattgcaggaggagcgatggcgtttagttccgtcagtgtattgttgaactccctgagcttaaatcggcacatgaaaaagtaa

SEQ ID NO: 1774 - DNA (genomic), 225 bp, Enterococcus faecium; double-stranded, circular
  misc_feature (B) LOCATION 1...225
  hypothetical: NO
  anti-sense: NO
atcatcggtgaagtgatcttccaagaattgacgctagcagaaagattgattgctattgttgtcggcagtatcatttatcagctattgattttagtagtaatcaaactagggtttgacacgacttatctgaagttgttctccgctatcatcttagctatttgtctgatgatcccgcaattgaagaaagcactgaacttaaaaacgggttttgagaaggaggcatag

SEQ ID NO: 1775 - DNA (genomic), 2388 bp, Enterococcus faecium; double-stranded, circular
  misc_feature (B) LOCATION 1...2388
  hypothetical: NO
  anti-sense: NO
aaaggcggtgaaagaatgatcattggaggaatattttccggcattgccgactggtggtcaggcttatttggggatggggatgcagatcccaaaaccgtaacgaaagtcttacaagattatggtaattatctgcagtatcaagatgtattcagttggatttgtaatacttttttatggggtttgattaaagggttatataatctcaatactttactagaaaaaacaatttatcaaagctttgatttaaaagacttattgaacgccgctggtgttaatgaactgtttcaaagtttgattagtaaggtattggctcttttttgtgtcgtcacattaatttatttaggcttaaaattttttatgagtaaacatccaccaaaaatcaaaaatatcttggttaatctatttatggccatgattttgatttttggtggtagttctttaatcgatgaagggctaaatattagtaaaaacttttacggagacgtgactgcagcaaataaagcagataaaactggttcacctgcttttcaaattattcaaaataatgtgattgatgtgagtacgttactagaaaatgatccgaacaaagtagaacacataccaacagacaaaagaaatgctctcacggcgaaaaattttaaaacagcgaatatcaatgggattattacacctgatcaagctaagaaaatgtctgaatcaagtgatattagtacagtacaaaaagatcggttaaaggcattacagtatcgactagagttagacgataatgggaaagaaatccctgttcaaattagtgatgaaggtttagcaaaatatgtgtatacttcaggctatcgccgatacattagtagtccaggtattattttagctggtgaatcttctttgtcggtagcctatttatttatcttgtttacgattgttacttgcattattgagctggtatttaaaaaattctatttagtgattgccgcgtcaacggactttgagacaggacaacggatgaaaagtgctatagaagatatttctcaatccttcttgttattggcatttacgattttagaattacgaatctatacattaatgctttcaggtatcggtgatttgcatgcggcaggaaagatcaatggattcttgtatgttgtcgctttaattgtattaaccattgcgctattcaaaggctctcaatcagttacgaaaattttcggcgttgatacgagtctgaaaaacggcagcaattctcttcttagcatgtttgccttaggaaatgttgcgaaaaatgtgggtagcggggctaaaaaccttgcaagtgctggtaagagtggtttaagcaatttaaatgatattcgtaaaaatggatttggtaatcgaaaagatgttacccctgataacggggaagaacaatcagacgataaagctacaactgtacctaatagtaagaaaacagtttccgaaatgttcgggaaagcgaaaaatggtgtttctaaagccgcagaaggtcttggttacgtcaatgaacgtgggttaaaaggaacagctgaagatcttacagaaaaagccaaagacaccttagaagagaaattagacggcacgagagctaaagaattggctgaagctgtgaagaatccatccgaaacactagaaaaacaaaaagaaaaagcttcagaaatcaaagaaggactaaaagatgcgtatggtgaaggacaagtcaatgcagcagtaaaagctaatacaacaaccgaaaaagaaaatcaagaaggtgcagcgattccttcagccaaagatcaccaagatgagttgcattctaacgaaaattcagaagaaggacaaaatggtcaattaccaaaaacagatccagaacaatatcgttataaatctaacattaattctgaaaatgaaaagcgcatttcagatttaccaaaacgaaatcaagaagtacaaacggatgatgattccatcgatctgccaaatgataatggggtcgaagttggaactgaaaaatcaacgaaaattggtttacctaaggcacaaaatttaccaatgaaagatagtcgtttgaatcaattcaaggagaatgatcaaagctttgttcaccaatcaactgcaggtaatgttcaaatgaaaccaagtcgtttgcctgaaaatggaaatctgacaactgtttcttacaatttatctgaaagtggggagacagggaatgcgtccgttcaaaatgttgtgacaagagaagctgcaccagaacctattcaaagagttcacacaggttacaaaccagcaaatgtggcatttactgcaccaacaaaaataaatgtgacaagagaaactaaaaacaggaacaatgaattgaaagaacaactattgagggatatcaaacaggatatcaaaccataa

SEQ ID NO: 1776 - DNA (genomic), 594 bp, Enterococcus faecium; double-stranded, circular
  misc_feature (B) LOCATION 1...594
  hypothetical: NO
  anti-sense: NO
cttccgggtgaagccgattctggtgaattaattccagtaactgttgtagaagctactccaaacgtagtactacaagtgaaaacaatggaaacggatggctacgaagctattcaagttggttaccaagatatgcgtgaagttttatcaaacaaacctgcgaaaggtcatgttgcaaaagcaaacacggctcctaagcgcttcattcgtgaattcaaaaatgttgagctaggagaatatgaagtaggaaaagaaattacagtagatgttttccaagcaggagacattattgatgtaacaggtactacgaaaggtaaaggattccaaggggttatcaaacgccacggacaaagccgcggaccaatggctcacggttctcgttaccatcgtcgtcctgggtcaatgggtccagttgcacctaaccgtgtatttaaaaacaaacgtcttgctggccgtatgggtggcaaccgcgtaactatccaaaacttggaagttgtacgtgtcgatgcagaaagaaatgttatcttgatcaaaggtaatgttcctggagctaaaaaatctttaattactatcaaatcagctgtgaaagctaaataa

SEQ ID NO: 1777 - DNA (genomic), 264 bp, Enterococcus faecium; double-stranded, circular
  misc_feature (B) LOCATION 1...264
  hypothetical: NO
  anti-sense: NO
aggcctttcgaaataatttggagggtaggtatggtacaaattaaaacgactactatactaatttatttactagcaattcaggaattatcaaaaagaaaaaagaaattaaaaaataatgatttagcaaaagttctaagtgttagtccagcatctgtaagtgagatgctggctaaacttagatatgaggactatttagatataggatttcaattaactgataaagggaaaaaatttattgacgattacaaaaaaggttttaagtaa

SEQ ID NO: 1778 - DNA (genomic), 246 bp, Enterococcus faecium; double-stranded, circular
  misc_feature (B) LOCATION 1...246
  hypothetical: NO
  anti-sense: NO
aggttcttcgatggggattattgcaaatgtcgtagcaggtttagttggatcagcacttggtcaagcattattaggttcttggggaccaagtattgcaggaatggcaatcgtgccatcattgattggtgccatcattttagtactaatcgtatcattctttgctcgaaaactgtaaaaagacttttaaaaagaggtcgtgaaaaagctgttcttcatcaagtaataagaacagccaaacaaaaatag

SEQ ID NO: 1779 - DNA (genomic), 201 bp, Enterococcus faecium; double-stranded, circular
  misc_feature (B) LOCATION 1...201
  hypothetical: NO
  anti-sense: NO
aggaaattcgatgggctgtgtaacgaatatcattgctggactagtcggttcaagtattggacaagcgattttcggcgaatggggaccaaaagctgcaggtatggcacttattccatctattttaggcgcagtgattttggtagcagttgtctcatttttctttggaaaacgatcataagtttttacaaaatagtaaactaa

SEQ ID NO: 1780 - DNA (genomic), 726 bp, Enterococcus faecium; double-stranded, circular
  misc_feature (B) LOCATION 1...726
  hypothetical: NO
  anti-sense: NO
ggaagtatcgaaaaaatatccataaaaggaatgtggaaaatggacaaccagctgacaaaagaactaaaagaaaactataacatcgtttttcacgatctaaatttgcttgaacaagcttttacccattcatcctatgtgaatgagcatcgcaatctgcaattatcggataatgagcgacttgaatttttaggagatgccgttttagaactgatggtttctcagtatttattccgtttatatcctcatttgccagaaggaaaattgacaaaaacacgagctgcgatcgttcgcgaagacagcttgtcgaaatttgccaaagaatgtcactttgatcaatatgttttgttgggcaagggagaagagaattcaggaggacgtacgcgaccagcattgctttgcgacctattcgaagcttttttaggcgcgttatatcttgaccagggattcgacacgacccatgcattcatcgaaaaagtgatttttcctaaagtcaaagcaggtgctttttcacatgagatggatcataaaacaaaactacaagaagtcttgcaaaaatcaggtgatgtatcaatcgaataccgattgatcaatgaagaaggtccagctcatgaacgagtattttggatcgaagtttatgtagatgatcaattgattggcactggacaagggaaatcgaaaaaattagcagaacaagctgcggcggaaaatgcattggcagcactgtaa

SEQ ID NO: 1781 - DNA (genomic), 246 bp, Enterococcus faecium; double-stranded, circular
  misc_feature (B) LOCATION 1...246
  hypothetical: NO
  anti-sense: NO
atgagtatcgaagaagctattttactggatactttacgttgtcgtctgaatttcttaagaactggccgatctttatctcaagtagctgtttctagcgcgttaagtattcctttattcaaatatcgtaagtacgaagaaggagaagaaattccaagcatcattgaattaatctatatcgctgacttttacgatatttccgttgattacctaattggtcgctcagaaacagcaagcaaactgaagtga

SEQ ID NO: 1782 - DNA (genomic), 462 bp, Enterococcus faecium; double-stranded, circular
  misc_feature (B) LOCATION 1...462
  hypothetical: NO
  anti-sense: NO
aaacaaatcgaaaccacagacaaaagcgaggtgaaacccatgcggaaatatttgatcgccactcacggcgaattagccaaaggcttccaaagctccttgaacattctggcggacaaaggcaatgacttccaagtcatcaacgcctacatcatcgacgaagattacacccccgccatcgatgaattcatcgcttccgtccaaccggaggaacaaggctttatcttcaccgatctcttcggcggcagcgtcaaccaaaaggccttcactgaactaatgaatgccaaaaaagacaacatcgtcatcatcaccaatgccaacctggcagtgatcttatccgtcctattcttaggcggtgacgaagccctcagcctggaacagatccaacaagccgtcagtgaaagtcaggtacaagtggtaccgactcagatcgccgacgaagacgatgattcgatcttcgattaa

SEQ ID NO: 1783 - DNA (genomic), 1254 bp, Enterococcus faecium; double-stranded, circular
  misc_feature (B) LOCATION 1...1254
  hypothetical: NO
  anti-sense: NO
aagatgatcgacaaagttcaaaaaatagctgcaaaaattagtaatcaaagacatctactagctttaagagacagcatggctgcagttatgccattaatcattattggttccttttttatgttattagcaaatttcccgatagaaggatttacaaaatggttatctgaaattggagtacaatcctttttgaacaaagcatcagattcaacatttggtattattggattagctgttacctactctttgggacacaatctagcaaagacttatggtgtagactcattatcagcaggattattatctttgagtggatatgttttacttacacctttattggatgcagatggttctataggatttccaacaaaatactttggtacctcgggtctttttgttggtattattgtagcacttgtatctacagaaattttccggtggtttgtacttaaaaatattacaattaaaatgccggcaagcgttccaccaaatgtaagccgagctttcgttgctattattcctggcttttttgtcgttctactatggtttattgttgttgtaatttgttataaacttggaattgaaaatgttcatgctcttattgcagatacactcgcaaaaccactatctttactgacgaaaactttaccaggaattatattggttatacttattcaatgtttcttttggatgtttggtattcatggtgcacaggtaacggggccaataattgaaccgttattattgcaaaactctgatgtaaatagaattgcttatcaagctggaaaagaacttcctaacattataacttatgaattcttatataactttgttttttctggtggtgcaggttgtttatttgcacttgccattttaacatttttcttttcaaagagtcaggaaaataaaactttaggtaagttatcaatcgctccagtaagttttcaagtagcagagccccttctatttgggtttccaactatattaaatataaaaatgttaattccatttgtaactgcaccagtagtaacaacattaattacttatttttcaatgagtatgggattagttgcaaaacctgtaggagcaacaatcccatggacaactccaccgataattgccggatttttagcttctggtggacgaataagtggtgcagtgattcaagtaataacaattgcaataaatgttttgatatactatccattctttaaattagatgataatgccaagctaaaaagcgaaaaaaatgattag

SEQ ID NO: 1784 - DNA (genomic), 936 bp, Enterococcus faecium; double-stranded, circular
  misc_feature (B) LOCATION 1...936
  hypothetical: NO
  anti-sense: NO
gcttttgtcgattggttatcgtatcctttatttatcagtaagaaacgaggaggaaccacaatgagtcggatggatcgctataaggacatccataagaaggcgaaacctctgaagcgggatacggggagtatttttgctagaagagaacgaaaacgaacgcgtatggaaaatgaggaagatgctacccgtatttatgaaagagagcagcattcatttgaacatttgaaccaatacgagcaacagatatacagagatgcaccaagagcagaagaacaacaaaaaaataaaaaatttttcaatcggcaaaagaagaacaaaccgttaaaacctcgaagaaagcgatcgtggaaaaaaatcattctatcgattttgcttgttttgatcctttattcaggtatctcattttttattggtaaatatgtagctgaacatgacacaagcttagaggcagcgacttcagaaacctttcatgggcaaaaagcgacgaatggtgcgcataatattttgatccttggaagtgatacacgcggagaagatgccgggcgagccgatacgatcatggtcttacagttggatggtccttcccataagccgaaactgatttcttttatgcgtgacagcttcgttacgatcccaggggtaggacaaaataagatcaattcagcttatgcatacggaggagccgatctagtgcgtcaaactttagtagaaaattttggaatcgattgtcaatactatgcgaaagtcgatttcaaatcgtttgaaaaagtgatcgatgccttattcatgaacggagtgaagatcgatgcagaaaaagatctgaatctggatggtgtagatattaaaaaaggggtccagaagatggatggacatgttcttttgcagtacgcacgtttccagaatggacgaacaaggcactttatcttcaccaagggt

SEQ ID NO: 1785 - DNA (genomic), 258 bp, Enterococcus faecium; double-stranded, circular
  misc_feature (B) LOCATION 1...258
  hypothetical: NO
  anti-sense: NO
ctggacgtcgaccaaagaaataaatttgaaacttatacaatacctggagagagaggaacagggatgatttgcttgaatggagctgcagctagatgtgtatcaactggagataaaataattttaatggcatattgtgaattaaatgaaaatgaggttaaggatcatagacctaaggttgtttttgtcgatgataataataaagttgaaagagtaacatcatatgaaaaacatggaaggttatcagatataattctttag

SEQ ID NO: 1786 - DNA (genomic), 774 bp, Enterococcus faecium; double-stranded, circular
  misc_feature (B) LOCATION 1...774
  hypothetical: NO
  anti-sense: NO
cacttatgcctacaaaccgcaaaaatgagctacttgttcaaatggcacaaaccatcaaaaaagaatcaacaagcgatcattgaagcaaatcataaagacttagaaaaagcagtcgaacacaatatcagtgaaacgatgcaagaccgcttgcagctgacacctgagcgaatcaatgccatggctacagagatcgaaaaaattgcttcgttagacgatcctattggaaaagtagatgagatgtggacgaacaccgacggattgagaatcggcaaaaagcgcgtgccactaggcgtgaccggcatcatttacgaatctcgtccaaatgtcacgacagatgcagctagtctagcattcaaatcagggaatgccgttatccttcgcggtggcaaagaagcattcttctcgaatcaattattagtccaattattgcagcaagtactggtcagtgctggcgaatctccttatgccatccagtttgtcgatgatacttctcatgaaactgcaggacagttgatgcgattgacagaatacttagatgtgctgattcctcgaggcggagcaaaattaatccaacgagtcaaagaacaggcaacggtacctatcattgaaacaggtacaggaaataatcacgtatatatcgataaagaagcacagttatctatggcagtgaacatcatcgtcaatgcaaaagcttcccgtccatctgtctgtaacgcggcagaaacattgctgatccattctgagatcgcacctttttttcttgccagctattga

SEQ ID NO: 1787 - DNA (genomic), 189 bp, Enterococcus faecium; double-stranded, circular
  misc_feature (B) LOCATION 1...189
  hypothetical: NO
  anti-sense: NO
tttagatgcctgggattatattggacaatacagttggaggattttttattatctagcgaagagaagtgtaagttaacagaactgtatgagaaaaaagacaactacgtagtagctaaccgattcattaattttttcaagttcatgtttatttacgtatcagaatttttcttattcaatggtttggtgtaa

SEQ ID NO: 1788 - DNA (genomic), 960 bp, Enterococcus faecium; double-stranded, circular
  misc_feature (B) LOCATION 1...960
  hypothetical: NO
  anti-sense: NO
aaaactaccgaaatgtttggtaaaatagggtcgttggttaagaattgtcttaacaaatttagttttacaaaacttaggaggaattttattatgccagtagtatcaggagctgaatttttaaaagctgctcgtaaaggcggttacgctgtcggcggattcaacacaaacaacttggaatggactcaagcaatccttgaagcggctgaagcaaaacaagcaccagtacttatccaaacatcaatgggtgcagctaaatacatgggtggttacaaaatctgtaaagatttaatcactgatttagttgaagcaatgaacatcactgttccagttgctatccacttagaccatggtgactacgaagctgctttggaatgtatcgaattaggctatacttcagtaatgttcgatggttcacatctaccatttgaagaaaacttgaaattagctaaagacgttgttgaaaaagcacatgcaaaaggtatctcagttgaatgtgaagttggttcaatcggcggagaagaagacggaatcatcggtaacggcgaattagctgatattgaagaatgcaaacaaatggttgctacaggtatcgactacttagcttgcggtatcggtaacatccatggtcaatatccagaaaactggaaaggattagcttttgaccacttacaagcaattgctgatgctgtaggtccagacatgcctttagtattacatggcggatcaggtattcctcaagatcaaatcgaaaaagctatctcaatgggtatctcaaaagtaaatgttaacactgaattccaattatcatttgctgcagctactcgtaaatatatcgaagctggtaaagataaagaaggtaaaggattcgaccctcgtaaattattagctccaggtaaagcagcaatcgttgaagatgctaaatctcatatcgactggttcggttcagctaacaaagcgtaa

SEQ ID NO: 1789 - DNA (genomic), 243 bp, Enterococcus faecium; double-stranded, circular
  misc_feature (B) LOCATION 1...243
  hypothetical: NO
  anti-sense: NO
cttaataccgagaaactggcttttgaacaccgtttattcggaacaagaggttgtgacacgtcttttgtcacaacccctttgtctttattcattattattcttgtcggaactcatcatattgtttttgcatttctttcaataccttatcatagccagccttgtccaaagcgtctttcaatttcggtaatgtttcatctggatcaacagtccctgtattcaatccatctaaatattgattcatga

SEQ ID NO: 1790 - DNA (genomic), 813 bp, Enterococcus faecium; double-stranded, circular
  misc_feature (B) LOCATION 1...813
  hypothetical: NO
  anti-sense: NO
cccaataccgaccgccgcagtttgcaggactgcggcgttttttcatcggcagaataccattcagtcgggttaagcggcggcaaggattcctcggcgctactgctcctgatgctagaaaaagggatgccgattgacagcgtgatatttgccgataccggcatggatttcccggaaatggcggcgcatatcgcaaaattggacgcgcttctgtaccgtgagcgtggtatccacatcactaccctgcgccacccgcatggatttgagtggctcatgtttgacgagccaaagcggaagccaagctgcctaaagaaccgcgcccggttaggcgtaccgccatacgggaacggctggccgggaatcaaggttcgctggtgtaccggccagctcaaaacgcatttaatcacaaaagaggtaaaccggctgaaaaaagagaagaacgccctgcactatatcggcattgccgcagacgaagcgaaacggtgcaaggatgccccaaaccaccgctatcccctggtggaatggggcgtcaccgaggcgcaggctttacagatctgctatgaccggggcttcgattttggcgggctgtataaaatctaccaccgcgcttcctgctggtgctgccccttacagcggattggtgaattacgcaagctgcgtcagcaccaccctgaactgtgggcgcggctgtgggatatggataaccgggcgcgggcgcagtttggcgcaggcccccttggacagtttaaggagcgttggagcattgaacagttagacgcacggttttcccgcgaagaaaaggaggaacgcgcatga

SEQ ID NO: 1791 - DNA (genomic), 183 bp, Enterococcus faecium; double-stranded, circular
  misc_feature (B) LOCATION 1...183
  hypothetical: NO
  anti-sense: NO
gcaaataccgagagtcagctgaatgaacaccgtttagtggagaggttgtctcttaaacactgtttgtttgcaaataaggggactgtgacaaaagtcgtgtcacagctcccttttttttttcgaataaacggtgttcaaaagcttgcatctgcggtaataagcctaaccaaacgaaaaatatga

SEQ ID NO: 1792 - DNA (genomic), 312 bp, Enterococcus faecium; double-stranded, circular
  misc_feature (B) LOCATION 1...312
  hypothetical: NO
  anti-sense: NO
cttgtgaccgaggagttggcaggagaacaccgtttattcgaaaaaaggactgtgacaatgtatcgactcccaaaagttagaccaaaaaatctaacttttgggggtcggtacacacgttttttgtcacagtctctttgtgtctcatttcatataaacaattatttactttgtactatttatttcatttctgtgattttaatgctttttgctaaattttttacatcagctggaataactttcccgacttctgattgctgtgcattcgacatgccgcaagccattgcgtaccttacacattcttttaaaggataa

SEQ ID NO: 1793 - DNA (genomic), 411 bp, Enterococcus faecium; double-stranded, circular
  misc_feature (B) LOCATION 1...411
  hypothetical: NO
  anti-sense: NO
cttgtgaccgaggagttggcaggagaacaccgtttattcgaaaaaaggaactgcgacaagacttttgtcacagttccttcttttttttgctatgctatactagatgtaaaaaataggagaaataaaatgagggaaatttattcttttgaatcaaaaatctatgcttccgaagtcggcaagggcggggcatatattatttttccgtatgatataagaaaagaattcggtgctggaagagttaaagtccaagcaacttttgacaatgtgccgtatgaaggcagtatcgtgaatatgggcgtgaaaaatccagatggttcagtctgctacatccttggactacgaaaagatattcgtaaaaacatcggaaaagaaatcggtgatattgtagcagttacagtgaagcaaaaataa

SEQ ID NO: 1794 - DNA (genomic), 1434 bp, Enterococcus faecium; double-stranded, circular
  misc_feature (B) LOCATION 1...1434
  hypothetical: NO
  anti-sense: NO
gcaacttacgaaaacatctgcgaagtactggattggataaagaaatcaaaaccttacgtaatgtcggttatatactgcaaagggtgtgatgcaatgaatggagatattacacgaaagcaacgtagtcgcttttttgcgacaaatgtagcagcatttgcttttatcttttttcttttgggattcattactttacagatattaaaccaatctgcatacagagaaacagatctgtcattagagaaaataaattttgattctcgaacagtacaattagagatacaaagatatcagcaaggcgatccctttttaaacccgactcaaacggaacaaaacagaacaaacatggaacagccattaatggaaccatcaaatgaccgttttaacactcaagtgatcttgtggtctaaaaatggtgagatattgaataaagcagctattggtgggcgtttcaaccaaatcaaagaattaaaaatggatacgaaaaatctgaataccatccaaaatattgaattaaatgaagacagtggctcatctgccctctctttccgttcgattacgaaaaaagcggagacgaatcaagatggcgttgcctacatccaaattttagaaaatacaaatcaaatcaagaattcattagcgacttttcgcacgattatgattttgtgtatgattgttttttggattctctctattggtatcagttattacttgtctagtctaagcatgcgccctattattctttcttggagaagacaaaaagaatttgttgagaatgcttctcatgaattgcgcacaccgttaacgattattcaaaatagtttggaacatctttttaccaagcctaatcatactattattgaagaatccgaaagcatcgctcaagcattgtcagagacgaggcgcctcactggattgacttcggatttgctgacaatcgctcggaatgattctgatcagcagctgctttcaaagcaaatgatcaatacacaagaatatatcgaacaacttgttaaaccatttcaagagatggccatcatagatggaaaagagtttattctccataacgatgcaacattagaagtaccaattgatgaaaaaaaaatccatcaagttttggttattttgctggataatgcattaaaatatacgaatccagaagataagatcattttggattcatctgttaaccataaagaatggctgattcacgtaaagaatactggcccttctatcagtgaagaagatcaagcaaggatttttgatcgattttatcgggaagatcaatctcgggcgaaagagactggcggatacgggcttggcttggcaattgcaaaacaggtaatcgaacagcatcatggacagatttctgtatccaattatcttccacaaggagtcgattttaaagtccaattgccgttgaagcctaaaaaataa

SEQ ID NO: 1795 - DNA (genomic), 335 bp, Enterococcus faecium; double-stranded, circular
  misc_feature (B) LOCATION 1...335
  hypothetical: NO
  anti-sense: NO
acatctacgatagcgcgaatcaaatcgaacgtgagatccgtgaattaccagaattcaaagcgttgaaagaagcgtacgagaaagtacaagcaaacgaagaagcacacaaactgttcaaagacttccaagcgatgcaaatcgaattacaagaaaaacaaatgagtggacaagagttcagcgacgaagatgcaatgaaagcacaagaaatggctgtgaaaatccaatcagaagaagtaatcaatgacttgatgcaaaaagagcaaggcttcagtacaatcatcaatgacttgaaccgtatcatcatgacaccagttcgcgacctttacagcgaataa

SEQ ID NO: 1796 - DNA (genomic), 510 bp, Enterococcus faecium; double-stranded, circular
  misc_feature (B) LOCATION 1...510
  hypothetical: NO
  anti-sense: NO
cggcgctacgacgagncaacagatgctcgtgcttttgtgcgttggcattatgacaagaagaggaattgcatatatgccattgatgaactatacgaggttaaatgtagcaatcgtcgtgcagctcaatggattaagagcaataagtatcactaccaggacatcatcgcagaggttgaacctaaatcaaacgctgagatgagaaatgagcatgacatatcgaagataaggcaagttactaaagggcctgatagtgttgaatacggtgaaaaatggctagatgatttagatgcgatatacatcgatccgatcagaacaccaaacatcgctaaagagttcgaaaacatcgactatcaaacagatcgtgatggaaatccaaaacctcgacttgaggacaaagataatcacacaatcgatgctactcgatatgcttttaacgatgacatgagaaagcaaccagaaccagtcaacgtcaaaaagacgatcgacacattcaaaaaactaggattgtag

SEQ ID NO: 1797 - DNA (genomic), 186 bp, Enterococcus faecium; double-stranded, circular
  misc_feature (B) LOCATION 1...186
  hypothetical: NO
  anti-sense: NO
ctaactcacgatcgtacattttcattggaaaagaaatctgttgccctcgaaaagcaagataaaattgatagagcaattctgaatccagttccatttcctcaaaaaagtcattcatacttttataagagttactcaaacaagtttcatcaatctccatctacacaccccctgttattttttacataa

SEQ ID NO: 1798 - DNA (genomic), 288 bp, Enterococcus faecium; double-stranded, circular
  misc_feature (B) LOCATION 1...288
  hypothetical: NO
  anti-sense: NO
ttatgtaacgaatcaggaaaatcaagaaaattctttgaaatggtaaatgaaatccctgcaaaccaacaagctagggaaacagcaaaggctaaaaacgatgaattaacaacagctgtgattgaacaatatgaaacagctcaagcgatgccaaacatcccagaaatgggcgaagtttggacaggtgcagaaaacttgatgttcgatgcagcatcaggttcaaaaacaccaaaagaatccgcagatgaagcagtaaaaacaatcagtgaagccatagaacaaaaatactga

SEQ ID NO: 1799 - DNA (genomic), 381 bp, Enterococcus faecium; double-stranded, circular
  misc_feature (B) LOCATION 1...381
  hypothetical: NO
  anti-sense: NO
cagatgcgtttggtgtcactccaaaagcaggttatttggaggaagttcatacgaaagcaggtgtctgacatggtgaaaaaagctttttgcatgaaagtttacccagaaaaacaagaagaatacaaaaaaagacatgatgaactttggccagaaatgcgtacagcacttcgtgaacacggggtcatcgactattcgatctatcttgatccgagtacaagtttgttatttggttacttagtgatcgaagatgaaaagttatgggaaaaaatggcaaatacatctatcaatcaaaaatggtggaagtacatggaagatatcatggagacaaatccagatgcctctccagtcagttgggaattgatgccagtctttgaactgtag

SEQ ID NO: 1800 - DNA (genomic), 1209 bp, Enterococcus faecium; double-stranded, circular
  misc_feature (B) LOCATION 1...1209
  hypothetical: NO
  anti-sense: NO
tcattcaacgagaaggagagtcatatgtctaaaacaattgcaatcaatgctgggagttcaagtttgaaatggcaattatatcaaatgccagaagaaaccgtagttgcgaaagggatcgtcgaacgtatcggtttacaagattctatttttaccatcaagtacggcgataatcaaaaattcgaacaaatcatggatatcgaaaaccacgaagtagcagtaaaaatgctgttagatcagttgattgaactgcaaattttaagctcttatgatgaaatcaccggagtagggcaccgtgttgttcacggaggagaaacttatggggattcagtagtgatcgatgagaaagtaatggaccgcattgctgaattagcagaatttgctcctttgcataatcctgcaaacttaatggggatcaaagcgtttaaaaagattttacctgacattttgagtgtggctgtattcgatacatctttccactcaacaatgccaaagcaaaattatttatatagcttaccggtgtcttattatgaagatttcaaagtaagaaaatatggcttccatggcacaagtcatcgttatgtgtcggaacgtgcggcaaaattattgaacaaaccgatcgaagaactaaaaatcatcacttgccacttaggaaatggtgtatcgatcacagcagtcgatggaggtaaatccatggatacttctatgggattcacaccattagctggggtgacaatgggtacacgttcaggtgatatcgatccagctgttctcccatatttaatggaaaaattagagattgatattgatgaaatgatcaatgttttgaacaagaaatctggtctgctaggcctaacaggattgtctagtgatatgcgtgatcttgaaaagaactatgaaaaagaacatattcgtttagcttatgacattttcgtggaccgcatccgaaaatacatcggcggttatgtgacaacgatgaatggtgttgatgcaattgtctttactgctggtatcggcgagaatgacggacatgtacgtagtgaaatcatcaaaggtatgtcttggtttggttgtgaaatcgatccagcgttgaatgaattgcgtggtgaagaagtagatatctctacaaaagaatcaaaagtaagagtattagtgatcccaacagatgaggaactaatgattgcccgtgatgtggagcgtctgcgcggctaa

SEQ ID NO: 1801 - DNA (genomic), 204 bp, Enterococcus faecium; double-stranded, circular
  misc_feature (B) LOCATION 1...204
  hypothetical: NO
  anti-sense: NO
atagtaaacgaatcgtcgctatccatcaatgaatgggtgatcgactgtttttgtttagagccttgttttgaactgaatggccgtttttcggtatataacagaaaaacaaggtgtgttcaaaaagaagagggtcaagcaatggacgagtttgtccagcaatctgctgtgaaagattctcgcagatctgctcataacgattggtga

SEQ ID NO: 1802 - DNA (genomic), 360 bp, Enterococcus faecium; double-stranded, circular
  misc_feature (B) LOCATION 1...360
  hypothetical: NO
  anti-sense: NO
gtatcaaacgatgttattaccagaagaatactagtatctaaaagaaaggaacgaaaggacttgttagaaacggctatcgaagtactggaaaagtgtgcacagctggtcactgcttctgaagagtggggctatgaatccgttacgatggaaaaagaggaaattgaaatgggtatgcttcctgaagatgttcatctaccacgtttagtgatgacacatctttatatttattgcgcaccagaagatggaaaagactatgtagtttatttcattacagatattaccagccagcgagaatttgttcgtgggttactggtagaaggacgattggtttggagtcagattggaggaacggatgaataa

SEQ ID NO: 1803 - DNA (genomic), 1269 bp, Enterococcus faecium; double-stranded, circular
  misc_feature (B) LOCATION 1...1269
  hypothetical: NO
  anti-sense: NO
gatggaaacgagctgtcgaaagaggaaatcgagtacatcgtcacgaactatacgaatggaaagattccagattatcaagtcagtgcattattgatggcaattttttatcaagacatgacaaatgaagaaatcacgaacttaacattggcgattgctaattctggtgatgtcatcgatttgagttctcttgaaggaataaaggtagataagcattcgacaggtggcgttggtgacacgaccacattgattttagcccccctagtagctagtgtcggagtgacagtggctaaaatgtctggacgcggtctaggttacacaggtggtacactagacaagctagaagcaattcccggatttcagatcgagctttcggatgaagaatttgtacgcattgttaatgaaagtaaagtagcggtaattggtcaatcaggaaacttggcaccggcggacaaaaaattgtatgccttgcgtgacgtcacagcgaccgttgattctcttccgctgattgccagttcgattatgagtaaaaaaatcgcggcaggagcagatgcaatcgttttggatgtgaccactggagacggtgctttcatgaagaacatcgaagatgcaagacgtctggcaaagaccatgacgagcattgggaaactggctaaccgagaaacagtggcggttatctcagatatgtcagaacctcttggcgaagctatcggaaatagtctagaagttgtcgaggcaatcgaaacattacaaggaaatggtccagaagatctagtagaaatgtgctacgccttaggaagccaaatggttgttcttgctggcaaagctaagacaaccgatgaagcaagaacgttgcttcaagaagctctggaatcaggtaaagcgttagcaaaattcaaagaaatgatccaaaatcaagggggagacccagcgatcgtggaacatccagaacgaattttgactgcacgctacacaatggagcttcctgctaaacaaagcggagttgtgtcaaaaatcgtggcaaatgaattaggaattgctgcaatgatgctaggtgctgggcgtaaaaccaaagaagaagatattgatcacgctgttggattgaaactgcataaaaaaattggtgacactgtgacaaaaggtgagtcactattgacgatctatagtaacgacgaagaaatcacttctgtcattgaattattatataaaaatattgaaattggtgaatcggcaatgaagccaacgttgattcatgacatcatcacagaataa

SEQ ID NO: 1804 - DNA (genomic), 540 bp, Enterococcus faecium; double-stranded, circular
  misc_feature (B) LOCATION 1...540
  hypothetical: NO
  anti-sense: NO
atgaaccgcctaaaagaaaaatatcttaaagaagtaactccatcattgatggaaaaatttaactatagctctgttatgcaaacacctaaagttgaaaaaatcgtcatcaacatgggtgttggtgatgcggtatcaaacgctaaaaacttagataaagcagttgaagaattaactttgatcactggtcaaaaaccaatgattacaaaagctaaaaaatcaatcgctggattccgtttacgtgaaggaatgccaattggtgcaaaagttacattgcgcggagaaagaatgtacgaattcttagacaaattggtttctgtttcactaccacgtgtacgtgacttccatggtgtaagtaaaaaagcctttgacggtcgtggaaactatactttaggtattaaagaacaattgatcttcccagaagtagattatgatttagtagataaagtacgtggtatggacatcgttattgtaacaacagcaaactctgatgaagaatctcgtgagttgttgacacaattaggcatgccattccaaaaataa

SEQ ID NO: 1805 - DNA (genomic), 1275 bp, Enterococcus faecium; double-stranded, circular
  misc_feature (B) LOCATION 1...1275
  hypothetical: NO
  anti-sense: NO
atgattgacgatatttttgcaatcaacctctatcattttccttttatacccgcttttgtctataatgaagttatagataaaggaggaaaaagagtgaaaaaagaaacagatacaacgaatcgtttgatccgctttttaggaggaaaaacctcttactatgttttaggaatagttatcttacttgcgctgatcatttattttttccatcagatctcgtttatattcaagcctgtcggaatcattatcgctactatcttgcccccattattgtttgcactgatcttgtattatcttttggaaccagtcatcaaacgtttgagcaagcacctttcgaggaacttgtcagtcattatcgtttatgtgattattttatttttattggggcttggaagcatatggcttattccttttcttgaagaacaggcaaagacattgatcagtagtttgccagatttgtttcaagattttcaagagagtctccgacaatttttggagaaaacaccttttgccgattcatttaatcaatttttcgcttctattgacgacgtgacgtctgatatagctggatttattggaaattattgggaaagtggcgcacaacggatcagcaacattttttcaactgttacagctatttttattactttatttactggtccaattgtcgcttttttccttttgagagatcctcaaaaattttatcagtcagttttagcgattgtcccaccagcatttcgtacagattttaaaaatttgacaaagattgctaatcaacaattgggttcatttctaaaggggcaaatcattgcttcatttatccttggagcagtctactgggtttgtttcttactgatcggattagaatttgctagtgttttagctatttctgctgggttgttatgtatcattccatatattgggccgtttatcgccttctttccaggtttgatcattgcattccaagactctacttttatggctgtcaaatttgtcattgtctggtttgccgtacaacttctccacggtgacttggtgattcctcgagtaatgggtgatcgtttacagatccatccgattacgatcttaatcgttttacttgtcatgggtgatctaatgggaattgtgggcgttatttttggtattcctatctatacgttagtcaaattactcgttacttttattttccgtaaattcaaacaacgctacaataaattttatggcgataaaggagagtatgaaaactcttcattttctgaagaagattattttaaataa

SEQ ID NO: 1806 - DNA (genomic), 972 bp, Enterococcus faecium; double-stranded, circular
  misc_feature (B) LOCATION 1...972
  hypothetical: NO
  anti-sense: NO
ggggacgacgatatgcttaaaaaaaagccatctatttttattggtatgcttgttcttgttttatttgttacaggaatgtacttgacgatccatacatatggaaactggcattttgcatgtgcattgaggagtaagaaaatttttgcatttatccttgtctcgctagctgtcagcagtgccacaatcagctttcagacaattacgcataaccagtttttgactccttcagtattgggacttgagtcgttatatgtccttgtccaaacggtccttttcttctttatcggaggagtgacgatgcttcagcagacaggtacagtttttttcttattgaacgttgggctgatggtcgggctgagtctattgttatttttctttcttttgaaaaaaatgagagcgaatctttttttattactgatgtcagggatgattttaggtacgctttttggtagtgtcagtacctttttacaagtcatcatggatccgaatgaatatgatttgcttcaaggcagattatttgcaagctttggcaatatccagagtcagtatcttttgcctgcttctttgatcattatcggctgctggtacctgttatttcgatatcgacatgtgctagacgttttccatctcggaaatgaacaagcagtaaacctcgggatagacacagatcgttttgaatttttgattttatgttgtgtcagtcttttgacagggacatcaacggctcttgtgggtccagttacttttttagggtttattgtcgcaaatatcagttatcgtgtcttttctacttatcgtcatggtcagctatttatcggaagctttctggtagctatgctgtttctgacaggaggacagctcgcagtagagcagattttcggctggaatacaacagtgagtgtcgtcgttgaatttgtcggaggaatttattttgtcacaaaattgattcgcgaaaggaagagtatcctatga

SEQ ID NO: 1807 - DNA (genomic), 936 bp, Enterococcus faecium; double-stranded, circular
  misc_feature (B) LOCATION 1...936
  hypothetical: NO
  anti-sense: NO
caccaggacgagcttgtggtgagagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaaaaaaaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaa

SEQ ID NO: 1808 - DNA (genomic), 618 bp, Enterococcus faecium; double-stranded, circular
  misc_feature (B) LOCATION 1...618
  hypothetical: NO
  anti-sense: NO
cgattttgcgatttctttttctgcatgttagaatggagaaaaggagaggaaactatgattcgttttgcgagaaaagaagatgctccagaaatcgccccattgatcttagtgattctaaaagatatggaactgccatttttgaagcagacaggggaacaaaagactttagagattttagaagaagcaatcactgatccaaattatcgttacagttattcacgaggtatcgtagaagaaatagacggtaaagttgcaggagttgcttacggttatacagatgaagaagaatcaatcatcgatcagccactggtacctatcttagagaaatatcagctagatgcgtctacacgtttgttcattgataaagaaacgtttcccaacgaatggtatttggactctatcagtgtatcagaagattttagaggacaaggcatcggttcgcgattattagaagcattacctaaattggcgaagaaagctaatcgctccgtcatcggtctaagtgtggatgaaaaaaatccaaaggctaaaaaattatacgaacgccatgacttcaaagttgtcggtcagcggatgatcagtggtcatctttatgatcatatgcaaaagaatatctaa

SEQ ID NO: 1809 - DNA (genomic), 660 bp, Enterococcus faecium; double-stranded, circular
  misc_feature (B) LOCATION 1...660
  hypothetical: NO
  anti-sense: NO
aacatatgcgattttaggtttcgttatttccttcctattagtattgaatgcctaagcataaaggaggaaaagcagatgaacgccattgaaaaaatcatctctcagatgaatgaagcagcagagcaagaaagagcggcgttagagcaagaagagcgaatgaagatcgatcaaaactttgaacaaaaacgtacgcaaatcgaaacagaacatcaaaaacaaaaagaaaaacaaatcgaattacttgaaaaaaaataccgtcagcttaggaatcgccaacaagtagaagtacgacaagaaaatttgaatgcgaagcaggaatttttacgacgattgtttgcagatgcaatagctgaaatggagaattgggatgaatctgaacaaatccagtttatcaaaaattcattgtattcattacctttgacaggcaaagtaacattcattgctggagaaaaatcagcagcttatctttctcagacattgctggatgaatggaacaatgaacttccctttatgatggttttaagtgatgaaactgttgctgatcaagcgggttttctgataaacgatcaaggagttcagtataattttcttttcagcagccttgtacaagatatccaaggaacgatgagttttgagattgccaatcaattattcgaataa

SEQ ID NO: 1810 - DNA (genomic), 921 bp, Enterococcus faecium; double-stranded, circular
  misc_feature (B) LOCATION 1...921
  hypothetical: NO
  anti-sense: NO
agaaagtgcgacacatcgaatcaacacgaccaatcaaacaccagaaaagatcatcgataccattatagaaaggatcaaaagcatatgaacgtcagctatctagggccagaaagttcattcacttatcaggcggcttgtcagctatttcctacagaacaattgactgcgtatgcttccatccctgtttgtttgcgcgctttgtttcgcaaacaagtcgatctggctgtcgttcctgtagagaattcattggaaggagctgttcatcacacaatcgatcttctttccaaacatccagaagtcgaagttaaaagtgaaatcgttcttcctatcaagcagcagcttttaggcaatccagcaacaaagattacaaaaatcctttcacatccacaagcactagcacaatcacaacagtttttagaaacgcattatcctaatgttcctttagtagcaacagaatcaacaactgctgcagcaatgtatgtagcagaacatccgaaagaagacgcagcagcgattgcttcattagaaacagcacagcatgttggattggagatcttagctgagaatatccaagataatgagttgaaccagacacgtttttggatcgtcggtgaccgaaagatgaccagccagcagtcagctccagtaaaaatgagtgtcatcttgacactacctgctaatcggccagggatgcttcataaaatgctggcagcttttggctggcgggaaatcaacttaagtaagattgaatcccgaccattgaaaactagcttgggagaatattttttcgtgatcgatttgttgttggaccgtccaatgacattagtagagaatgcgctccaagaaatcaagatgctcggaggagaaagtcaaatattgggctgttatccagtgctgacagtagaagagacgcgtagatga

SEQ ID NO: 1811 - DNA (genomic), 1374 bp, Enterococcus faecium; double-stranded, circular
  misc_feature (B) LOCATION 1...1374
  hypothetical: NO
  anti-sense: NO
aagatgcgcgatttaacaaaaggaagccccgctaaactgattttgatgttcactgttcctttactgatcggaaatgtgtttcagcagttctacaatatgatcgatatgatcatcgtgggtcagacgctaggtaaaaatgcgctggcagcggttggtgcaactggaagcctgacatttttgatcattggctttgcccaaggtttaacagctggtttagccattattaccgcacaacgttacggtgcaaaagattatcggggtctgaagaaaagttttgctgctagtgttgtcattagtcttgtcgtcactgtgattttaactgtcctaagtctcctgtttattcgtccgatgcttcaattgatgcaaactcctcctgaaatacttgatcaagcacaaacatttatttcaattattttattagggatctttgcatcagtcagtttcaatttgctttctaatgtcattcgcgcacttggtgacagccgcacaccactattctttctgatcattgcggtcatcatcaacgtcgtacttgatttgatctttattatctattttggcatgggtgtggaaggtgcagctattgctacagtaatcgcacaagtttcttccagcgtactgtgtctagtgtatatcaagaaaaaaatgcctttgttacagttacgcaaaaaagatttcaaatttgaaaaagaagagtttgctgtacacctaaatgctgctttgccaatggcgtttcaatcttcgatcatcgctgttggtgctatcgtgttacaagcagcactaaatagtctagggacagatgtcgtagctgctcaagccgctgctggtcgtatcgaccaatttgcaaatcagccgatgatgtcatttggtattgcaatggcaactttcactgcacaaaactatggtgcgaaagaatatggccgaatcttgcaaggggtacgtcaaactttactgatgagtgtcggatttagtctcttagcaggtgctatcgtcattttcttcggtcatttctttgttcaattgtttgttagcccatcagaaacacgtgtatttgaattagcacaaacctacttcaatatcaatgggtctctttactggatcttagcagtcctgttcattttacgctacacacttcaagggcttggacaaagcaagatccctacgatcgccggtatgatggaattgcttatgcgttcttttgcagctatcgttcttacaggaatgtggggatacccaggagcagcagcagcttctcctttagcttggatcggttctgttgccgtgttgctttactcttatatgcgttcgatgaaacaattgaaacacatgggtgaagaggaacatttcacattagaacatgcagaagcaagatag

SEQ ID NO: 1812 - DNA (genomic), 1350 bp, Enterococcus faecium; double-stranded, circular
  misc_feature (B) LOCATION 1...1350
  hypothetical: NO
  anti-sense: NO
aaaagaagcgagggaaaaatgatggaaaaatatcaaaatattgtgatcggttttggaaagggcggtaagactttagcgaaggcgttagcttcaaaaggtgaatcggttttagtcgttgaaaagtcaacacgtatgtatggcggaacatgtatcaacatcggctgtattccttctaaatcattgattttcaatggagaaagaggaatcgactttacagaggctgttgctcggaaagaaaaattgacgggcatgcttcgcgccaaaaattatcatatgatcagcgatgaggcaactgggacagtgatggacggtacagcacgttttctttctaaccatcaaatcgaagtgacgaataatggtgaaaaagtgattgttgaaggcgaacggattttcatcaatactggttctgaaccaatcattttaccaatcaaaggattgaatacaagtcgctacttgattgattctacgcaagcgatggatcaggaacaattaccggaaaaattagtgatcatcggggctggatatattggcttggaatttgcatcaatgttcaatgaatacggatctaaagttgtcgttcttgatgcccattctgaatttcttccacgtgaagatgaagatatcgcgcaaatgattttagaagacatgacaaatgcgggaatcgaattccatctaggtgtatctgtagatcaagtagcagaccaagaatcaacagctgccgtcacctttacagaagatggccaagaagtaacaatccaagcgtcaaaagttttggctgcaactggaagaaaaccaagtacagcatcacttggattagaaaatacagatgttaaactaacagatcgcggagcaatcgctgtggatgaataccttcgtacagatgcagacaacatttgggcgattggagacgtcaaaggcggattgcagttcacttatatctctctagatgattatcgaatcattatggatcagttgaagggcgagaataaacgaacaacgaataaccggaaagctgtgccttacagtgtatttatcactccgactttatccaatgtaggtttaacagaaaaacaagccaaagcacaaggcgtcaattacaaattattcaagtatatgacaagcggtgtccctaaagcacaagtattagaagatcctaaaggtgtattcaaagttttagtcgaccctgaaactgacttgattctaggggcaagtatctatgcggaagattctcatgaagtcatcaacttgatttcgctagctatgaatggaaaacttccttatacgttattgagagatcaaatctattctcatccgacaatgagtgaagctctaaatgatgtattaaaataa

SEQ ID NO: 1813 - DNA (genomic), 1623 bp, Enterococcus faecium; double-stranded, circular
  misc_feature (B) LOCATION 1...1623
  hypothetical: NO
  anti-sense: NO
ggaggaagcgaaatgactgataaattttcacgctggtccacccttttttctcaaaaccttagccgtgactggaaaaagatcctgatatggctagtcggtgtcactgctttttctggtggttttgtccctgcgtttgaagaattgacttccggacaaggattagctggattatacgaaaccttgcaaaacccggcaatgattgcaatggtcggaccaactccagcttcgaatgctgctgagtatactttaggagcgatgtatgcaaatgaaatgttgcttttttgcagtttgtttgctgctgtgatctctgttttacacgtggtgagccaaacgagaaaaaaagaagaacttggtctgattgaacttattcgttcctttcgagtcggacgtcaagcaaactctttagctgtcatcgctgaaagtattctgatcaatttgcttttagcaatatcgatcagctgtacgatgatttttttccaagcggattcgatcactgcagaaggtgcttggctttttgggctatctgtaggtagtatggggattttggggagtgccgttgcactgtttgctgcacaactgatgccaagttcagccagttcgaatggtctgtctttagcgtttttaggtggactttaccttctacgagcaataacagatgtagctgattcctccctttcgatgtggaatcctttaggctggtcttatttgacctatccatttacaactaacaactggattcctttgctttatttgtttttgttcagtctaatcttgataatcagttcatttgttttagaggaacatcgagatttgaacaccggctatatccccgaacgtgaaggaaaaccgtatgctaaacgttctcttttatccttgcgtggtttattattctatctaaataaagggatgacaatcagttggcttatcacttttggtttgatgggggcggcatacggctctatctacgggaatatgcaacagtttttagaaagtaacgacttaatgaaacagatgtttatccaatctggcgtctcaattgaaaaaaactttacaagcacgatcatggtagtcttgatttgtctagctgctattttaccaattgctagcatcaatcgtttatttacagaagaaacccacggacgtatgaatcagctgttcgcaacaaaaatttctaggaaccaactttattggaccaatatgttactagctattctatttgctatattggcaatcctgattagttctggtgcactagggctttctgctttggcttcgatgaaggatgcgaaagacatggatctattgatgtttcttaaagccgggttcaatttcctgcctgccgttttagtgtttatcggaattagtggctttctattcggatggcttcctcgaatcggtaaacttgcttatatctacttagcttactcctttgcactcaattactttggcggaattttggatttaccagaatggttttccaaaacagctgtccctagctgggttccacggatgccaaacgattcttttgatctttccgtgttccttacgttatcatgtatcagccttgcactgttcgtccttggttctattggttataggcgaagagacttactagaaggataa

SEQ ID NO: 1814 - DNA (genomic), 723 bp, Enterococcus faecium; double-stranded, circular
  misc_feature (B) LOCATION 1...723
  hypothetical: NO
  anti-sense: NO
ggaagtggcgacatgactgaaaaaattttataccagcacgggacattaggagctttgatggccggcttgatggatggaacagaaacgattgctcatatattggaaaaaggaactctgggattgggaacattgcatggacttgatggtgaagtcatctttttagatggcgtagcttatcaaggaagatcagatggctcagttgtccaattagatggaagtgaacttaccccctatgcagcaattacagattttacgccagatactagtttttctgtttcagaatctgcagatggagaacaattgaaaaaagacatcttagtaaaagaagatggggaaaatctatttttagcagtgaagataactggattattcaaaaacatgcatatccgtatcatgccgaaacaagaaaagccttatcgaagactagcaaaaatttcagagtctcaaccagaattccaacaaagcaacattcatggaacattagttgggttctttacgcctgaattaatccaaggagttgctgcagcgggatttcatctgcattttatcgatgatacacatacatttggtggacatgtaatggattttgaagtaactgaaggaaatgtggaaatcagccgcatctcgtcccttgtacagcactttccagttgatgatccgacttttgttcatgaaacgattgattatgctgatttagcagcagaaatccaacaagcagaatag

SEQ ID NO: 1815 - DNA (genomic), 630 bp, Enterococcus faecium; double-stranded, circular
  misc_feature (B) LOCATION 1...630
  hypothetical: NO
  anti-sense: NO
aaagaaggcgaaaccatgtttgaacggagtcattcagaattgacagaacgtgaaaattacaagttgctgattggttcagtcatccctagaccagtagcagtagtaacgactaaatcagcaaaagatatagtgaatatcgcacccttcagttacttcaatatcgtcagttcgaatcgacccatcttatccttggcgatccagagaaaacaagatgcagtaaaagacacagcaaagaatattcttgagacaagagaagctgttatccatatccttgatgaggacaacgtagaagaagtaaataaaacagcagccaatctgcctaatgaggaaagcgaactgtacctgactgacttgactttaactgattcagtaatcatttcagtaccagcattgacagaagcaaaagttcgttttgaaacatccttatatgaacatgtcgagatacggaataaaaataaagtaacagctgatttatttttgctagaagtacagaaatatcatttaaatgaaacagtctatgatgataagacaggaaggatcgatccaagaaaattgaatgctgtaagccgtttggcaggaaatgattatgcagcaataggagaaattttcacgattgcacgtcccgaataa

SEQ ID NO: 1816 - DNA (genomic), 1530 bp, Enterococcus faecium; double-stranded, circular
  misc_feature (B) LOCATION 1...1530
  hypothetical: NO
  anti-sense: NO
agaaagcgtttgcatataatggagggaatcacaatgacagaatcaacgtatatcatggcgattgaccaaggtacaactagctcacgagcaattatctttgacaagaaaggaagacacatcggcagttctcaaaaagagttcacgcaatatttcccgcaagaaagttgggtggaacatgatgcaaatgaaatctggaattctgtacagtcagttattgccggagcgttcatcgaatcagggatcaaaccaaatcagattgctgggattggcataacgaaccagcgtgaaacaacagtaatatgggaaaaagatacaggacgtccaatctatcatgcagttgtttggcaatccagacagtcagctggaattgcagataacttaaaaaatgaaggctatcaagaatttttccacgaaaaaacagggttagtgatcgatgcctatttctcagcaacgaagatacgctggattcttgatcatgtagaaggcgcgcaagaacgagctgaaaaaggcgaattgatgtttggaacgatcgattcttggttagtatggaaactgaccgatggacaagcacatgttactgattactcgaatgccagtcggacgatgttgttcaatatccatcagctagattgggatcaggagattttagatttactaaatattcctcgagtgatgttaccaaaagtcacttctaactcagaagtttatggttatacgcaaggttatcatttttatggaagcgaagcaccaatttcagggatggcaggagaccagcaagccgcattattcggacaaatggcattcgaaccaggcatggtcaagaatacttatggtacaggttcatttattgtcatgaataccggtgaaaaaccgcaattatccaaaaataatttattgacgacaattggttacggcataaatggaaaggtttactatgctttagaaggaagtatttttgtggctggttcttcgattcaatggctgagagatggacttcaaatgttgcaaaaagctagcgattcagaagacgcagcgaaacgctctacaagcgaagatgaggtttatgttgttcctgcattcgttgggctaggtgctccttattgggatcaggcagcacgaggggctatgtttggcttgacacgtggtacgacaaaagaagatatcattaaagctactttacagtcgattgcttatcaagtgagagatatcatcgatacgatgcaagatgacactggaatcaagattcctgtattgaaagtagatggcggtgcagcaaacaatgaatatctgatgcaattccaaacagatatcttgaatgtaccgatccaacgagcagaaaacttggaaacaacggcgctaggggcagcatttttagcaggattagctgtcggttattggaaagatacagacgagatccgcgaattttatgaagctggcaagctatttgaagttcaaatggaggaagagcgccgagaaaaactttacaacggttggaaaaaagcagtaaaagctacccaagcatttgaataa

SEQ ID NO: 1817 - DNA (genomic), 384 bp, Enterococcus faecium; double-stranded, circular
  misc_feature (B) LOCATION 1...384
  hypothetical: NO
  anti-sense: NO
tggaggcgttttagaatggaaaaatttcagccgatcatcaatcaaatcaaagaaaaagaacatcaacaaaagatcaaagacctttttgctaagataacagaaacgtatccccagctagacacaactgtaaaatggaaccaacctatgtttactgaccatggtacctttattattgcatttagttttgctaaaaatcatttttctatcgcaccggaaaaagcagcgattcgtgcccttgaaaaaaatatccaagaagcaggctacgtatatacggataacgtcatcaaagttccttggaaaagtgtaatcaactgggaattgattgaacaattgatttcatttaatattgaagataaaaaaggtcatgataaattttggcgataa

SEQ ID NO: 1818 - DNA (genomic), 780 bp, Enterococcus faecium; double-stranded, circular
  misc_feature (B) LOCATION 1...780
  hypothetical: NO
  anti-sense: NO
gaagaaagcctagaaggatcaaaaccaatgattatcaggaagcctaagaaaaagcgaatcatgggtaaatggatcattgctttctggttactttcagctgtaggtgtcttacttttgatgcctgctgaagcgagcgtggcgaaataccaacaaaatcagcagattgccgcaatcgatcgaacaggaacggcagcagaaacggattcttctttggatgttgctaagattgagttaggcgatcctgttggtattcttacaattccaagtatttctttaaaactaccaatttatgacggaacgtccgacaaaattttagaaaatggtgtaggtattacggaaggaactggtgatattacaggaggaaacggtaaaaatcctttaatcgcaggtcatagtggactttataaagataatctttttgatgatttaccttcagtaaaaaagggagaaaagttttatatcaaagttgatggtgagcagcacgcttatcaaatcgatcggattgaggaagtgcaaaaagacgaactacaaagaaactttgtcacttacttagaaccaaatcccaatgaagatcgagtaacgctaatgacatgtacgcctaaggggatcaacacacaccgttttctagtgtatgggaagcgagtaacctttacaaaatcagaattaaaagatgaagaaaataagcaacaaaaattatcttggaaatggcttttaggaagtactgtttttctttcagtcatgatcattggttcgctatttgtttataaaaagaaaaaataa

SEQ ID NO: 1819 - DNA (genomic), 246 bp, Enterococcus faecium; double-stranded, circular
  misc_feature (B) LOCATION 1...246
  hypothetical: NO
  anti-sense: NO
gggagtttagagagaatgtgtaattctattgtcactattcaagagaaagctgaagaagaattaatgagaattgaagcggaatataaagaaaagagaaaagcgattaagcgcaaaaaaaatgcagagcttaaaaaatataaagaggaacaagcgttaaaattaggaatgatgttgtgtaaatattatgattgctatgatataaacgaagtgctaaaaaaagcgaatttaaaccaattttgtgaatag

SEQ ID NO: 1820 - DNA (genomic), 726 bp, Enterococcus faecium; double-stranded, circular
  misc_feature (B) LOCATION 1...726
  hypothetical: NO
  anti-sense: NO
tttcacttagatatcatcgttgaccgtatgcgtcgtgaattcaaagttgaagctaacgtaggtgcgcctcaagtatcttaccgtgaaactttccgtgctggcactcaagccgaaggtaagtttgtacgtcagtctggtggtaaaggtcaatacggtcacgtatggattgaatttacaccaaatgaagaaggtgctggtttcgaatttgaaaatgcgatcgtcggtggggttgttcctcgtgaatacattccagctgttgaaactggtttgaaagatgctatggaaaatggtgtcttagctggctatccattagtagatatcaaagctaaactttacgatggttcataccatgatgtcgattcaaatgaaactgccttccgtgttgctgcttctatggcattacgtgcagcagctaagaaagctaatccagtaatccttgaaccaatcatggctgtagaagttgttatccctgaagattatttaggtgatgttatgggtcacgtaactgctcgtcgtggacgtgttgaaggtatggaagctcgcgctggcggccaacaagttgttcgtgcgatggttccacttgctgaaatgtttggttatgctacaactcttcgttctgctactcaaggtcgtggtacatttacaatgacatttgaccactacgaagatgtaccaaaatcagtacaagaagaaatcattaagaaaaacggcggacaagctgaataa

SEQ ID NO: 1821 - DNA (genomic), 477 bp, Enterococcus faecium; double-stranded, circular
  misc_feature (B) LOCATION 1...477
  hypothetical: NO
  anti-sense: NO
gccaaattagaacgttatttcagtgacgaaccggatgcaacggggcatgtgaacttaaaagtttatacaggaaaaacagcaaaagtgggagtaacgatcccattacttattcttgtattacgtgccgaagaaatttctccagatttatacgcaagtatcgatttggttgttgacaaattggaacgccaaatccgcaaattcaagacaaaaattaatcgtaaatcccgtgaaacgggcatgaatactgcagatgctactgctttattcaatgaagaggacgaaaacgaaaatgattctgaattagatatcgtacgtacgaaacgcctttcattgaaaccaatggatagtgaagaagcagtcttacaaatgaacatgctgggacataacttctttatttttgaagatgcagaaacaaatggtacaagtatcgtttaccgccgtaaagatggaaaatacggactgattgaaacagactga

SEQ ID NO: 1822 - DNA (genomic), 462 bp, Enterococcus faecium; double-stranded, circular
  misc_feature (B) LOCATION 1...462
  hypothetical: NO
  anti-sense: NO
aacatgttagaaaaatcttcaaaagcatgcgatacgaataaagaaaaagttactgataagtcacataatgaacgcattccttgggaccagtactttatggctcaggcagtactgttatctttacgtagtacgtgtacacgtttagaagtaggagcgacactcgttcgagaaaaaaggatcattgctggcggctataatggagcagtcagtggagatgtccactgcatagatgaagggtgttacgtcgtggatggacactgcttgcgaacgatccatgcagagatgaatgcactcctacagtgtgcaaaacttggtatcccgacggaaggttcagaaatctatgtcacacattttccatgtttggcctgtacaaaggctttgttgcaagctggtgtgaaagggatcaattatctccatgactatcgaaatgatccttatgcccaagcgttgatcgaaaaataa

SEQ ID NO: 1823 - DNA (genomic), 999 bp, Enterococcus faecium; double-stranded, circular
  misc_feature (B) LOCATION 1...999
  hypothetical: NO
  anti-sense: NO
agcatgttagaatggtcggaaaataaaagacaagcaatggaacgtctatcgacgccagaaggcattattaccgctttggcgatcgatcagcgaggcgcgctgaagaaaatgatgtcggctttagggatggaagcgacaaaggaaaaaattgagcagtttaaaacactaatttcccaagaattgactccttatgcctcagcaattttattggatcctgaatacggactgcctgctgcacagaagcgtgcagcagcgagcggtctgctgttggcatatgaaaaaactggttatgatcaaaccgtacccggccgcttgccggatctgctgtcggactgttcagttctgcgattgaaagagttaggtgcggatgcggtgaaatttttactgtattacgattatgaagaagcagaggaaatcaatcggcaaaagcaagtttttgttgaacgaattggaagcgaatgcatggctgaaggactgccattttatttagagttattgtcatatgatgctaaaaatgtagatacgaaatcgctttcctatgccaaagcaaaaccgcgcaaagtgatcgaaatgatgaaagaattctcgaaaacccagtataaagtagatgtcttaaaggttgaagtaccagtaaacatgtcatttgttgaaggaaatgcaacaggggagatcgcctatacacgtcaagaagctgccgcttattttaaagaacaaagcgatgcaacagatttgccgtatatcttcttaagtgctggggtatcagcggcattattcatggagacattgcgttttgccaaacatgctggggcacgattcaacggtgtactctgtggcagagcaacttggaaagatgcagtcgctcctttcgttgaaaaaggagaagcggcaactttagaatggctgacagaacaagggacacaaaacattcgtcaattgaatgaagtgataagagaaactgccatcccatggtatgagaaagtaagtgaaagcacttgttaa

SEQ ID NO: 1824 - DNA (genomic), 192 bp, Enterococcus faecium; double-stranded, circular
  misc_feature (B) LOCATION 1...192
  hypothetical: NO
  anti-sense: NO
agaatgttagaagaaaaatctctaaatacttataattattttataagcaaaaaaatgctatcggtagtatcaccgatagctgaggaaagtcacagtagggactatttgattaaaaaatatgtttattcaatccatctatttatttttgccttattaacatattgtaataatgtaagcaacaatgtattttaa

SEQ ID NO: 1825 - DNA (genomic), 420 bp, Enterococcus faecium; double-stranded, circular
  misc_feature (B) LOCATION 1...420
  hypothetical: NO
  anti-sense: NO
aaggcgctagaagcattactagaagcacacttgttggtggtcatgcgggcggaaatgggggaattaaaaatgattgattacaatgatcgtggacgtttaaagtgggcagggttttatttatctgatcatactgaagaaattgatgccgacaatgaacaacgaaccagtcaaaatttagcaaaagaacaaatgacgactgaagagattgcggaagtattgaacgctgcagtcataaaaaatagatcagtatctattcaaaaagaagaacgaaacgctgaaggatactatccagaagatatcattggcaagatcttaggtagtgatgagctggggatctacgttggaaaagacaaaattcactacgacgaaatacgtcatatcgaattttaccaggataataaatggagtcgattagaatga

SEQ ID NO: 1826 - DNA (genomic), 1290 bp, Enterococcus faecium; double-stranded, circular
  misc_feature (B) LOCATION 1...1290
  hypothetical: NO
  anti-sense: NO
tcagctatagaagttttttttgtagaattttgctatactgttatcaagctaataaatggagatgaaaaaatggatcaaaaagattttagagaaaatcttgaattaaaaccggtcactcaagaacatatcgatcaattcaatgaattgctttcctatgtgttccaagtgactgaagcagacatcgaggaaagcgggtttgagaataaacgagcttttatccgttccaaaaaaccgattttggaagtatcgaaagtgttcggatggttccacgaaaataaactgatctctcaaatcgctatctatccttgtgaagtcaatattcacggtgcacgttataaaatgggtggtgtgactggagttggaacttatccaaaatatgctaaccatggattgatgcaagatctaattatcgttgcattggataatatgcgcaagaataagcaatggatctcttatttgtatccttacagtatcccctactatcggcgtaaaggatgggaaatcatgtctgataaactttcctttaaaatcagagatacacagctacctaaacaaatcccagtaagtggtatggttgagcgattaccagttgatcatccagacgtattttccgtttatgacaaatttgcccaacaaaaccatggtgctttattccgcagtgattttcattgggaagagtattggcgtttcgaaaatgaagatgagcgcacagccgctgtctactacgatagcaaccatgaaccaagaggtgttctgttctactgggtagctgaagaaatatttcacgtaaaagaaatgttctatcttgatcaagaagctcgaaatggcttatggaactttatttccgcacatttttccatgatctactgggtacatggagatatttataaaaatgagcctttagcatttttgattgaagatagtcagatcaaagagcagatcgaaccatattttatggctcggatcgttgatgtaaaagaattccttcaacggtttccgtttgttggaacagctgatgcttttcatttcatcattgaagatcctgtcgctccttggaataatggtgtcttcgctttaacatgggatgaacagggacaagtccgtgtcttaaatgaacctataggaaaatccgttcgactggatatccaaacattgacttgcttgatgatgaattatcgccgtgcttcttatttggcaagaatcgaacggttagaaacagatgaagaaacactgaagtcactagagcgtatcattccaaacatggaagcttactttagcgattatttttga

SEQ ID NO: 1827 - DNA (genomic), 348 bp, Enterococcus faecium; double-stranded, circular
  misc_feature (B) LOCATION 1...348
  hypothetical: NO
  anti-sense: NO
ttttatatagatagcaaggagtttttttatttgaaaaaagtgcattcatttttaaattatcttatgggagcaatcacgattgtggctgtgtaccaagcatttctaaagtatcctgattacgggacgaagttgttgtcattgacgcacaatcaaacagcatattcaccaacgttgattttatcgactttgactgcaggagctaaaagcgctacttatttttttcataaaacgacaagcatgctaaagcgaaagaaacagcgaaaacaattgttggtggtggtagcggctatgatcattatttattttctaccagttattacacaagtatttcatcaatattttggttaa

SEQ ID NO: 1828 - DNA (genomic), 1812 bp, Enterococcus faecium; double-stranded, circular
  misc_feature (B) LOCATION 1...1812
  hypothetical: NO
  anti-sense: NO
gctagtatagaagcgaagggngaaataggaatgaagaaaacgatttttggatttgcagcgctgatgtctgctgtcgttcttgcagcatgcgggggcggaggtacagatacctctggaaacaactctggaggcaacggcaataacaaagaggaattaacttttccaattgcaacaaaaaataatgatgatgcaatcgaagacggcgaattagaagctgcggtcgcaacggacagtcagtttaaaggattgttccagtgggagttttaccaagattcatatgatgcagcttttatggctccttctcatgaaccgctatttgcaaacgatgacgatttcagaatcacagacgacggagctgcaacgcttgatctagatgaagatacgaaaaaagcgacaatcaaagtaaaagacaacgtcaaatggtcagatggtgaagatgtaacggcggacgatgtgattttcccttacgaaatcattgggaataaagattacactggtatccgttatgacgacactttccgtaacatcgtaggtatggaagaatatcatgatggaagtgccgacacaatctccggaatcaaaaaaatagacgacaaaacagttgaaatcgaatataaagaagtaaacccaagcatgcttcaatcgggtggtggtatctggtcatatgcagcaccaaaacatacgttagaaggtgtagcaatcaaagatatggaatcaagcgatcaagtacgtaaaaatccagtgacttttggcccttattacatgagtaatatcgttgcaggagaatcagtagaatacttgccaaacgaacactactggaatggtacgcctaaattgaaaaagatcacgatgaaatctgtaccgatggcaagtgcaactgaagcattgaactctaaattatatgatatgattttccaaatgccaacagatacttacgatacctataaagaaattgctggctatacaaacttaggccgtgaacaaacttcttatacttatctaggattcaagttaggtaaatggaatgcagatacaaagagtgtggaatacaatccagattcaaaaatggctgataaatcattacgtcaagcaatgggctatgcattagataataatgcagtaggtgaacgtttctatgcaggtttgagaagcaatgcgacttcattgattcctccagtattccagtcataccatgatgatgagatgaaaggattcacacaagatctagacaaagcgaaaaaactattagatgatgctggctacaaagatgtggatgacgatggtttaagagaagacaaagatggaaataaactaacaatcaactttgcttcgatgtccggtggggaaacagcgcaaccattggcagattactatatccaacaatggaaagaaattggtttggatgtccaatacacaacaggtcgtctgatcgaattcaattctttctatgataaattagaaaacgatgatcctgaaattgatgtttaccaagctgcttggaatacaggaactgatccaaatccaagtggactatggggaccaaatgctgcgttcaactacactcgttatgaatcagaagaaaatacaaaattgatcaacgatatcagttcaagcaaagcatttgatgaagagtaccaaaaagaagcatatcaaaaatggcaacaatatgcatttgaagaagcatttgcgattccaacgttgttccgtaatgaagtattgccagtcaacgaccgtgtcaaagactgggattggtcttatgatgtaccaaacccatgggcaaatgtttctgttacagcagattcacgttcataa

SEQ ID NO: 1829 - DNA (genomic), 336 bp, Enterococcus faecium; double-stranded, circular
  misc_feature (B) LOCATION 1...336
  hypothetical: NO
  anti-sense: NO
aaaagtatagaactactaggaggaaccaacatgacaaattatgacggtgaaaaacacaaacgattaagaggttcaatggcccctaaaacagaagaagaagtggctttagcaggaactaattctggtgaaacagaagacaaagaagaatcattagctggcacaaactctggtgaaacagaaaataaagaaacagctttatctggttcaaattctgtagaagaggaaacaaagcctaatgagcccaatcactttgaaaaagatatcgaaaaagcggttgaagatgtcaaagaaaaatttgaagaactgacctcaaaaaataaacatgatcatcattga

SEQ ID NO: 1830 - DNA (genomic), 264 bp, Enterococcus faecium; double-stranded, circular
  misc_feature (B) LOCATION 1...264
  hypothetical: NO
  anti-sense: NO
gaaacaatagattataaagaggattattttaaaaggagtaaagaatcaggaggtgagagaatggaaacaaaatgtgatttcatggtaaatcgtgcaattttgatagagatgggctttaaacctagtcaagctgcacgaatgattaaagagagcaaggcatatcttgcaaggattgaaggtattgatttttataataatcgccaagttggtgtggtgccatcccgagtaattgaacatctttttcacattcaagttgcggaataa

SEQ ID NO: 1831 - DNA (genomic), 438 bp, Enterococcus faecium; double-stranded, circular
  misc_feature (B) LOCATION 1...438
  hypothetical: NO
  anti-sense: NO
gagatgatagacgaacaaaacagaaaggagacgaaacaaatgaatagtatggtttttgttaattttcctgttgctgatgtcaatcgttccgttgctttttatgaaaagctgggttttaaaaaaaatgaagaattttctactgaagaagctggttcaatggtatgggatgacactttttggataatgcttctctctcatgatttttataaaaaatttataaaagataaagaaatagctgataataaaaaaacaagtggtgctttgatttcgtttagtgttgaaaatgcggatgaagtaaaaaaatttgctcaaattgcaaaagaaaatggtggtactttccacgaagtagatatgggaatgcctgaagaagaaatgttttcattagaagtccaagatctagacggaaatacattagaacccgtatggatgaagatgtaa

SEQ ID NO: 1832 - DNA (genomic), 918 bp, Enterococcus faecium; double-stranded, circular
  misc_feature (B) LOCATION 1...918
  hypothetical: NO
  anti-sense: NO
ggagggatagacgtggagcaatcgatttttttaaaaaaggaacatcaacaagtagaaaaagaattgtattttgatttttgtggtttctctaaaacgatgccgtttcattcttttggtcctgctattcgcaatgattacatcctgcatgtcgtgatggaaggcaaaggatcttatcatgtgaaaaatcaacaattccaattgaaaaaaggtgatctgttcttgattcgtccaggagactcgacgttttacttatcagatggagaagatccgtggatgtattgctggctttcatttggtgggagtgctgcagaagaaatcattcggcagtcgcttttcagagaagaccaatacacgatggtctcttctgacatacaaaaatatatcgacattattttagaatgcatgaaagatacggaagaaaccttggaaaatgaattacagttaacagcattaacctaccgttttttatcagtccttttaaaagatggcggaaaggtcagcggtggtgtacaaaaggttcattcctctttagctgttgaaacagtcaaatacatcgaggcacattatgctgaaaaattgtctgttgaggaaatcgcccagcatttagcggtcaatcggagccatttgtcgcgagtattcaaaaatcatatgggtaccagtatcaaggaatatttgatcggggtacggatcaatcgaggggcgtttcttctttctctgacggatgaatccgtggaaagtattgcctatcaagtagggttcaatagtctagtcgtatttagccgaatgttcaaaaagagtaccggagaaacggctacgaactatcgtaaacgtatgaaaaacgaaaattttaagaatattgctttggataccttgaaaaaacagttggaaaaacaaaccgcagtttcttggacaacctga

SEQ ID NO: 1833 - DNA (genomic), 183 bp, Enterococcus faecium; double-stranded, circular
  misc_feature (B) LOCATION 1...183
  hypothetical: NO
  anti-sense: NO
ctacttgtagatagatcgcctttctgtacattttccacttcttcttcatcttcaaagtcaaagatttcttctgtttcttcttcattttcagaaacagtttcaatttcttctacttcttctgtttcttcagaagacacaactaattcttcgatctcttcttgttcttctaattcttcttcataa

SEQ ID NO: 1834 - DNA (genomic), 489 bp, Enterococcus faecium; double-stranded, circular
  misc_feature (B) LOCATION 1...489
  hypothetical: NO
  anti-sense: NO
gcatatgtagaattttttagaaacattccattattaatcatcgtgatgtttttttatgttgtcgtaccgatttattggtttaatctagatggattccaagcaggtacgattggattaacgatctatacatctgcttttattgctgaaacagtacgttcagggattcaaaccgtaccaaaaggtcaaacagaagcaggactatcttctggttttacctattcagaaatcatgcgttatattgttttaccgcaagcattcaaaatcgttatcccgccattaggcaaccaatttatcaacctcgtaaaaaactcatctattttagcaatcgtagctggtttagatttgatgtatcaaggagacttgatcgctagtgaaacattcaataccttcgatacgtatatcatcgttgggttattttacttagttatcacgctaccgttatcttacttaatggtttatcttgagaaaaaatgggcggttcgttcatag

SEQ ID NO: 1835 - DNA (genomic), 252 bp, Enterococcus faecium; double-stranded, circular
  misc_feature (B) LOCATION 1...252
  hypothetical: NO
  anti-sense: NO
ttgatagtagaggtgaactgtatgccaacaactttagcttcaatcaagaaagatttagaaggtcgtatcggcagcccaatcatgttggttgctcagacaggaagaaagcgtcaaacagaacgccgcggcgttttaacagaaacctatccttcagtattcgttgttgatttggatcctgcagcaattcttttgaacgagtatcttacagctattcagatgtacttactcggacagttgagatcgaatttttaa

SEQ ID NO: 1836 - DNA (genomic), 2283 bp, Enterococcus faecium; double-stranded, circular
  misc_feature (B) LOCATION 1...2283
  hypothetical: NO
  anti-sense: NO
ccagactcagatgattgcagatggctggcaaggatatgtcatccagaatctggtggaaaatttatatcgttcggcagaaacaggagaagttattaccttatgaaagtagaagaaaaacagtttgatttagagtatatcaataagtatgcgagtcagatgaccattggaaatggattttttggtatcagaggaagccaggaggaagactatcggaatcaagtaaggggaatgtttgcagctggtgtatataaccgacctttaggagcagaatcagccgagttagtgaatctcccagatgtcatcagatgggaaataaaaatcgacggtgaacatttttctcttgagacgatgaaagttcttgcatacgagcgggcactagatttagaaatgggagagcttaaacgctatgcgctcattgaaactgctcaaggaaaaaaagtggaagtcattacttgtcgtgttgctgatcaaaataatctccatcaggcagccctgaaagtggtcatcaagccgttgaccgaagactgccaagtagatgtgaaaacgggtatcgatggacagcaaaccaattttggtacacagcagttggttgaaaaagaactgcgagtatttggtgacgatttgatcagtgcatcctaccagacaacagaaagtaaaattgatattgggattgcagctaaattcaataaagcaggtgtattccaagcaaaaaatcgccggatcaccgcttccttttcagaaaagatcagaaaaaatacgtcctttacgctggagaagatcatcgtgctctctacctctcttcagcaaacagacccgtttaagaaaagtattgcccaagcccagaaaagcgttagttatacagaaattttagagcagtcgatgtcttattggacagatttttggcatcagcatcggataacgatccaaggcgattcttctttcgatcagttagcgatggacttcgctgcttaccatttacagattatgactccccgcaatgatccaagtgttagtgtaggggcgaagggactaactggcgaaggttataaagggcatgttttctgggatacggaaatttttatcctgcctttctttttatatcagtttcctgaagtagcaaagaatttgctgctgtaccgttatgatcgattagaaggcgcacggcaaaaagcaagagattatcactatcaaggtgcacttttcccatgggaaagcgcacacactggtcaggaagagacacccaaatttgctgcattgaatatcaaaaccggaacaagacaagaagttgcttcagctgccgcagaacatcatatcagtgcagaccttgcttatgccgttcaagagtatgtccaagcaacagaggatcaatcgtttttagaaacaaagggaaaaacgctcattcatgaaacagcagctttttggctgagcagagctgtaaaagtcgatgatcatttagagatacacagagtcattggtccagatgaatacacagaatatatcgacaataatgcatatacgaactatctggcgcattataatgtggccttagctgttaaatatcaagctggcgatccgctttttttgaaagaatgtcaaaattttttagataagttatatttgccagtgcctaacaaagaacagctgattccgcaagatgacacgtatctcagtaagccagttattgatttgaccacttacaaagaacgtcctggcagccagtctattttacttgattatgcccgtagcgaagtaaatgaactccaagtcagcaagcaagcagatcttgtcatgctgttatacttattacctgagtatttttctcaaccaatcgtttctaagaatttgcattactatgaaaacaaaacaatccacgactcatcgttgagtaaagcgattcacgccatagaggcttgccgtatccaagaaatggaatgggcgtatcatttattccaagaagcgtgcctgattgatttaggaccagatccgcattcatcagatgacggaattcatgctgcttcattaggagcactatggctagcagttatatttggtttttcaggtattacagtaacgaatggaactctttctatttctccaagacttccttcagcatgggaaaaaatttcttttccttttatttggaaaaatcacaggttgctatttgttttgacaaaaaaacaaatagtaataaaaaaagagacgaaagaaacattacctatttttgtcaatggagaccaataccagctggaaaaagaactgatcttggaacggaggggaaaataa

SEQ ID NO: 1837 - DNA (genomic), 213 bp, Enterococcus faecium; double-stranded, circular
  misc_feature (B) LOCATION 1...213
  hypothetical: NO
  anti-sense: NO
gcccaatcagatgaaaaatatggagtgctatttttatctgattgttcttactgcttgatgcagagcagctttttcacaacctctccactaaacggtgttctcctgccaactcctcggtcacaagtcacaatattcaacaaacatgagaagctgttttttgaaattgttccttgtgactcggagctaaacggcaggctcacaacctcttggtaa

SEQ ID NO: 1838 - DNA (genomic), 220 bp, Enterococcus faecium; double-stranded, circular
  misc_feature (B) LOCATION 1...220
  hypothetical: NO
  anti-sense: NO
tccnccagaaaantntgttgacggcgctacgacgagncaacagatgctcgtgcttttgtgcgttggcattatgacaagaagaggaattgcatatatgccattgatgaactatacgaggttaaatgtagcaatcgtcgtgcagctcaatggattaagagcaataagtatcactaccaggacatcatcgcagaggttgaacctaaatcaaacgctgagatga

SEQ ID NO: 1839 - DNA (genomic), 792 bp, Enterococcus faecium; double-stranded, circular
  misc_feature (B) LOCATION 1...792
  hypothetical: NO
  anti-sense: NO
gggattacagaaggcgatattccgttggcttcaacagatccactaggggggattcccagcattgtaatcgggccaatgacaggaagtgtgatcgcgatgctttcaggagtgacagatcatgtagctcatggcggtccgatcgtagcggttttaggagcagtggatcacgtagccatgttttttgtagcagtgattgctggtattgctgtaaccgtgctaatgttaagaatccttaaaccgacattacaacaaactgcggttgctgcagcaaatggtgtgacagtagcagatctatcagagactgaaacaagtgatgtttatacgaaaactgaaacttttgattctatcacggatattatgtcagatgaagcaatcgttttaggtgaaacagcaacaacaaaagacggagtaatcgaagatttagtccaacgtttagaaaaaacagcggcgatcacagataaaaccagatttaaagaagtcatctatgatagagaacatgaaagtacaacgggaatcggtatggggattgctattccacatggaaaatcagcttatgttcttaaaccaacagtggcatttgccagaagtcaatctggggtagattggcattctttagatggaaaacctgcacatatgatctttatgattgctgtacctgaaaacagccaaggtgatatgcacttgaaaatactgcaacgtctatcacgtaaattgatggatgatgacttccgtcaagcactgatggaagcgccagataaaacaacagttcaccaattattaagcgaaatgtaa

SEQ ID NO: 1840 - DNA (genomic), 1758 bp, Enterococcus faecium; double-stranded, circular
  misc_feature (B) LOCATION 1...1758
  hypothetical: NO
  anti-sense: NO
tctttaacagaattttataaggaggaaacacaaatggaaacatcaatgattaatattccaatttatgtagataaagaaaaattattagagaagccagttacaaaaaaagaaaaaactgatgtaagagataggtgtttagataactatagagaagttacaagagatgagtttgtagagatactaaattcatcacaatcatttattccaagcaagacaaagaataaaggcaatgacaaggagagttttgtggaaaccagagtaattattctggatgtcgataacactgttaaagatgagaaggggaaggtagtagatttgagtaaagatgatagtagatacttaagcatagaaaaggttttatctatcaatttagttcataattctgcgtttgcgatacaaaaaagtattcggtactctgaaaatctaaaaaaatacaagattgtctttctattaaaagaagcaattactgactatggtaaaatggttgctgtttacgaatacttgaaaaagaacatccccgggtgtgatgacaatgtaaatgcttcgaatagaatgttttttggaggatataagtcagatgcagtgataataattaatgaagacaacatgttagatattactgagcttccgattgattttaccatgacatgttctaaaaattgtcaaagtgattcagggagagagtatgaactagtcaatgaaaccgattttgttaagttgataaaaaatgacgacaaagaagaaatgaaacagtggtttaaagactgcctgtttgattcctccgacatgtcttttaatgagatttatgaaagattgttaaccattgatatgaataaattacttaagtcaagtaaaaacttaagatgtctgtttcacaacgatcataatccctctgctagtatttttaccagtaaaactgggcattccattttttattgtcattccagtaattgtgatatcagtgaaaattttattggagttgtgatgctaattttaaagaaagacagtcgggtagaaacatttaattggctattagagaacctagacttgtatcctacacattttcgaaaattgaaagaggaatcaaaagtactttttgacactcttgaatcaatgaaagacaaacttttcaggacaataaggaattatctagaggaaatgcgacgtgtctatgatgtcttgctttctgatgttaatttttttgatgatagtaaggaaagtgtgacttgtattttgtcgggggaacaattagctaaaaaaatgagttcttactatggtaaaacttatgacatagataaatgtaataagttactatcacttatgacttttataggattgataaaaaaattagatgatgaagatgttcctttgaagatgctcgaatacctaaataggttaaaggaagagaaagcgttaggaaactttaaacataagagaagcaatgtctatcgattagacgtttttaatgcaacttctgtgattcaaaaattgaatgaagatatccttccacttctggaaaaatttcattttacatatcaatatttttcttatgaatgggttaagatatgttttaacgaaaaagaggctaaaagagtatttcctcaaaattcccgatcagaacttagcaaggaaaaacaattgattttagatgaagcacatgaagttttacagggcttatcgtggcaagggacatatctaatgacagaaaaaggacttatttacactgtttgtgaaacgcctacgaaatgtcagggataa

SEQ ID NO: 1841 - DNA (genomic), 543 bp, Enterococcus faecium; double-stranded, circular
  misc_feature (B) LOCATION 1...543
  hypothetical: NO
  anti-sense: NO
ggagtgacagatatgaaatggaatgaagtaaaagtagaaactgaaagtgaagcagtcgaagcagttgctaatattttgatggaggcaggggcgagtggtgtcgcgattgaagattctttagatgttgaacattttcagtcggatcaatatggtgagattttagataaaaatgattttacatcgctgaaagaaggcgcactagtcatggcttattttccggaaacgactttcttaccggaaatcttgccttttatcaaagatcgtatcacacaattacctgagtttggtctagctattggaaaaaataaagtaacagttagtgaagtagaggaaagcaactgggcccccagcctggaaggaatactatcatccggtgcgttttacgcgaatgctgacggttgcgccaagctgggaaaactaccagacagaagatcctctagaaaaaattatcacactagatcctggtatggcatttggcacaggcactcatcccacgacttccttgacattgacagcactagaaacagtcttgcgtggtggtga

SEQ ID NO: 1842 - DNA (genomic), 1029 bp, Enterococcus faecium; double-stranded, circular
  misc_feature (B) LOCATION 1...1029
  hypothetical: NO
  anti-sense: NO
actaagacagaagggaatgagaaaatggatatctatttaaaaaaagcaattctgcatattattgacagagaaactggttctccagtcttttcacaaaaagagctggatctgacaaaagaatatattcgtgattttcttcaaaagaagatccaaaaaatctcttctgctcaaacaaaaactggacaactagcagaagaaagcatgatcgttgaatcacttaaaatcgctcaagaaaattttgtggaagcaagtgaagcaatcgttcagcggtggttcgatatctaccaagaaagtgaagaagcacctagtgcagatgtatttgttgtcttgtatgaattagatacagtgatgtacttatctttattgaaagtcaattatcgtgaggcttacactcactttgttgaagcagacgaagcagggatcgacaaccgcttgattttgaatcgagcaattctaggggcgaaaacacaaaaagcagatgaagcattcgctgtgaatttgactgattggacctacgaattaattgaaaaaaaatatgagttttctggcaaaaaagagctttatttttctggaagagtgatcgaaagtgttcctgcaccttctttagaagaaaatgtaaaagtgatccaaaaagtagccaagcatcttggaaaaaaatttgagacagaagaatttgatatcatggctgatttgaaagaagctgtctatgatacgatagaagaaaaaggtcggttggatcatgagatgattgcggaaaaagtcttcaaggaaaacatcacggcaaaaatggcttttaaagaagaagtacaagagcaaggatttgtcccagaagcacctcctgtaaaagaagtacaagaaatttctgagaaaaaatttggaaaacaaaaattcaagctatcaaacgggatcgaactgatcgtaccagtagatgtatatcgcaacccagatttgattgaatttgtgaataatccggatggtacgatatccgtgatgatcaaaaatgtggatgaagtattgaatcgtttataa

SEQ ID NO: 1843 - DNA (genomic), 285 bp, Enterococcus faecium; double-stranded, circular
  misc_feature (B) LOCATION 1...285
  hypothetical: NO
  anti-sense: NO
aataatgcagaatcgctatcaaaacgtcgggcgatcgtatttgtgatcatcaatacaactattcntgtcgctctattttctatttcaggtacgcctgcttctgctggtttcggcgtggtcggacttgttggtccgttggcttctttaaatgcagggctaaatggctttcttgttgttctttgttggttagtcatccctgtgtttgcggcactaattactcaatttttatgcgagaaagtatttaaactgtatgatcgagaagaagtcttcaaatttttaggctag

SEQ ID NO: 1844 - DNA (genomic), 756 bp, Enterococcus faecium; double-stranded, circular
  misc_feature (B) LOCATION 1...756
  hypothetical: NO
  anti-sense: NO
cttgatgcagaacagctttttcacaacctctatttgtccatatcgcaaaattcaggtagaatacaaaagataacggaaagaggcgaaacaatggaacttggaaaatcagattatcagttgtttgatcgaccaatctacgcattcaaacagctcaaagagagccatccaacagataagattgaacaaatcaagaaagaatataaagaacactggcaaaaatggaaagagattcagctccagacagctgcacttttgcctgatatgtacggcatgagcaaacctaaaatcgaaagctggacgaatggctggaatttacgcagtcatttttggagcgcgtaccgaagcgaatctcgtcaagacgagaatgcctgtctagcagttttgttgaatcaaaaacaataccaaatctatttgatgtaccaacattataaaagcgaagaacgatatggtagcattgcagcgtataaccagttgcttgcgatactgaaagagtggagcaaaacagtcgatatcaaggattattacatatggccgcaaccagaacatgaacttgacgaccacttagctttgtctgactatttgtccgatacaaagaaacaagaagagttgaaaaaagcgatgagagaccgaacctttcaaatgggtaaactattcttctatccgcaagaaatcgaacacgttgagcaaataaccgctgaaaccttacaagaactagcaccactatatcaaaagctaggtgcggaaaaatttcaatag

SEQ ID NO: 1845 - DNA (genomic), 900 bp, Enterococcus faecium; double-stranded, circular
  misc_feature (B) LOCATION 1...900
  hypothetical: NO
  anti-sense: NO
ctattggcagattatcagggggaggtttcaatgaatcgtccaaggaaacattctgacttaaaattagccatgggacttttagcaccaagcatgcttttattagctgttttagtgctgattccaatgctttccaatattcagatcagttttttcgatatgccgctgaatcctaactcagacgccgtttttatcggattaagcaattatcttgaaattttaagtgatagtgaattttatcgttctttaggtttaacagttgcttacacattcttagttgtagcaggcagtacagctttaggattagccgtagctattttgcttaaccgcaagttcagatttaggaaaacggtgcgttcactgattttattaagttatgttacgccatctatttctttgatttttgcttggaaatatatgttcaataatagttatggaatcgtcaatgatctgttagtagataggttgcagcttttcaacgaagcaccgctgtggttcgaccagccagttgctagcttctttatggtcgttttgtttgctatctggagatactatccgtatgcgtttatttcatttttggctattttgcaaacagtcgacaaaacgctttatgaagcagctgaaatggacggtgcaaatgcttggcagaagttcaagatcgtgacactgccggcaatcaaaccagtactagcaactgtgattgttttacgatctatctggatgttctatatgtttacagatgtctatctactgacgaataaagtcaatatcttaggcgtttatttgtatcagacagcctttgcgttcaatgatcttggaaaagcagcagctatatcgattctattgttcatcattattgcagcggtcgtcttgctctcacgaaagaaggtggacttgaaatga

SEQ ID NO: 1846 - DNA (genomic), 318 bp, Enterococcus faecium; double-stranded, circular
  misc_feature (B) LOCATION 1...318
  hypothetical: NO
  anti-sense: NO
aaattggcagatttaagcgcgcttgatgaagatagagaaatccgatttgtgtctccagaatcatcaattggaatagcaaaaatccaaaaactgattgcgagaagcatcttttcatcaggtatgaaaagaaacttctatcgtgatcagtttttgatttttttaaaattcatttttctaagactggttagcagaaagaagagaataatctcttctcttttttctattatatatagattttctctattttttggtaagggagctgtttcaaaaatggtaaagagcggaaatgttgcgaatatcagttatttaatgatatga

SEQ ID NO: 1847 - DNA (genomic), 474 bp, Enterococcus faecium; double-stranded, circular
  misc_feature (B) LOCATION 1...474
  hypothetical: NO
  anti-sense: NO
gtgttggcagaagcattatgtggtggtctttttgcctggttctttactttttcttccgcaagaaatttttcgacgttcatatggatgctttcggctttgctattttcgttgatggatttattttacttcatggtccattctcacacgctattctgttcttgggcaattttatggattttttggttgcaggccggcgtcttccaatggcaaagtgtgctgttaacgtttatcgtaggcggtgtgtgccttcgctatggtcaatcctatctcggagctggcgatactctgttgatgctttcttggagtggtggcttgtctctagaagagttgcttcagatcttgtttcttgctagtctgtttggaatatccgttttttctgtttactttatctgtcataaaaaaaagttggaaaagctgcctttcattccttttttgagcagtgcgttgctgattgtccttcatcttaggtattga

SEQ ID NO: 1848 - DNA (genomic), 237 bp, Enterococcus faecium; double-stranded, circular
  misc_feature (B) LOCATION 1...237
  hypothetical: NO
  anti-sense: NO
aaaatggcagacaagagaaaagaaaagattcaaaaattactggcgcttgcggcggatgtaaatgatgaggaatcaatgagcgcattagccaaagcccagcaattgatgatggactatgatcttactgaagatgagattttcaattatcatgagcagcaacggatagaagcagtagaaacgcacgtgatctatcgtggacgtccgcaaaaatggctgtatcgtttatttaaaaattaa

SEQ ID NO: 1849 - DNA (genomic), 225 bp, Enterococcus faecium; double-stranded, circular
  misc_feature (B) LOCATION 1...225
  hypothetical: NO
  anti-sense: NO
gaggaggcagaatcaatcatgcgaaagaaatttgattattggggtgttcccttcagcgaattattcccaaactaccatgcgccacatactatcgaatgcgactgtggagaaagagcgaaatgtatcaaaagctatcgtttgtaccaatgtcaaacatgcggaaaaaaatacaccttgtcttatggcgattatattttgattgatgagaaaggaaagaaacgctga

SEQ ID NO: 1850 - DNA (genomic), 228 bp, Enterococcus faecium; double-stranded, circular
  misc_feature (B) LOCATION 1...228
  hypothetical: NO
  anti-sense: NO
gaggaggcagaatcaatcatgcgaaaggaatttgattattggggtgttcccttcagcgaattattcccaaactatcatgcaccacatactgtcgaatgcgattgtggagaaagagcgaaatgtatcaaaagctattgtttgtatcaatgtccaacatgcgggaaaaaatataccttgtcttatggcgattatattttgattgaggagaaaggaaagaaacgctgttga

SEQ ID NO: 1851 - DNA (genomic), 264 bp, Enterococcus faecium; double-stranded, circular
  misc_feature (B) LOCATION 1...264
  hypothetical: NO
  anti-sense: NO
gacggaggcctcaacatgacaaaagagattatttcatctaaagatcttcatctgtattatggaaagaaagaagcactaaaagggatcgatctaagcttcaatcaaggggaaatcactgcgatgatcggtccttctggttgcggaaaatccacttatctgcgttctttgaaccggatgaatgacctgattccgaatgtaacgatcaccggaagtgttatatataaagacaaagacatctatggtccagaaacagatgtctgttga

SEQ ID NO: 1852 - DNA (genomic), 1338 bp, Enterococcus faecium; double-stranded, circular
  misc_feature (B) LOCATION 1...1338
  hypothetical: NO
  anti-sense: NO
atggcacaagaatatttaactgtcactacattaacgaagtatttgaaaagaaaatttgatgccgatccttatttagaacgcgtatatttaacaggcgaaatatcgaatttccgtttacgtgccaatgcccatcaatatttcagcttaaaagatgaccatgcaaaaatatctgctattatgttcaaaggagcattccaaaaattacgattccagccaaaagaaggaatgaaagtccttgtcgttgggcgtatttcattatatgaagcgggaggttcttatcaaatctatgtagagcacatggagcctgatggaataggtgctttatatcaagaattggaagaacgaaaagaaaagctgatgaaggaaggcctttttcaagggcctaaaaaaatgctgccacgtttcccaaagcgaatcgcggtccttaccagtccaagcggagcggttatccgcgatatcatcacgacggtgaaaagaagatatccaattgtccaattggttttgttcccaacagttgtacaaggaaaccaagcagcggacaatgttgtcaggaatatccagagagtagaagagatgggcaatttcgatacaatgatcatcggtcgtgggggtggttcgattgaggatttatggccgtttaatgaagagcgggttgctcgggcgatttatcaagctaatacgccggtgatttcatctgtaggacatgaaacagataccacgatcgctgatttagtagcagatgttcgggctgccactccaacagcagctgcagaattagctgttcctgttttgtcagaagagttgatgcgcattcaagaacggcaagctagattgcagcaggcgtttgtacgccagatccagcgcaaacaagaacggttcgagcgtgctcgacgttcctatgtatttcggcagcctgaaagattgtatgaaggtcagaccatcaaattagaccagttgaaacagcgattatatcaagctacacagcaaatttatcatgcgaaagaaaaacaaacgatcgcattaagccaccaattggaacaagtggctccgctttatcgagttaaagcagctcgccaagaaactgcttatctagaaaaacgcttagaagagaaaatccaacaatatatgaaacaacagcagcagcgttttgctcaagctgttcaatctcttgatttgttgagtccattgaaaatcatgggaagaggctacagctatacgacgttaaatgatcaagtagtaaaaagtgtcaccgagattcatcaaggggatttgctgacgatccattatcaagatggaatcgttaaaggacaagtacaagagatagacaaaggagaataa

SEQ ID NO: 1853 - DNA (genomic), 1611 bp, Enterococcus faecium; double-stranded, circular
  misc_feature (B) LOCATION 1...1611
  hypothetical: NO
  anti-sense: NO
acaccgcaagaaaaaatggcacgaggttctgcttggatgaccgccagtaatatcatttcaagattgctaggcgctgtctatatcattccctggtatgcttggatgggcgaaaatgctaaggctgccaatggattattcaatatgggatacaatatatatgcattgtttctactgatctctacagcaggaatacctgctgcgattgcaaaacaaactgcacgctataattcattgaatgaatatggcacttcacgacgattatttatccgtgcattacagatgatgggcgggttaggcctgttgtttgctttgttcatgtacatcgcctctccttggctagctcatgcttctggtggcggagaagaactgattccaacgatgcgttctttgagtatcgctgtattggtttttccttgtatgagtgtgatacgagggtattttcaaggcaatcaagaaatgatgccttatgcgctgtcgcagattgtagaacaggtggcacgtattttttatatgctattggctacattcatcatcatgaaagtcatggatggtgactatgtgacggcggtcacgcaatcaactttcgcggcatttatcggtatgctagcaagtattcttgtccttttgtattttttgaagaaacatcaagcgtatacatcggcgtttattcactacagcgaaaacaaaataaatattgcaacgaaggaattgttgttagataccgttaaagaagcgattccgtttattattgtgggttcaggggtaacgatcttcaaattagtcgatcagttcacttttatgaagatcatgtctgcatccaccgagtattccaatgcacagttactggatcttttttcgatttttagtgccaatccagataagttgacgatggtagttattgcattggcaacatcgatcgcgtctactgggttaccgttgattacagaagctgttacgttgaaagatcgagtaggtctggcaaaattgacaagcggaaatttacagttgttttcattttttatgtttccggcgacatttggtgttatgttacttgcctatccgctaaatacattattttatacaccggattctctaggaagtaatgtactgatccaagcaagttttgtaggactcttcctaggactatatatgctagtttccaacatgctgcaaggaatgtttgaaaacaaggcggcaattaattatttggttattgggtttctagtgaaactccttcttcaatacccagccattcgtttatttgaagtatacggccctttattggcgacaatgatcggatttgctgtgtcttgtaccttgatcttaaagagaatccatgaagtagcccgctttaaaccaagttttgtctggcgcaggacattgctgatctttattcttaccttgattatgcttttggcttcgtggatcacaaagatgatttttggtgcttttttaaacgaagatagcaaattccagtctctattgttgattcttgtagtagcaggtataggggctttagtgtatggttatttagctttgaaaatccgcttggcagaaagactactaggaccaggaatagcgcgtttacgacataaattaaaaataaaataa

SEQ ID NO: 1854 - DNA (genomic), 576 bp, Enterococcus faecium; double-stranded, circular
  misc_feature (B) LOCATION 1...576
  hypothetical: NO
  anti-sense: NO
aataagcaagaacaagggggaagacgtatgataatcagtgaatttgaccgtaataatccagtattgaaagatcagctttctgatttactgagactgacttggccggaagaatatggagacagctcggcagaagaagtagaagaaatgatgaatccagaacgaatcgcggtagcagcggtagaccaagatgagttagtaggatttattggtgcaatccctcaatacggtatcacaggttgggaattgcatccattagttgtagaaagctcccgacgaaagaaccaaataggtactcgattagtcaattacttagaaaaagaagtagcttccagaggaggaatcacgatttatttaggtacggatgatttagaccatggaacaacgttaagtcaaacggacctgtatgagcatacatttgataaagtggcttccatccagaaccttcgtgaacatccgtatgaattctatgaaaaattaggttataaaatcgtaggtgtcttaccaaatgcaaatggctgggacaaaccggatatttggatggcaaaaacgattattcctcgaccaaattctcaataa

SEQ ID NO: 1855 - DNA (genomic), 1395 bp, Enterococcus faecium; double-stranded, circular
  misc_feature (B) LOCATION 1...1395
  hypothetical: NO
  anti-sense: NO
aagtggcaagagcgagatggaaaattatcttgctcttgttgccattatcttaaaagcagtttgcggtttagcaagtttagagggggcattcagatgcagcaagataaaacaagcaatatcaacgaaaaaaaaatcacgctttgttcacttattccagggatggggcagtttgtaaatggccaagcttttaaaggtatcgtttttttcgccatattcgtcctattcattggtcagatgcttctgggcggatttcatgcattggtaggattggttactttgggaagtataccaatggaagatcattcattatttattttgattgaaggcactttgcaattcatcattacaatcattttcttgattttttacggtttgaatcttttagacgcttatcgagtagccaagatgcgtcaagagggcaaaaaaatcaatcggacgatgaaagaaatcatacataatataggtgatgaaggttttccttatctattgacacttcccgcttatcttctcatgatttttacgatcattttcccagtcctagttacattgttcactgcatttactaattatgacttcaatcatattccaccagccagtttaattgattgggtaggggctaaaaacttttttagtatcttctttttaagctcatatcgtaatactttttttgcagtcttttcgtggaccgtgatttggactttatgtgcaacaactttgcaaatcacccttggtattctcacagcggttgttgctcaccaaaaatttattaaattcaaacgtattttcggtatcattttcttattaccatgggcggtcccagcttttattactatcatgagtttttcgaatatattcaacgatagcgtaggtgccatcaatactcaagtgattcctttcataaaccagcttccttttgtagatatcagtgcaatctcttggaaaacggacccgaactggacgaaagtagcaattatcttagtgcagggctggttaggatttccctatatctatgtgatggttacaggaatcttacaatcgatttcagaagacttatatgaagcagcaaaaatcgacggagcaaatgcatggcagcgcttttcaaacatcacgcttcctgctgtcttcctagtggcagcgccaacatttattacacagtatacggggaatttcaataatttctccatgatctatctgtttaacaatggtggtcccggaagcgtaggcggaggagctggttctactgatattcttatttcctggatctataaacttacgactggaacttctccgcagtattctatggcttcagcaatcacgttgattatctccgtcatcgttatctgtgtgtcattgctggtatttaaaaagacaaatgcgttcaatatgggggattaa

SEQ ID NO: 1856 - DNA (genomic), 2445 bp, Enterococcus faecium; double-stranded, circular
  misc_feature (B) LOCATION 1...2445
  hypothetical: NO
  anti-sense: NO
atagctaaagaccaaaagcagcgagaacagctgtcttttggacacaaaggagagattgagatggaaaaaaagaaagatacacaaaaaatctatgcagcttttgctggaaaaacgaaacaagaattatttgaactattccatgcatcagcaaatggattgacagaagaacaaatcgaacgttcaagagaaaattacggtgaaaatgcgatttcatatggcaaaaaaacaccattcattgtagaaatattgaaagcatacatcacgccatttacattagtgttgatcgcattaggaattatttcattcatcacggaatatgtattagcagctcctggagataaagatcttttcggtgtagccattatcttcactatggttatcgtcagcgggacaatgacgttgattcagtccgtacgttccaatcaagcggctgaaaaactgaaatcacttgtgaaagtaacggcagctgtaaaacgtaatggaaagtacacagagattcctatggaagaaatcgtctgtggagatcttgttcggctttcagcaggggatatgataccagcggatatgcgtttattgtccgcaaaggatttattcatttcccaagcagcattgacaggggaaagctatccagtaaaaaagcatgcgaaagtatgtgaagacgatcagcaaagcgaaacaagttacgaaaatcttgtctttatgggaagtaatgtcatcagtggaagtgcggaaggaatcattgtttctgttggaaatgaaacactatttggtcatgtagcagaaacgctatctgaaaaaccaattcaatcaagctttgaattaggcatccataaaacatccatgctactgatcaaatttatgtcattgatggctccagcagttatcgtcatcaatgggcttacaaaaggggattggctagaagcttttctttttggactatctgtagcagttggtctaacacctgaaatgcttccaatgatcgttacgacgaatttggtcaaaggagcaagtgtgatggccaaaaaaggaacagtgatcaaaaatttgaatgccatccagaactttggtgcaatcgatgtgttatgtacggataaaacggggacattgacacaagataaaatcattcttgaatatcatatggattgtgaaggaaatgaagatgatcgtgttttgcgccatgcgtatctaaatagctactatcaaacagggctgaaaaatttgttagatgtggctatcattgatgaagcaacagaaactttagatacagataagatcaattatcaaaaagtggatgaaattccttttgattttgaacgtcgtcgtatgagtgttgtggttgctgatccagctggtaaaacacaaatgatcacaaaaggcgcgattgaagaaatgctgaacatttctaaatttattgatcttggcggtactgttacaccattaacaaaagaacgaaaagaagccgtacttgcaaaagtacagtcacttaatgaagatggcttacgagtgattggtgtcgcacaaaagaccaatccaagcgtcgttggagaattttcagtcaaagatgagtcagacatggttttgattggttatcttgctttccttgatccaccaaaagaaacaacgaaacaagcgttgaaagctctgaaagaacatggtgtagctgtaaaagttctgactggggacaacgaattagttacacgttcagtgtgccgtcaagtaggtctagagatcaatgaattggttaccggtgagaaaatctcggaaatgagtgatcatgaattagcacaagtagctgaagaccatgaagtattcgtaaaattgaatcctcagcaaaaagcacgtttgacgacagctttacgtaaaaatggtcatactgtcggatttttaggagatggtatcaatgacgctcctgcaatgaaagtggctgatatcggtatttctgtagatacagctgtggatattgcgaaagaatctgcagacgtgatccttttagaaaaagatttgacgattttggaaagaggccttctttctggacgagaaacttttgggaatatcatgaaatatatcaaggctacagcaagttctaattttggcaatatgttttccgtgctgattgcaagtacgttcctgccatttttaccaatgctgcctttacaacttttgtttttgaatctgatctatgatgtttcctgcatttccttgccatgggatcggatggataaagaatatttggacgagccaaaaaaatggaatgcatctagtattggggaattcatggtttactttggtccaacaagttcgatatttgatattactacttacttgttgatgtattttgttatttgtcctgctgtagtgggccgaagtttccatacattggatagttcacagcgagtgattttcatcgcattattccatgcaggatgtttgttcgattcactatga

SEQ ID NO: 1857 - DNA (genomic), 552 bp, Enterococcus faecium; double-stranded, circular
  misc_feature (B) LOCATION 1...552
  hypothetical: NO
  anti-sense: NO
tataataaagaaaataagacgagaggtaggatttttatgaatactttagcctatatattattatgcgtgcttttatccaaaccacgttctgggtatgaattgaagcagctgatcacaattttttgggaagcccatcacagtcagatctatacaacgcttgccaagttagaccagcagggttatgtgaccgttttggacaaagacgagcactctcaaaaaaagatctaccacttgactgatgaaggacgtgctcttgtagaggaatggatcaaagaggaaactcccgctcctacgcaaaaagatgaatttctagcaaaaatctatgctttttcgacgctcgataaaacaacagctactggactgctattcactagagaacaacagctgaacaaaatcatgcaaaaaaatcaaaaaaaattgaatgacctctcgctagacaagaaacaagaatttggacgttatgttgtgatccagcgcagaattatgctttgtcagcaggaactccaatggtgtcagcaagtaagagaacaaatgcagcagttttttgagtaa

SEQ ID NO: 1858 - DNA (genomic), 234 bp, Enterococcus faecium; double-stranded, circular
  misc_feature (B) LOCATION 1...234
  hypothetical: NO
  anti-sense: NO
atgaacaaagaacgattgaaacaagatttctatgaagcagtcaatgaagaatggcaaaaaacagcaaaaatccctgcagataaaccagctacaggcggtttccaagatttagttgacgggatcgaccaacttttgatgggagaaacagacgatctgcttgcccatccagaaaaaagtgtcttcagaaaaaatgaaacatttccttgcatattatcaactggcaaacgattatga

SEQ ID NO: 1859 - DNA (genomic), 306 bp, Enterococcus faecium; double-stranded, circular
  misc_feature (B) LOCATION 1...306
  hypothetical: NO
  anti-sense: NO
ggaggcaaagagatgaaacaaaggaaaattcctttacgcaaatccgtggtttcaggtgaaatgaaacctaaaaaagagatggtccgaatcacccgttcaaaagaaggggaagtatcgatcgatccaactggaaaaatgcctggacgaggagcgtatgtctcacttgagccggaagaagtacaacaagcttgggataaaaaaattctcgatcgagtactcgaaacaacattaacagatgagttttatcaagaacttcttgactatgtcactcaccaaaaagcacgtaaagagttatttggaaaatga

SEQ ID NO: 1860 - DNA (genomic), 1020 bp, Enterococcus faecium; double-stranded, circular
  misc_feature (B) LOCATION 1...1020
  hypothetical: NO
  anti-sense: NO
ttaataaaagaatccggaagattacttccatgtctcgctgcaccaattatagcgggacttttttttgtagaggtgaccaaaatgtcagataaaccgtttaagacactagaagaacaaattgaaattttaaaacaaagaaatttaaaatttaaaaacagtgaaaatgctaaatatgtactaatgaataactcttattatggattaataaatcgctataaagaattattctcgatttctactcaaaatgctgaaggcgattttgaagatgattttcaaggaaattactttgaggatttgttaagtatatatgattttgacaaaaacttatcttcgttgctctacaaatatttttctatgattgagactacattaaaaacatcttgttcttactatatctctttatatattggtgaaatgcaaactaattacttaaataaaaacaattattcgtggggatatattgtagaacacggtaagatgaaaggtcgaccttcaagagaagtcactattgatcatttagaaaaatgcatcaaaaaaagtggagatccttcaattgagtattataaaaaagaacataataatgtaccaccttggatttccatccctgcactttctttaggaacaatctatgagttgtatcgtatttgcccaaaagaagctaaaagtgatatttcttctgtttttatgaaaccaaaaatccaagatattagtgctcaaaaaaatttatttataaaatccttgaaatttattcacatttaccgaaatagagtagcgcatggacaaagaattgtaaatcactgtgtggaagaaaaaaatgttttacctaaatatgaatttaaattattctctaaaaacaagaaaactcatatgctagtcaaagatggtcgttcagattcaataattgggctttttttatcagttaccttgttattatcttcgagaagtttagtgcaaagtcaatttatagatgaactagaatctatttttgttaccttaaaaaaaagaaatactaaagcttaa

SEQ ID NO: 1861 - DNA (genomic), 210 bp, Enterococcus faecium; double-stranded, circular
  misc_feature (B) LOCATION 1...210
  hypothetical: NO
  anti-sense: NO
ctaataaaagatcgtaaaaatcccaatggtttcttaccgtcaaacgttttttgcgacatgaaccaagtaactgccaccggtatacctaagtattttaaaaaggccccctctatcatagatagtggaggcacatgggcaaatacgatgacaaacagcaaggataaaacaaaccaagccatctggttaaaagtcacaggaaaaggcagttga

SEQ ID NO: 1862 - DNA (genomic), 414 bp, Enterococcus faecium; double-stranded, circular
  misc_feature (B) LOCATION 1...414
  hypothetical: NO
  anti-sense: NO
aaaataaaagatgcctctgtagtaaaaaaagcatttagctgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagaaattggcgcagcgaatccttgataatgagctcggatgtgctaacgctagcgaggcagtctaa

SEQ ID NO: 1863 - DNA (genomic), 204 bp, Enterococcus faecium; double-stranded, circular
  misc_feature (B) LOCATION 1...204
  hypothetical: NO
  anti-sense: NO
aaggtaaaagaaaacccaatggccatcaagtataaaacgggaaaaaaacaatatcaccgctcaatccatgatcgacctgataattatcctgatttcaattctgagtttggtcaccttgaaggtgatacgatcgttggcattcatcataaaagtgccgtcattactttagttgaaagattatctaaagtcattatcacgaattaa

SEQ ID NO: 1864 - DNA (genomic), 486 bp, Enterococcus faecium; double-stranded, circular
  misc_feature (B) LOCATION 1...486
  hypothetical: NO
  anti-sense: NO
acatcaaaagatttgataatcaaactaattagtggacggtggaacatggaaccagatttaaaaacagtaaatgattatcttgttagtgtcttcaatgatattttgacaatcgaagagtctgagctgaaaaaatctcaattcaaagatctgtcaatcacagagatgcacacgatcgaggcaatcgggatgtacaagaaaaaaacaacttcagaagtagccaaagaactatcaattactgttgggaccttgaccactgctattaacaagttagtaaaaaaaggctatgtcgaacgtatccgcagtgaagatgaccgccgcgttgtaaagttgggactaacgaaaaaaggaaagttactatttcgggtccatcagcattttcatcgtgaaatggtcaagaacatcttagacggaatggctacggaggaacagcatgccttgctggatgcactgaaaaacttgcacgacttcttgcaagactataagtga

SEQ ID NO: 1865 - DNA (genomic), 1140 bp, Enterococcus faecium; double-stranded, circular
  misc_feature (B) LOCATION 1...1140
  hypothetical: NO
  anti-sense: NO
atgaaaaaagaagaaaaaatcgcgattttacaagagatcatccgaattaaatcagtgaatggaaacgaaggtgaagtagcagcctatttgaataagcttttggcaaagcatgacataacaggagagattgtttcttacagagatggtagagataatttgattgctcgttaccaaaagggccaatcaggaaaagtgttaggcctatctgggcatatggatgtcgtggcggctggtgatgaatcgtcttggacctatgcaccctttgcagcagaaatccatgggaaccgtttgtacggacgtggtgctacagatatgaagagtggcttggcagcaatggtgattgccatgatcgaactgaaagagtcaggaaaaccatttaacggaacagtcaaattattagccactgtcggagaagaagtgggtgaactaggtggggaacagctcacgaaagcaggctatgtagatgacttagatgccttgatcatcggagagccaactaattacagtttgatgtatacgcacatgggatcaatcaactatacagtcacctcgcacggaaaagaagcgcatagctctatgccagaccaaggttataatgcaatcaatcacctaaatgaattcattacgaaagcaaatgctgaaatgaatcacctcgctgaaacaatcgagaatcctgtcctaggaaaaacaatccataatgttacattgatcagtggcgggaatcaagtcaacagcatcccaagccatgcgcagctccaagggaacattcgatcgattccagaatacccaaatgataaaatcattgcattgctgcaatcaatcgtcaatgaattgaatcaagagacagactatcatttggaattgatgatcgattacaacaaaatacctgtcaaagctgatccagattctcctttgattcattgcattcagcaacaattcagccagccattacctttagttggagcggcagcaacaacggatgcagccgaatttacgaaagctaaccattccttcgactttgtcgtctttgggcctggtgtcgttactttgcctcatcaagtagatgagtatgttgaaatcgataattatttggatatgattgaaaaatatcaaggaattattttatcctacttagcgtaa

SEQ ID NO: 1866 - DNA (genomic), 969 bp, Enterococcus faecium; double-stranded, circular
  misc_feature (B) LOCATION 1...969
  hypothetical: NO
  anti-sense: NO
gaacgaaaagaaggaaggaagaaatacatggattatcaagtactgctttattacaattatacaaaaatcgaagaaccagaggaatttgccaaaaatcatttagccttttgcaaatctttggatcttaaaggtcgtattctaatagctgaagaaggaataaatggtactgtgtctggaaccgttgaaaacacgactgcctatatgaaagcaatgaaagctgatcctcgatttgctgatacgatgttcaagatcgatccaagcgaaggacatgcctttaagaagatgtttgtaagataccgtccagagcttgtaagtttaaagctagaagaggacattgatccaaaccaagtgacaggtgcctatctttcaccgcaagaatttaaagaagctattttagatgaacagacagtggtgattgatgcacggaatgattatgaatatgacttgggacattttcgaggggctgtacgcccagatatacgcagttttcgagagcttccagactggatccgcgagcacaaagaagaatttatggaaaaacgggtagtgacctactgtactggtggcattcgttgcgagaagttttctggttggcttgtccgtgaaggattcaaagatgtcggacagctgcatggcggtattgctacttatggtaaggatcctgaagtccaaggagaattatgggacggcaagatgtatgtgtttgatgaacggatcgctgtcgatatcaaccaagtagataaacaaatcgtcggtcgcgactggtttgacggaacaccatgtgaacgatatatcaattgtagcaatcctgagtgcaatcgtcagattcttgcttccattgaaaatgaagaaaaacatttaggagcatgtagcatagagtgtgcgaaacatccgcgcaatcgctatgttcaagaccatggagtctctccagaagaagcagaactgcggtttacagctttaattaaatag

SEQ ID NO: 1867 - DNA (genomic), 1953 bp, Enterococcus faecium; double-stranded, circular
  misc_feature (B) LOCATION 1...1953
  hypothetical: NO
  anti-sense: NO
agaagaaaagacgcgagctgtttccgaactcacccaacttatgaaagaacatccagtcattacttttgtttatggtgcaaaaaacgagcaccagaaccatgccgttgtgttaaaagaatttatcgaaaaggaggtgtacaaatgaaaatagggatcattggtgccggacctagaggattaagtgtagcagaaaggattctccataataatcagggcagatattctcttgaacttattctttttgatccagaaggtccaggcggtcgagtttggcgattgaatcagccaccagaattattaatgaactctgtttctcaacaagtgacgctttttacagacgaaacgttgtccagtgggggaacggtaatgccgggacctaatttgtttcaatggagtaaaggacctgctacagattatatcgaacagacggtaaccaaaaataagcaactatttatagaagaaattaaccgtctggaaaaagatcagcaatctactcgttgcctatacggactttatcaacgctggtttttctcaaagttgcaagaagaatttccagcttctactcagcttgtctattctttagtgaaaaaggtcagcaaagaaaaagacggtttcctattacagacagatcagcaaagctatcctgttgatcagctcattttagcgagtggtcattgggaaaatgatcagacagaagaggaaagagcttgggtagactatgcaaagaaaaatgatttactgtatcagcttccttctaatcctgcagatgtcgatctttcaaagatacagccaaaagaaaatgtctttctaagagggcttggtttaagcttttttgattatgtcggattgtttacggtatcaagaggagggcgcttcgaaaacaaaaagggaaaattggtctatcatccatccggcaaggaaccgattatatacagcgggtcaagaagaggtctgccttactatcctcgagggagaaatcaaaagcaaggcggagcaatggcatggccacggctacttacaaaagaaaaccttgagcgatggcatcgatcgggacttttgactggcgaaacattttttgactatctgaaaaaagacgctgagttgttttattacaagaaaatcatcgaagaacatcacttgccgatttcaaggaaaacttttgatcatgattttctttccctctcctcagaagagtgtcttggaaagtatccagcattacttccatacaaatggtcttggtcgtatctagaaactcctcttacctatcaggatgagtcctttgcagaaactagccgagcatttattgaagggcagataaaagaagcggaaaaaggcaattgcacaggggcattgacttcgacatttgatgcattgaaagactggcgtgatccaatccggcaggctattgaatggcacgttttttctgctaaggaatacaaagaaatactgtggggatggtttactcatctaaacagctttttaacgattggaccgccagttattcggacgaaagagttagcagcactgatagatgcgggtatttttcatttgatcgaaccgccacttgatattcagcaaaagcaaaaccactatgttatttctctacaagataaagaaatcagcagtcgctatttgatcgaagctcgtttgccacaaacaagcttttctcgttcaagtaatcctgtcataaaaaatttgaaggaaaataaacttgttcgccctttttcgttttcagataatacaggaagttatcattcagaagctatagatgttgagcgaggtacgaatcgcgtgattgatgcttccgggaaaatccagtctggcttttattgctatggaataccagttgaaggtgtggattggttaactgcagcagcagctagaccttatacagatccatggaatttgagacaggcagataaaatagcacaacttatattgactgataaataa

SEQ ID NO: 1868 - DNA (genomic), 456 bp, Enterococcus faecium; double-stranded, circular
  misc_feature (B) LOCATION 1...456
  hypothetical: NO
  anti-sense: NO
acattgaaagatttttactcagtaaatgaattagccgaacaattaggtgttactacacgttctatcagaaattatcttcatgaaggaaaactaaaaggaacaaaggttggcgggcaatggaaattttctgaacgtaatctttttgagttcctatacggagatcaagcagaggaagcagcaaaagaaatgcagcgattcatgctaaatgcaccaatcacgatgcgtttcaaccttcaatatcgtgattttacagcaatcaatcaattccgagaacaattagtccagtaccataacgatgtttacgcaaataaaaaagaccgtcttttacaatacgatctttataaagacaatcatgcggagatactaatcggtggtaacttcaattatgtcgtaaactttagtcaatggatcaatgaaaaattattgatccagacagatatttcccttgtatcttaa

SEQ ID NO: 1869 - DNA (genomic), 1296 bp, Enterococcus faecium; double-stranded, circular
  misc_feature (B) LOCATION 1...1296
  hypothetical: NO
  anti-sense: NO
gaaatgaaagagtggttagatcgtgcctttttaccaatgataacatctgttgtgaatcttagacccttaactgctttgcgtaatggaatgacttacacgatcccaataattattgttggctcgctgtttttcttatttgctcattttcctgtggattacatcgctcagtggatagacaaaacaggattttctatgtattttacacaagtataccaggctacatttgatgtgatagccttttggatcgtttttgccattgcatacgcttatgcaaaagaagaagacatcgatcgcttaccagtcggcataacagccttgtctgcttatctactgcttattcagccactaaatactcagatagatactgtctggacaggtgctgaagggatactaggagcagttacaactgggctcatcatcggatggggctatgcacgtttagtaagacttgcgaaagggtggaagcaaagagagaagatacctgcaaatgtttggcagtcttttacttcattgattccaatcattgtgatagtcacttatacgcttatcggttcagcggtttttcaacagttgttcagaatgactgttgttcaaggagtatggacatatgtccagcttcccattcaatcgttcatagacacgttgtttggtgtgcttttattaggtttttttgttccgtttttatggttatttggtcttcatggatctgcgatggtcaatgggttggttagtcccgtcttgcaagcgaattcattagcgaatgcagaaatcttagcctcaggacaagagttgacggtggcaaatggcggacatatcgttactcagcaatttctcgatcagttcatgacggttacgggtgctggattgacgttaggggctgtattttttatgacggtttttgcgaaatcgaagaaatacagagaattaggaaatcttgctcttttaccagcttttttcaacatcaatgaatcaattattttttccacaccgatcgtgatgaacccgatgatggctgttccttttattttcgcaccggtcgtttcaggattgattacctattccgctttatattttggattcgttcctttatttacagcagtccaagtcccttggacaacaccgccgatcctctcgggtttcttagtaggcggagtgcctgcagcgattttacaaggtatcgtgttgtcaattagttttttcatttatttcccatttttgaaaaaaatagattctgcaaactgcaaaaaggaaagacagacaaaaaatgatggagcagcagaaaagatgaacgactaa

SEQ ID NO: 1870 - DNA (genomic), 1500 bp, Enterococcus faecium; double-stranded, circular
  misc_feature (B) LOCATION 1...1500
  hypothetical: NO
  anti-sense: NO
ggaatgaaagaaaaagagtttttacaagaagtaaaagaaatcaatcttctacaacaagctttaggaatcctcgattgggatacacaaacaggtatgcctgaaaaagctagtgcataccgaagtgaagtagacagctatctttacagcatttatttttcaaaaaaaatcggtccaaaaatcaaagaagccattcgctatttttctgaacatccggaagaattgtcggaagttggaactgccgtttttgccaaagtaaaagaagagtatgatttggaacatcgcgtaccggaagatcttatgagaaaatatacagctgccgtttcttcagcacacggacaatggcaaaaagctagagaaacacaacaattttctgattttcaacacgcattgaatcaaaatattgaattaacaaaacagttgataccttactggagaaaagatgaaaagacgaattatgatgttttgctgaatcaatacgaacccgggatgactgtcgaaatccttgataaggtatttgatcagcttaaagaaggaattctttcgatccgccgtacgctccaagaaaaagggactgaacctgaaacagactttttaaatcggagaatgacgaaaaaacaacagaagagatttgtagtgaaagtaatcgaacaacttggttatgattttagtcgtggtcgtttagatgacactgtccacccatttatgactggaattaatccgaatgatgcacgaatcacgacacgatggaacgaaacagatttcaaaatggctgtttttggagtgatccacgaggctggtcatggtatgtatgaacaagacatcgatgataaatatgcgtatacaccggtttatgaaggtacatcaatgggtatccatgaatcacaatcgttgtttaacgagatcattattggaagtagtcgcagcttctggaaaaagcaatatcctttctttcaagaatgtgcagaaggaacattcgatgatattccttttgacaaattttatcgttcattgaaccatacaaaatcaagtttggttcgtatcgaggcagacagtttgacttaccctctccatatcatcattcgttatgaaatcgaaaaaatgattttcaatgaaggggtagatgttgctgaactacctgaaatatggaatcaaaaatatgaagagtatctgggaatacgaccaacaaatgatgtggaaggcatcctacaagacgttcattggtcaggtgcaagctttggttattttccctcttatgcattagggtacatgtatgcggcacaattacttcattctttgcagcaagaaatagatgtggaaaatgttctagcgtcagacgattattctccaatcaaaaactggatgtcagagcatatccatcaatatggtgcatctagaaaaccaaatcaattaatcatggatgcaacacatgaaccgcttaatccgcaatacctgatcgactatatgaaagacctgtattttaatgtatatcaggtaaaataa

SEQ ID NO: 1871 - DNA (genomic), 573 bp, Enterococcus faecium; double-stranded, circular
  misc_feature (B) LOCATION 1...573
  hypothetical: NO
  anti-sense: NO
gctgtgaaagaatttttgaaaaattgggggattttgatccttgtattagcggctattttattagctagagtgtacgtgtttacaccagttactgtaaacgggcattcgatggaccctacattaagtgatggacaacgattgatttcatctaagatctcaaactatgaacgaatggatattattactacaaaggaaccgggggatgaagaacggatgattgttaaacggatcatcggtatgcctggagatacagtcaagatggaaaatgaccagttgaccattaatggcaaaaagtatgatgaaccttatctggatgagttcaaaaaagaattttcagaagataagttacaaggagaatatgcttatagctcaggattccaagcacaagcagaaagttcatccacctttacgagtgactttgaatatactgtgccaaaaggaaagtatcttgttctaggcgataaccgcttgatttcaaaagacagccgaatgtttgggttagtcgacaaagatatgatccaaggaaaagttgttttccgttattggcctctttcagaaattaaaatcatgtga

SEQ ID NO: 1872 - DNA (genomic), 306 bp, Enterococcus faecium; double-stranded, circular
  misc_feature (B) LOCATION 1...306
  hypothetical: NO
  anti-sense: NO
atgacgaaagaggtagagataatgaaatattatgacgtaacgttccacgaattaagtggaaaaactgtggttaaacgggatatcccttctgaaaaaaacggctttgacgtatggaaagatgcctgtgcagactataatgagaacgaactgtttattttgatcaacgacggtgcttacgtgacgatgaatcggaaatttattgttcgaattgacacagaagaggtagaagatccgacagaaaaagcacgttctcgaaaagatgagatcatgggtgtagtgaatactttgtccaatatgggcttttag

SEQ ID NO: 1873 - DNA (genomic), 270 bp, Enterococcus faecium; double-stranded, circular
  misc_feature (B) LOCATION 1...270
  hypothetical: NO
  anti-sense: NO
gaaaggaaagaaacgctgatgaaaacacaacataaattattgactgtggaagaagtcgttcaaattttagtggacaaagaagtcatttctgaaaaagtagcggaagctttacttagtccgaggcactggacgatagaaatccctttagtagaagatggaccaaccatgctttttgaagacctagtgaagatagcaggatatgaactgcattatcaagaaaacatggaaacttatgaaaacgaatattggttaaccaaattagagaactaa

SEQ ID NO: 1874 - DNA (genomic), 294 bp, Enterococcus faecium; double-stranded, circular
  misc_feature (B) LOCATION 1...294
  hypothetical: NO
  anti-sense: NO
caggggaaagatttttttatttttgggatgtttttcagaccgccgatagtaccgacaattccctttaaatatggaatctcaacaacccacatgaagggtaaggcaagtccggtaattatatcttctgactttgggttaggaagaattgaaattgttaagaacgattcaacgcttatggtttataatttggagatagcctttgttaatatgctaaagccaacatacgatacagattttgagcagtttattctaaccatcaaagggtatgtggcctatcgcctatcctattactga

SEQ ID NO: 1875 - DNA (genomic), 735 bp, Enterococcus faecium; double-stranded, circular
  misc_feature (B) LOCATION 1...735
  hypothetical: NO
  anti-sense: NO
gtggttgaagaggcctttggcgaaaacagcaaaccacagccggcaggatctagcgagttggcagaagtcagtgaagacggattaacttacaaaatcaaattacgagaagacgcaaaatggtcaaatggtgatcctgttacagcagcggattacgtttatggctggcaacgaacagtagacccagctacagcttctgaatatgcttacctgtatgcgccagttgaaaatgcagaagacattacagctggaaagaaagataaatcagaactagggatcaaagcagttggtgactatgaattagaaatcaaattgacgaaacaaacaccatatttccaatatctgcttgctttcccatcatttttcccacaaaaacaatccgtagtggaagaaaatggggatgcctatgcatctgcaagtgataaagctgtttataatggaccattcacattagaagattttgatggaccaggaacagatacagaatggacttataagaaaaatgatcattactgggacaaagatacagtaaaactttctgaaatcaaagtcagtgtagtaaaagaatcttctactgcattgaacttattcaaagatggccaagcagatgacgtgatcttgtctggtgagttagcacagcaaaacgcaaacgatccagcttatacttctgttaaagaagcgcggacaagctatatcgaattcaatcaacgtgaaaagacccaccattcaacaatgtga

SEQ ID NO: 1876 - DNA (genomic), 1284 bp, Enterococcus faecium; double-stranded, circular
  misc_feature (B) LOCATION 1...1284
  hypothetical: NO
  anti-sense: NO
cgtggtgaagatttgcttgtagctgaggacaggttgggatacggacgtgtcatctgcgctgtttggctattgtcaatcgttgagaaaaaactgcataaagtagtacctgatgcggtagatatcatcgttacaccaactctttcattgattgccatcggtctgattgaaattttcttcatcatgcctttagcaggtttcatttctgatggcatggtcggtgggatcaactgggtacttggcgttggtggaacatttgccggcttcgttctaggcacattattcttgccgatggttatgttcggactgcatcaaattttgactccaatccatgtgcaaatgattgatgaaactggtcgtacgctattgcttccaattcttgcgatggctggtgcaggacaagtgggtgcagcattggcattatggattcgctgcaaaaaagataaagaattaacagaaatgatcaaaggagctttaccagtcgggatcctaggaatcggcgaaccattgatttacggagtaacattacctctaggacgcccatttattactgcttgtatcggtggaggtatcggcggggcagtgatcggaatgatcggaaatgtcggggctatcgctattggaccttcaggagccgctttgatcccattgatctctgacggtaaatggttaggctacatccttggattattggcagcttatgctggtggcttcgttgctacattcttcttcggtattcctaaagaccgtttagaaaaagaagaattagcgactgaaacagccacagtaaatgaagtgcctgaaaaagtagtacctcaaacttcagctgaaagtgtgactatcctctcatcagttgctgacggaacagttgtttctttagataaagcaagtgatccagtttttgcacaaaagatgatgggtgaaggctactttgtagaaccagaaaacggacatatctattctccagttactggggtagtcagctctgtcttcccaacgaaacacgctattgggatcacaacgccaaatggtttagaaatcttgcttcatatgggaatcaacacagttgacttaggcggtacgccatttgatgtgaaagtaacagaagggcagcaagtgacacctgatacgcttgtagcagaagctgacttagaagcgatcaaagcagcaggcaaagaaacatccatgatcgtcttggtaaccaatatggatcgtgtaaaaaactttgtcttggaaaaaacaggtaaagcaaaagcaaaagcacctgtgatggatgtcaaagcttaa

SEQ ID NO: 1877 - DNA (genomic), 1947 bp, Enterococcus faecium; double-stranded, circular
  misc_feature (B) LOCATION 1...1947
  hypothetical: NO
  anti-sense: NO
atgacagaagaaagaagtttagtagaacgcgctaaagagtatgatgccagtcagattcaagtacttgaaggacttgaagccgttcgtaaacgacctggcatgtatatcggttcgactagttctgagggtctgcatcaccttgtttgggaaattgtcgataattcgatcgatgaagtattagcaggttttgcaacgaaaatccatgtgattattgaaaaagacaacagtatcaccgttattgacgacggtcgggggatacctgtagatatccaggcaaaaactggacgtcctgcagttgaaacggtctttactgttttacatgctggaggaaaattcggcggtggtgggtacaaagtttctggtggacttcacggagtaggatcttctgttgtaaacgcgctttctacacagcttgatgtcaaagtatacaaagaaggaaatgtgtactatcaagaatatcgtcgtggagctgtagtggacgacttaaagattatcgaacaaacggatcgccatggaacaacggttcactttacgccagaccctgaaatttttacagagacaactgagtttgatttttcaaaattggctacccggatccgtgaacttgctttcttgaaccgcgggatgcgtatatcgattgaagacaaacgagaagaagaaccagtcatcaatgaataccattatgacggcgggatcaaaagttatgtcgaatacttgaatgcaaacaaaaccgtgatttttccagaacctgtatatttggaaggtgaacagcaagatatcgcagttgaagtctctatgcaatatacagacggctaccattccaatatcatgagttttgccaacaatatccatacgtatgaaggtggaacacatgaatcaggattcaagactgctttaactcgtgtgataaatgattatgcccgaaaacaaaagctgatgaaagaaaatgacgacaacttgaccggtgaagacgtgcgagaaggattgacagctgttatttctatcaagcatcctgaccctcaattcgaaggacaaacaaaaacaaaattgggcaattccgaagtacggacagtcactgatcggttatttagcgaacatttcatgaaattcttgctggaaaacccaagtgtgggccggcaaattgttgaaaaaggattactagcttccagagctcgtctagcagcgaaacgtgcgcgtgaagtaacgagacgtaaaggtgctttagagattagtaatctgccaggaaaattagcggactgctctagcaacgatcctgaaaaatgcgaattgttcatcgtcgaaggagattcggccggcggatcagctaagcaaggtcgtaatcgagagtttcaagccatcttgcctattcgtgggaaaatcttgaatgttgaaaaagcaagcatggacaagatcttggcaaatgaagagatccggtctttatttactgctatgggtacagggtttggagaagattttgatgtatcgaaagctcgctaccacaaattagttatcatgactgatgccgatgtcgacggcgcgcatatccgtacattgctgctgactcttttttatcgttacatgcgtcctattgttgaagctggatacgtctatattgctcagccacctttatacggggtaaaacaagggaagaatattacgtatgtacaaccaggaaaaaatgcagaagaagagttgaaacaagtcgttgcttcacttcctgcctcaccaaaaccaagcgttcagcgttataaaggacttggagaaatggatgatcatcaactatgggaaacaactatggacccaagcaatcggatgatggcccgcgtcagtgtggacgatgctattgcagcagatcagatatttgaaatgttgatgggggatcgagtagaaccccgtcgtgcattcatcgaggaaaatgcacactatgtgaagaacttagatatttaa

SEQ ID NO: 1878 - DNA (genomic), 201 bp, Enterococcus faecium; double-stranded, circular
  misc_feature (B) LOCATION 1...201
  hypothetical: NO
  anti-sense: NO
gtgacagaagagagagggacactcacagcgatagaagctgactgcacgaggactttatacatatcagatgcccgggagatcgagcatgctgatcccgaagacgagacaactagtaacatggagagcaatacgatgtcaggactctgcaccagtcacattccagaacagataacccaagtgaagcgaaaacgcgggaaatag

SEQ ID NO: 1879 - DNA (genomic), 270 bp, Enterococcus faecium; double-stranded, circular
  misc_feature (B) LOCATION 1...270
  hypothetical: NO
  anti-sense: NO
tgtaaagaagattctgcttccaaacctgccttatctgttcatcttctggtttttcaaccgtgtggcggagggctaccggctggcggagggcgcggatatggtgacaaaggcaatgggcgcagtatccggcctgggggcgctgatttccaaaaacccgctgcccagcttctacccgcgcgacctgctgctcggcgctgtcgtcgcggtcattatccgggccgtagtttatttcaaggcgaaaaacgccaagaaataccgccacggagttga

SEQ ID NO: 1880 - DNA (genomic), 351 bp, Enterococcus faecium; double-stranded, circular
  misc_feature (B) LOCATION 1...351
  hypothetical: NO
  anti-sense: NO
aaaaaagaagattttctactgggagagattattatgaaagactatgcttcacgtaaatttatccacttagagcctatgaaagaattggttattaatgggaatgaatataatgattacaaatctttatttgtaaaggaacagcctaaaggcggtattcggatgaaaaatttaccggacttccgatttatcgaagtaaacaatttaggaattatagaagactatttagataagttagatgaagcgataaagcaatcaattgaaaaaaatggtgaagatcatatacttacggttgttttaaaagacttgaaagatagactagaagctgaagcagagtactttaataaagactaa

SEQ ID NO: 1881 - DNA (genomic), 320 bp, Enterococcus faecium; double-stranded, circular
  misc_feature (B) LOCATION 1...320
  hypothetical: NO
  anti-sense: NO
gggaagaagatattgaagaagaagaaacattcgagtctttcgaagaagcacgacaagcgtacgaaaaacaatggaacgaaatccatcaaaattatgaatatatcaatgcaaaaagtaactttctcagcgccttttggaatgacggagatgagcgctggtgtgaagagtgtgacgatgatttacagcaatacaagggacttgcgttgttgaaaaatcatcagcccatcacagtagaaagcagaaaggaattttatgaaacaactaattctagcggaaaaaccaagcgttgcgaaagacctaagcaaggtgcttggtgctaa

SEQ ID NO: 1882 - DNA (genomic), 183 bp, Enterococcus faecium; double-stranded, circular
  misc_feature (B) LOCATION 1...183
  hypothetical: NO
  anti-sense: NO
atcaaggaagaattatttcaaaaagtcaaggaaattattaacaatggccattttggttgcgccaaacgatttatcggagaacataaagaacaattaggaccttataaagagaaagcccaaaatcttttaaaagatgtaaatatcgacagtgtcaaagacaaatttaaaaatctattcaaataa

SEQ ID NO: 1883 - DNA (genomic), 486 bp, Enterococcus faecium; double-stranded, circular
  misc_feature (B) LOCATION 1...486
  hypothetical: NO
  anti-sense: NO
gaggaggaagagaaaatgaaagaagttcaattgattagaaaaagcgaactatcagaaggcggttgcaatgcatgtggcgtagtagaagcgacaagctatacattaaaattagattccaatcaagcaataatctctgaactgacagtaggcggtcttgtggacagtctggcgcttgctgaaggttttactggagaagatatttatgagatgttttcagaagtccgtcagttaaaaaaaggagaaaaatgcatagaggttcatcatgagagcccgaatgtgaggttcaaacgtggtgataatgagatgatcttcaagaatcatgtgtctgatcacactgaactatatgaaatcgtgaatcaaatactgtctgggatttttgaattaggaccttatgagttcaaggaagaaaacggtaatccaaaattaaatgaagaatggcaagaaacgattgaaacacaaagaaacaatccacacttatttcaatag

SEQ ID NO: 1884 - DNA (genomic), 849 bp, Enterococcus faecium; double-stranded, circular
  misc_feature (B) LOCATION 1...849
  hypothetical: NO
  anti-sense: NO
gaggaggaagaaatgaataatacagtaacgaaatggtttcaatacggttttattttgctattaggtctagtcatgatttatccggtcttatggatgatcgcaggttcttttaaaacggatcaagagattatgagtggttcgctgaatttgattccagagacttttcaatgggaaaattacgcaaaaggatgggcggggtttgctggaatttcattttttactttctttaggaattcgtttgtcatctctgcagtttcgacgatagggacagttctgagctcgacttgtattgcttacgcattatcgagaatcgatttcaaaggaaaaagattctggttcgtcgtcatgttagtaacgatgatgattcctgcacaagtgattttgattccgcagtttattatttacaatcggctgaatttggttgggacgtatgtgccgctgattttaccacatttttttggacaagcatttttcatttaccagatcatgcaattcatggtcagcatccccaaagagttagatgaatcagcgattattgacggatgcagcaagtatagtgtctttaccaaaattatttttcctttgctgaaaccttcgatcatcacgacgatcatcatccagttttattggaaatgggacgacttcatgggaccattgatttatttaaacaagccgagatcttacacggtatcgattgccatcaaattatttgcagacgctggatctagtacgacttacgcgagtatgtttgcgatgtctacgttgtcgctgctaccggtttttctgattttcttattcttcaataaatatcttgtccaggggatcagtacaagcggtctgaagggctga

SEQ ID NO: 1885 - DNA (genomic), 744 bp, Enterococcus faecium; double-stranded, circular
  misc_feature (B) LOCATION 1...744
  hypothetical: NO
  anti-sense: NO
agaagggaagaagatgctgtgaggtgcagttgctgcagtaaagatatcgtccaaaatttaacattcagcgagattattggtgtttcgaaatacagattacctcagacttgttcagtttgtcgcgcacaatttcatttattggaaacaagaggctgttctggctgtcaaaaaccaatccatttcaatctagagagtacgaaaaagaaagtaaagtctattcccgtttactgcagtgactgtcaagaatggaagaagaaatatccgacctatgattttcagcaccgtgccttttttgtgtacgatgaaaatatgaaggcctggctcaatcaatacaagtttatgggagatatccgactagcaggcacctttgcatataaatggacgcagataaaaaaagaatacccgacatacatctattgtccaatacctttatctgaaaaaaggcgaacagaaagaggattcaatcaagtaagcgagatgttgaaagcagcaagaattccttttcagatgctactcaaaagagagaagcatctgctggctcaagcaaaaaacacgcgaaaggaaagattggagatgcctcaaccttttgaacttgcagtcaccttttctaagatacaaaataaaaaaatattgattattgatgatgtctatacaacaggacagactcttttccacgcagcagattgtttgcaggtcgcacagccgaaaaatcatccgaaccatttcattctgacccagatttga

SEQ ID NO: 1886 - DNA (genomic), 678 bp, Enterococcus faecium; double-stranded, circular
  misc_feature (B) LOCATION 1...678
  hypothetical: NO
  anti-sense: NO
ttganggaagaaaatgccccgattggaattcggttagtaattaatttcggccagatgaaaacagcagtgccaagttggtggtgccttaagctgttgaccgcgaatcttnttctggaacaattacccgaaaaagtcaaggggcatccattagttacagtgataaacgaagaaattaatgaaataccggaaggaatcaccgtagtagcaacaggacctttgacttctcatccattagcagaaagcatcaaagcattcaatggttcagatggtttttatttctatgatgcagctgcaccaatcgtagacaaagctacgatcgatatggataaagtatatttgaagtcccgctatgacaaaggagaagcagcttacttgaactgtccgatgacagaagaggaattcaaagctttccatgaggcactaatcaatgccgaagtggcagaacttaaatcttttgagaaagaaaaatattttgaaggatgtatgccaattgaagtaatgtttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaa

SEQ ID NO: 1887 - DNA (genomic), 819 bp, Enterococcus faecium; double-stranded, circular
  misc_feature (B) LOCATION 1...819
  hypothetical: NO
  anti-sense: NO
nggnnanaagacgtggcanttatggtgaanacccaccaagatgatgtttcggcatatcaaaagcgattgatcgaactaggaagcgaagcgaaaaagaataaactagaattgatggtcgatatttcaggagaggcattggaacgagcgggtttttcattagaagatctaacgcctttgaaagcaattggtgtaacaggtttaagaatggattatcatatttccaatcagcagattgccgactggtcacatcaattgaaaatcagtttgaatgctagcacgatcacgcctaaagatatcgatgaattgaaagaagcagaagctgatttctcacagattgaagcttggcataattattatccacgtcccgaaacagggctggacaaagaatggtatcagaaaaaaaatcaatggctcaaaattcaaggtctccttgtccaaggttttgtaccaggagatacagagttgagaggcccactatatcaaggattgccaactttggaagaacatcgagggatccatcctcttgcaggcgctctagatctattagcaagtaacacggatattgtttacatcggagatgcaggtctgtcagaaaacgttcaggagcaatttgcttctttccaaaaagaacagacagtcttgctccatacggaacctgtagatgaagaattttacgaatatatattagggaagcatacgaatcggcaagacgatgcaagagatgtcatacgaagcgtagatgcacgttttcgagagattccgcctatcccagcaagaaatacagctacgcgtatgaaagggtctattactntaagataa

SEQ ID NO: 1888 - DNA (genomic), 960 bp, Enterococcus faecium; double-stranded, circular
  misc_feature (B) LOCATION 1...960
  hypothetical: NO
  anti-sense: NO
atctatcgagaaccacgtcggatcttgctaatggtcaaagcaggaccggcaacagatgcaacaatccaagagttacttcctcaccttgataaaggcgatattttgattgacggaggaaatacattctttaaagatacgatgcgtcgtaatgaagagttagccaactctggcatcaactttatcggtacaggcgtttccggtggtgaagaaggagctttaaaaggaccttcaatcatgcctggtggacaaaaagaagcctatgcgctagttgcaccaatcttagagcaaatttctgcaaaagcagaagacggagcaccatgtgtcacatatattggcccaaatggagccggacattatgtgaaaatggtacacaacggtattgagtatggagatatgcaactgattgctgaatcttatgacttaatgaagaatattttaaacctttcagtagaagaaatggctgatatctttaaagaatggaatcaaggcgaattagacagctatttgatagaaatcactgctgacattctgacacgtaaagacgatgaaggaacaggtaaaccagtagtagatgtgatccttgatgcagctgggaataaaggaacaggtaaatggacaagccaaagcgcgcttgacttaggtgtgccacttccattgatcactgaatctgtatttgcccgctatatttctgcttataaagaagaacgcgtacaagcaagcaagattttgtctcgtacgaacgattttgagttcacgggagacaaaaaagaattggtcgaaaaaatccgagaagcgttgtatttcagtaaaatcatgagttatgcccaaagatttgctcaattacgtgtcgcttcaaaagaatttgattgggacttgccatttggtgaaatcgcaaaaatctggcgcgctgggatgtatcatccgagctcgattcttgcaaaaaattacggatgcctatga

SEQ ID NO: 1889 - DNA (genomic), 807 bp, Enterococcus faecium; double-stranded, circular
  misc_feature (B) LOCATION 1...807
  hypothetical: NO
  anti-sense: NO
caaattagagaaaggggctttaaaatgaacttagattattacgtagttgatgcatttgcagatgaggtgttcaaaggaaatccagcagcggtttatgtgctagaagaatggctgccagaaggtacgatgcaaaaaattgccattgaaaacaatttatctgaaacagcatttacagtgaagaaaaaccaagaatttgagcttagatggtttacgccagatcgagaaatcgatctttgtggtcacgcgacattagcaacagcatttgttttatttaactattacaaaatacctgatgaaacgattaaattttctactcaaagcggtaatctatttgtgacaagaattaaagattattattacatggattttcctagtattatgccgaaaaaagtgccgatattgtctgaatatgaagaagcgattggggctaagattaaagaagcctacttagcacgtgatttatttttcgtattagaagatgaaaaaacggtggctaaattgcagccagattttacagctatcaaaaattttgaattaggaataggagtcatcgtgacagcagaaagtgtgcaaaaagactttgtttctagaaccttctttccaaaattaacaatcaatgaagatccagtatgtggatcagcacattctaatcttattccttattgggcagaaagaatgaataaaacaaaattgtcagcttatcaaatgtcatcaaggggcggggatctagaatgtgaattaaaagaagatcgtgtgataataggaggaaaagcagttttgttttctaaaggtacctcgtttatttga

SEQ ID NO: 1890 - DNA (genomic), 189 bp, Enterococcus faecium; double-stranded, circular
  misc_feature (B) LOCATION 1...189
  hypothetical: NO
  anti-sense: NO
aacgttagagatattaaaagaaccaatttatcaatgtatattgctcagtccggagtcagaacagaaaaagttagaacatcgctttcccggagtgtaagttttaaggtttcaaataggtatactgtagatatcatcccaaaaggtggttcaaaattactaggcatccaaagctttcgcaaaatgctttga

SEQ ID NO: 1891 - DNA (genomic), 603 bp, Enterococcus faecium; double-stranded, circular
  misc_feature (B) LOCATION 1...603
  hypothetical: NO
  anti-sense: NO
cctaacagagaggtgagaaaaatgctaattgatgtacgggaaaagaagaattttttaacgtggatggtcaatcatgtatcttttagccgaagagaagttttttggatcttgaattatcttgccaatcatgaagcgattttaagcaatgtccactttgttgaaggggcgaattttgcggatcgaggactgcagatcagtgatctatctgttgaaggggaacccatgaaattgtttttgcagggaaaagaatttacggacacagaccagatttttcatgaaatccgtttgaattggaaaaagcctttatatgtggaatgtatattcgaaaatgcttggcagacaagagaatatctatctatcttagaagacaatccattttcttcttgggattcttcagtcagtgaagaagatactgaattaattgaacgatattttcaagaaaaagaagaagaggcaaaactaaaaatgctttatgctcaaatcgatcaagcactagaagatggagatagggatgcttttttgaaattatctgatgaagttaaccgaaagatccttttgcagacacaaaagaaaagtaaccgggtaagtgaacataacaattag

SEQ ID NO: 1892 - DNA (genomic), 1032 bp, Enterococcus faecium; double-stranded, circular
  misc_feature (B) LOCATION 1...1032
  hypothetical: NO
  anti-sense: NO
gtgatgagagaatttgaaaaatccaacaaattagaaggtgtcagttacgatgttcgcggtcccgttctagaagaagcggagcggatgcaagaagagggcattagtattttaaaattgaacacgggaaatcccgcaccttttggatttgaagcaccaaacgaagtcattcgtgatttgatcatgaatgcccgtgactcagaaggctactcagattccaaggggatcttttttgctagaaaagcaattgagcaatattcccaactgagacattttccgaatgtgacgatcaatgatatttacaccggcaacggagtgagcgaattgatcacgatgtgtatgcaggggttgctggacaatggagatgaagtactggttccaatgccggactatccgttgtggacggcttctattgcattagctggaggcacacctgttcattatatttgcgatgaagaggcagaatggtatcctgatattgatgatatcaaatcaaaaataacgagtcggacaaaagctattgttatcattaatcctaataatcctactggggcactttatccaaaagaattattagaagaaatcgttgaagtagctcgacaaaataacctgattatttattccgacgaaatctatgatcgcttagtgatggatggtctagaacatattccgattgcaacattagcgcatgatttgttcgttgttacgctgaacggtctatccaaatctcatcgtgtagcaggatttcgagtaggctggatggtcctaagtggagataagtcacacgtcaaaggctatatagaagggctgaatatgttgtcctccatgcgtttgtgttccaatgtattgtctcagcaattatcccaacccgcgttaggccggttatcaaaagtgtccgatgagctgctcctgccaggcggaaggatctatgaacaaagagaatatatctataatgcaatcaatgatattcctggtctttcagccgtaaaaccaaaagatgcttttaatatattcccaaagaccgaacggaccgat

SEQ ID NO: 1893 - DNA (genomic), 384 bp, Enterococcus faecium; double-stranded, circular
  misc_feature (B) LOCATION 1...384
  hypothetical: NO
  anti-sense: NO
agtaagagagaaggggaaaaagtgaaaaaacttctgatcggtctacttgttttcatcgttgtggtacttgcaggggtgaaaatcgcagattacgtagttatgggtggagaagaatactatgtacaaattacgacagatggtacaaaaacagtttcaaaatcagactctggacaagaaacagtcaactatagatatatcctgcctggctatacgaaagagggtaaggaaaaagaactggacttcaagggacaattgactcgaccgcttcgtaaaggagcatatttaaaaatcacctggaacaaaaataaaggtgtcacttcgtatgaagaagtcgaaaaaaaagacgtgccgaaaacagcactggaaaaactaattaaagggtag

SEQ ID NO: 1894 - DNA (genomic), 459 bp, Enterococcus faecium; double-stranded, circular
  misc_feature (B) LOCATION 1...459
  hypothetical: NO
  anti-sense: NO
gtaaggagagaaaaaatgatccgcacaacaacaaaattgtctgccaaagaactggaatctgttctatcgatttggctgcatgctaacttggattctcatgaattcattccatcaacttattgggagaatcaagtagaatctgttaggaaagctttaccagatgcagtgatttacttagcagaaatagatcaagaaattattggttttgctggggtgattgatcagtttatcgcaggaatctttgtgaaaagggaataccggcaacaaagaatcggtacgcaactaatgaaaaaaataaaagaaaccaataaaacactgactttgacagtctatcaaaaaaatcaatcagctattcatttctatctttcacaaggttttacaattcaaacacagcaaaaagatgaagcagtaaatgaggaggaacttgtgatgaaatggaatcaaaacgctgatttttga

SEQ ID NO: 1895 - DNA (genomic), 795 bp, Enterococcus faecium; double-stranded, circular
  misc_feature (B) LOCATION 1...795
  hypothetical: NO
  anti-sense: NO
gaaagtggagaaaaaatggaagagacaatcagcttgaaagaaatttttgaaacattgcgcaaacacgtgataacaatcctcatctcaatgtttgctggcttggccatctcaggcatcgtgacgtttttcatcttgacgccaaaatacagctcacaagcccaattgatcgtgacactgccgcaatcagatactgcaaatgtcaatgatgtcaatacgaacctgcaaatgatcaatacgtataaagatatgatcgtcagtgatctagtactaaatgaagtcaaagatcgtttagaaacagaagacaatgtgaaaatgactgctggacaaattaaagatgctatctccgtcaatcagtcacaaaattcacaaatgttctcgatccaagcaacaagcacaaatgcagtgacggctcaacaaatcgctaatacaacgtcacaagtattccaagagaacgccaaagatgtgatgaatgtcgataaaatctcgatcatctcaggtgcagttgccaatacgacacctatttcgccaaataataaattgaatctagtgattggcttagtgttaggaatgatggtaggcgtaggtctagctttcttatttgaattactcgatcggacagtaaaagatgaaaaatatgtgacggatacattgggcttcccgatcttagggactgtatcagaaatgtcagcgaaagaattgaatgctggtatccgtaaaaaaggaccagctcagacacaaccaaaagctacaaacgataaaacagcgccatcacgcagaagccgctcaagagtctag

SEQ ID NO: 1896 - DNA (genomic), 486 bp, Enterococcus faecium; double-stranded, circular
  misc_feature (B) LOCATION 1...486
  hypothetical: NO
  anti-sense: NO
aaaataggagaaaaagtagaaaagaaggtgtttgttatttgggaagtagttaaatcgagagtacaagaaatgaatgaacatttctcagtgtcattcgcagaaaatccaagtaagtattttcgacgtcttgtttttctgctcatcttatcattgctgttaacagttgcaatgtttttattgccggaaaaaatccgagaagagcaagtaaatagtctcgtttattcgtccataccaaccagcaaattgaaaccttttgattacagcaaagctgatcagaaaatcaaacaaagccgggcgatatcggtgatgttcagcaaaccgaacgggaaaacctatcaggacatgcttgatgtttttaatgatcctgagcttatggaagaattgaatcgaccgatcttttattatccgatcgtttatgatgtacatgaactggaacaaaaatataacatacgaacggatgaagtgacatttattttctttgattga

SEQ ID NO: 1897 - DNA (genomic), 1251 bp, Enterococcus faecium; double-stranded, circular
  misc_feature (B) LOCATION 1...1251
  hypothetical: NO
  anti-sense: NO
ttaaaaggagagaatactatgtacgaaaatcttttgccacgttttttacgatatgtcaaaacagaaacacgctccgatgcaacaagcaaaacgactccatcgactcagacacaagttgcttttgcgcaagaattgaaaaaagaattagaagagttaggcttagctgatgttttctataatgaagataacggattcgttatgggaacattaccaagcaatgttgatcatgaagtgcgttccattggatttatttcccacatggatacagcagattttaatgcagtaggagtcaatccacaaatcattgaaaactatgatggcgagtctacgatcgtactagatgcggaagaacgctatacattgaatacaaaagattttccaaatttgaaaaattatgaaggccacacattgatcacaacagatggcagtacattactgggagcagatgacaaatcagggattgcggaaatcatgactgcaatggagatcttgatcaataatccttctatccctcacggtaccatcaaagtggcttttggtcctgatgaagaaatcggtgtcggagcggataaattcgatgttgagcaattcgatgtagattttgcttatacagtcgatggtggtcctttaggtgagttgcagtatgaaacgtttagtgctgctcaagcaaatattacgatccaagggaaaaatgtacatccagggacggcaaaagatacaatgatcaatgctctacagttagcaatcgattttcataatcagcttccagccgatgaagttccagaaaaaacggaaggatacgaaggtttcttccatttgatggcattggatgggaatcctgaagaagcttctatgagttatatcattcgcgatcatgatcgtgaaaaattcgaagcacgcaaagcacaaatcacacatatccaagaagagttgaatcagcgatttgatcaagaacgaatcaaagtagatatgtatgatcaatattacaacatgaaagaaatcattgaaaaagatatgagcatcgtggaattagcgaaacaagcaatgatcgagcttggtatctctccagtgatcgaaccagttcgtggaggaacagatggttcaaaaatctcttacatgggtattccgacgccaaatctatttgccggaggagaaaatatgcacggacgattcgaatttgtttctttacaagtaatggaaaaagcaacagacgtgattgtaaaaattgcagaattgaacacaaagagttaa

SEQ ID NO: 1898 - DNA (genomic), 921 bp, Enterococcus faecium; double-stranded, circular
  misc_feature (B) LOCATION 1...921
  hypothetical: NO
  anti-sense: NO
aatgaaggagagaagagtgccatgtattcccaaaaagaaaatttaaaaaaactaaagaaaacttataaagaacaagcaattcccaaagggcttaaagaggagatccgccagcgttttattatcgaagagcaatcatttataaaagcaaagcggagaaagagacgtctccaagggttcggagtatctttggctatcgtaatgattacaacaagtagccttctttttaatagtcaagttcgaagctttgcagaagatttacccatcttaggatcagtcattgaattgatcttaggcgaacgctttactgatcgatctgaaaaaatcgatattcaggtaccgaagatcaatacacaaaatgagaaagaaaataaaacaattcatggattaaatcaaaaatactttcgcgaaggacaagcagattttgaaaaagctgaaaaagaatatggaaattttgaaacggatcattaccaagttttgggagattatcagaaaatcgtagacgataaccggtttctcgtgattgaaaggcagatcacccaaacagcagcagatagccatgttgaaaaaagatacgacacaatcgacaagaaaaacagtgtccagctctcacttccacttttattcaaagatgacacctatctatctgttttgacaaaagaagtcaaacggcagatggccgaacaagtcaaggaagatccatctaagtactattggactgagcaagatattcaagaagggacgatagaaaaaccaacacttgttacgcctacacgaagtttttatttgaacaaagagcatcaattagttttgactttttctcaatacgaaattgctcctggttatatgggtacaccagaatttgtcattcctaagtccgtgacaaaaacgattttggcatcggaagattatttggatcattag

SEQ ID NO: 1899 - DNA (genomic), 849 bp, Enterococcus faecium; double-stranded, circular
  misc_feature (B) LOCATION 1...849
  hypothetical: NO
  anti-sense: NO
cggcagggagaaatctccaccttatatgcttactttgccgacatcacggaacctaatgaaagaaccaaagtttttggatggatgggtgctttagtcggtataggaacaacgctgggtcctattatagggggtctattagctgagttggggaattctgttcctatatttattggagcactctttactttcttaaatgccgtttatggctacacatttatgctagaaagccttccaataaaaaaacgttcagtagatttaagtttctcccatgtaagaccttttcaccaattacaacaattattcaagatttcatccgttattcctttattgacagcaggttttgctgtttggttggcagctggctctcttcaatctatcttttctcaattttcgattgacgcctttcagtggaaggctgggttggttggtttaagcttctctttgattggaatcttggatactgtctcgcaattgttcattatgcctcgattgctcaaaaaattttcagaacagcagatcacaagaatagggatgttcagtgaaatcctcgcctatctattcatcacattatctggaattcttctactgccgattttgtttttatttgggattatctgttatggtttcggtgattctatttttactcctgtattcaatggccaactatccaattctgtctcagataaccagcaaggtcttgtaatgggcggtacccaaagtatacaatctctatcgcgcgtcatcggcccgctaatcgcaggacagctttatgctgcagcaccatttcttccgacggtattcggatttttgcttatgatttttgcctattatcactacaataaaaaatag

SEQ ID NO: 1900 - DNA (genomic), 684 bp, Enterococcus faecium; double-stranded, circular
  misc_feature (B) LOCATION 1...684
  hypothetical: NO
  anti-sense: NO
ttagggggagaaaaaatgattttttcaattacaatgaaactggtgttcgggttgatcggtttattattagtggtacgtttgcttgggaagaaatccatgtcagaaatcacaccgtttgatttagtctatacgcttgttttaggtgggatcttagaagaatcaacctatgatgacaatgtccatgtagggcatgtcctatttgccattgcgctttgggcagtaatgatttatggtatcgaacgtatcgtccaaaaaaatgaaaaggtcaatcgttgggtcaaaggcgagccatctgttctaatcaaagacggcgtcatcaacatgacagagttgacaaataaccatatcgagatggagcagttgcgagcaatcttaagacagcaagaatgcttttttcttgaaaatgccaaacatgttatcctagagaatgccggtcaaatgagtgtattgaaaaaatcagatgaagacaaagctttatcgatcctgcttgtagatgaagggcaaattcagcataaagtgcttcagtccaatcaattgactgaagcatggcttatggagaacttgaagaaagaaggctatgcagatgtaaaacagctgatttatgttgaatggtcagaagaaaaagggctctacatactaaataaagaagacgtcatgcatgaatcttaccgaatagatggatag

SEQ ID NO: 1901 - DNA (genomic), 1161 bp, Enterococcus faecium; double-stranded, circular
  misc_feature (B) LOCATION 1...1161
  hypothetical: NO
  anti-sense: NO
tttgacttggaacctcgtggctggcccagtagcatagagtatgaaataaattcaacaaactgcggtgaaaatactataggtgaaggattttttaccgcagttgttgttgaaaggatgtggtggacaatgaatcaaagtaaacgactgtttgtttcgtttttttctattttaagtctatttttcatttttccgtcaatcagccaagcaaaggattcagcaggagactttggaatcaaaccggtatttccagagaaccaaatagataaagcaatcggttattttgatttattagtggcaccggaacaaaatcagacactagaagtaattatcagcaattcttcagatgaagaacgaacatttgaggtctctgtcaatccggcggtaacgagtgatggtggaacgatcgattatagtcaaaaaaacccaacgttagatgagacattgccgtttgatgtccgtgacgttttgctcattgcgaaaaaggaaatcaatgtatcagcacatgcagaaacaactatacctatagaagtgaaaatcccagcaaaaagctttaagggacgtgtattagcgggtattcatgtttcacctaaagaagaagctgaaacagaaaatgctacagaaggagcacaaatcaaaaatcgtattgcttataatctcgcagtcgttttacaagaaagtcaagagacgatagaaccggatctgaaacttttatcaggagatttggacgaggtcaacgcaaagccaactgttcagcttcgtttccaaaatcctcagcctaggattatcagcaatttgatatttacgagcaagatcttttatgaaaatcagctttatattgaaaatacgtctaatgaatttttagttgcaccaaattcgaattttcacttgaatcttgatttagctggtgataaagcaaaagccggcgattaccgcgcagaaatcatagcaaaatcaggcgacagtaatgaatggcgatttacacaaaactttacgatcaaaaaagaaaaagcacaaaaagtaaatgaaaattccgtttttgcagtacaagaacaatctttcccatggctttatgcaggattggttgctgcagttctagtgttatggttgattttgctgtttttgtgggtccacaagaaaaagaaaaaaggagaaacaacatga

SEQ ID NO: 1902 - DNA (genomic), 207 bp, Enterococcus faecium; double-stranded, circular
  misc_feature (B) LOCATION 1...207
  hypothetical: NO
  anti-sense: NO
ataccattggaggacattaggtcaatccaaattatcgctatcaacatcgatggaactttattaaatgaggaaagagaattaacgaaagaagtaaaagaagcgattgccgctgctgttgcaaaaggggtttcgatcgttttatgcactggccgtcctttaccagggttccaggaacagttagnacgagttgaacctttttcaagataa

SEQ ID NO: 1903 - DNA (genomic), 603 bp, Enterococcus faecium; double-stranded, circular
  misc_feature (B) LOCATION 1...603
  hypothetical: NO
  anti-sense: NO
ttggaattggaggaattaggtgtggaaacagtgagattatggatattcatgaaaaattttcgttcggctttgagatatgttattctggaatcaaaatcaggttattatctgattgacacagatcactatactttttggggaggctacctttttccgatttttaattggataatcccccataaggttatgaaaattaacttgcctgcagaagaaataaatagattaatactcaacaaagatttacaaaggaaaagagagaaagaacattctaatgttgcttggataggtccagcatttgcagtagtgacttcttcaattgtcggtcctatgctagagagtatttatagtgatttttctattggaatacgttatttatttgttactttaagtatagctgttcttttgtgcataaagggttatgttagcaagaagaataaagatattttaacactaatcggtgtaaacaatttatctagtactaaaattatactgtttcctgaatctataaaagaaggatcaaggttgttgataatttttataatgcttatactgttttctgttttatttggggtgatgtttatagattattatttgtcaaattaa

SEQ ID NO: 1904 - DNA (genomic), 726 bp, Enterococcus faecium; double-stranded, circular
  misc_feature (B) LOCATION 1...726
  hypothetical: NO
  anti-sense: NO
aatggattggatgaacgctcgctaacgttccacattggaccaatttggtttgatggtacagtttgtataatggtgttactgacctgtttgattgttttcttcttagcttacttttttacaagaaatcttaagttgaaaccaacaggcaaacaaaatgcgatagaatgggtcattgattttagtcgaggaatcgtaacagataatctgcctagaaaagaattgagcaatttccatttgttggcatttacattgtttttatttgtttttgttgcaaacaacatcggtttagtaacaaaaatcgttttacctaacgaaacaacactttggaaaagcccgacagcagacccgtttgttactttaactttggcatttataatgatcttacttactcacttatttggggtgaaaaagttaggcttcaaaggatatttcgtaaattcgttcttgaaaccatatagttttatgtttccgatgaaactgattgaagaatttacaaacttattaacacttgctttacgtctttatgggaatatttatgcgggggaagttttgctaaccttgattgcaaaaatggtaataagcttaggctggttctcattgccgttagcaattccattagagatggtctggatcgcattctccttgtttatcggaagcatccaagcatttgtcttcgttactttatctatggtttatatgagccataagattgaagtggaagaataa

SEQ ID NO: 1905 - DNA (genomic), 414 bp, Enterococcus faecium; double-stranded, circular
  misc_feature (B) LOCATION 1...414
  hypothetical: NO
  anti-sense: NO
aatgagttggaggaaacagctatgccaaaaggcgagggaaaattaattgcacaaaacaagaaagctcgccatgattattcgatcatcgacacgatggaagcagggatggtcttgcaaggaaccgagatcaagtcgatacgaaacagccggatcaatctaaaagatggatttattcgcgtccgcaacggagaagctttcttgcataatgttcatatcagtccttatgaacaaggaaatatttttaatcatgatccgttgcgcacgagaaagttattattacacaaaaaacaaatcatccggcttgaaaatgaattgaaaaatactggaatcactgttgttcctttaaaagtctatattcgtaacggctatgccaaggtattgattggtctggcgaaagggaaaaaatctttatga

SEQ ID NO: 1906 - DNA (genomic), 642 bp, Enterococcus faecium; double-stranded, circular
  misc_feature (B) LOCATION 1...642
  hypothetical: NO
  anti-sense: NO
aatcttagtttggaggaagttattttgttacaaagtattttttcagctatcgctgtttatatttctaccagtattgattatttgtttatcttgctcattatcttttctcaaagccacacacaaaaaggtattcgtcacattttttggggtcaatatcttggaacaggtattttggtagccgtaagtttgtttgctgcttatgtgctaaattttattccgcaagattggatcattggacttcttggattaattccaatttatttaggtattcgtgtcgctgtgataggtgaagaggaggaagaagaagaggaagtcgttgaaaagttagaatctagaggaaccagttggttattttggactgtcgccttaataaccattgcgtcaggtggcgataatttaggcatttatattccttactttacttcgttagccttttcagaaattgttattactttaatcgtatttgctttctctgttgcaattctttgctatgtcagttataaattagcaaaaatttcctttgtttccgaaacattagaaaaatatgaacgaatcattgttcctatagtgtttattggtttaggaatttatatatcgatcgaaaatggtacgattcaaactttattaagtttatttaattaa

SEQ ID NO: 1907 - DNA (genomic), 189 bp, Enterococcus faecium; double-stranded, circular
  misc_feature (B) LOCATION 1...189
  hypothetical: NO
  anti-sense: NO
gccaaactggaagaagaagctcatgtagcagaagtaccagttattccccatgaaacagttgtatttttgaaatttttacttggacagcttcagcctgaacgaatcttggagatcggagcagctatcggtttttcatcaagtgtcatggccacgacaatcggagaaaaacgctcatgttacgacaattga

SEQ ID NO: 1908 - DNA (genomic), 702 bp, Enterococcus faecium; double-stranded, circular
  misc_feature (B) LOCATION 1...702
  hypothetical: NO
  anti-sense: NO
aaaatgctggaacaactgaaagaagaagtataccaagcaaatcttgacttgcctaaacacggactcgtcaaatatacatggggaaatgtgagcgcttttgatcctgaaacacgatatttcgttatcaaacctagcggagtcagttatgaagagatgacagcagacgacatggtcgttgtggacttggacaatcatatcattgaaggtaaactcaatccctcttcggatacgcctactcatgctgttttatatcgttcatttcctcaaatcggaggaatcgtccatactcactcgacatgggcgacgatctgggcacaagcaggattggatgttcctgcgatggggacgacgcatgcagatactttttatggatcggtaccttgtgctcgatttttgacacaacaggaaatcgacagcgggtacgaatatgaaacaggaaaagttatcatagaaacattcaaagaacgcaaaattgatcccttagcaattccaggggtacttttacacggacacggtccatttacttgggggaaagatgcgcaaagtgcggtaatgaacgcagtcgtactagatgaagtatgcaagatgaatttatttaccagacagctcaattcattttcagaagagctgcctcaacggattttagataaacattatttacgaaaacacggaaaaaatgcgtattacggacaaaacaaataa

SEQ ID NO: 1909 - DNA (genomic), 1617 bp, Enterococcus faecium; double-stranded, circular
  misc_feature (B) LOCATION 1...1617
  hypothetical: NO
  anti-sense: NO
aaatggctggaaggcaagcgacaggagatggaccgtatgtataagcgacaattattagaattaattcgagttaatcttttatatgttaatccacagctcacgaataaagcaagagagaaaggaaaaaagggaaagcgattaactatctatcttttgtctcaaaatcttttttcagggctgatttttttactgatttacggatttgctatgtttgctatgaactttgttaaattgccaggtttctttacttattacgtggcactttttggtatgttaggtttaactcaaagtatatcagtcatttataatatcttttttgaaggaaatgacctgcaagtatttttgcctctgccttttggacaagaacaggttttttcagcaaagattttggtagttgctttgaccatcattccttttgtttttccgcttctagtcatgtttattttaaccggatggcgagctgatctagggattttgcttactatcattatctcaatccttttgttttctctatttttgattattcttttttgtctggctagtttgattgtttttggtttggctcgaacagcagtgtttaaaaaacatagaaaaacagtttctagtatcttgcttggcagctcgatgctgatcgcatttgctggaatcatgtggatgaatcatcaaacggggactattgaaaatgagttaacagatcggcatccgatttcgatattattgccattctatgatgctgccagtcagccactttctcaacaaggtttattgggttggggaatactagctatcacggctctgggatttttccttgctgtaaaacagctgatagtaccaaagcttacagagcaactgactgattcaaacagtgagttcaaaataaaaagaacccataaaaagaaccaaaatgtgcatcagcttttatttagttacaatgctcaattagtaaaagaacctaatttgattatgcaagttctttcttcttccttgttaactccaatcatttttattcttgcttttgccctaggaggcgaaataaaattaactgatttagataataagttaatcggtgttgttttcctggtagggatcgcattggctttcttaacagttaatcagacttcttttatcagcaatcttatttctttggatcaagaaaattttctgtttatccgttctttgccaatctctatgaaccaatatttaaaagaaaagttcagattcggatggatattgcagagttttttaactggtgggatcgcattattaagcggactgtcttttcagctgcctttgttttttatccctagcttgctatttggttctttattcggctgctacttattgtcactacgttatttcgctagagattatcggttgctgctgctgaactggaccaatattaaccaattatttaacagaggttcaggaagtttgggtttagtcgcaactatgatgggttcattgatcatcagtattattcttatcgtcttatacggaatgttggctttgttttatccattttggttagtgaatattcctgtgatcggtttagttctaatactttccgctctatggatcgtttattatcaacgaacgttttggaaaaaatttgaataa

SEQ ID NO: 1910 - DNA (genomic), 1653 bp, Enterococcus faecium; double-stranded, circular
  misc_feature (B) LOCATION 1...1653
  hypothetical: NO
  anti-sense: NO
ctaattatggaaaaaccaaaccgcaactgggcttctaaacgcgaaaaaaaagcgcagcgattggaaaaaatcagcaacttgctcaatggcaagtatgtagaaactgaaaaaatcgtagaagtaatggaaaaactgattgctcccggcgacaaagttgtattagaaggcgacaatcaaaaacaagcaagttttctttcagaaagtcttgaaaaagtagatgcagaaaaagtgaatgatctgcatttgatcatgtctagtatctcacgaccagaacatttgaatatttttgaaaaaggaatcgcaagcaagatcgatttctcttatgctggtgcacaaagcttgcgtgtcgcccaaatgattgaagacggcacaatgaaattaggtgatatccatacttatttggaactttatggacgcttattcatcgatttgattccaaatgttgttttagtagctgcagataaagcagataaagacggcaacttgtacacaggtttcaatacggaagaaacaccaacaatcatcgaagctgcagctttcaaagatggtatcgtgatcgttcaagttaacgaagttgtcgattctttaccacgtgtagatatccctggtgactgggtagacgttgtcgtgaaagcagataaaccttatcaattagaagctttattcacacgagatcctcaaaacatcacagaattgcaaattctaatggcaatgatggcaatcaaaggaatctacgcagaacacggcgtacaatctttgaatcacggtattggattcaatacagcagctatcgaattgttactgccaacttatggtgaatcactagggttaaaagggaaaatcgcgaagaactgggtattgaacccacatccaacgatgattccagccatcgaatcaggttgggttgaaagcatccatagttttggtggcgaagttggtatggaaaaatatattgctgctcgcccagatgtcttttttgtcggtaaagacggcacgatgcgcagtaaccgaacattatcacaagctgcaggacaatatgccatcgatatgtttatcggttcaaccttgcaattagattacgaaggaaactcttctaccgtaacaaaaggacgtttatctggttttggcggtgcgcctaacatgggacataatcctggcggtcgtcgtcattctacaccagcatggcaatcacttcgcgacaatgatgatccattagggaaaggccaaaaattagttgttcaaatggttgaaacatatggttcaaataaaaaaccagtctttgtcgaagaattagatgcactagctgttcaaaaacaagcaggcttagccaatgcaccagtgatgatttatagcgaagatactacacatatcgtgacagaagaaggaattgcttatttgtacaaagcaaaaacaaaagaagaacgacaagcagcaattgcagcaattggcggtgttacacctcttggaatgactagcacgaaagaatcactagatagcttgcgtgcagccggcatcgtgaaattaccagaagatctaggcatcaaacgtagtgaagcgaaacgttcattattagctgcacaaaccatcgatgatttgatcgaatggtcagatggcctgtatgaaccaccaatgaaattcagaacttggtcataa

SEQ ID NO: 1911 - DNA (genomic), 264 bp, Enterococcus faecium; double-stranded, circular
  misc_feature (B) LOCATION 1...264
  hypothetical: NO
  anti-sense: NO
aattatatggaaatcagaagacaaaaagaagttgtagaagcatttcattatgatatgagattgccgaaccaagaagtagaaacagatttgaaagtaggcttctcgcctttaaaagaaacgatcgaaaactatccgaaagaacatagcatcgtaggagcacgcttagagttccgtttagtgtttgatacatatgttttatctggaagtgtgagtcagatcaatcatatcctcaatcggaaaattgaaggtcaaaatgatgtcaca

SEQ ID NO: 1912 - DNA (genomic), 642 bp, Enterococcus faecium; double-stranded, circular
  misc_feature (B) LOCATION 1...642
  hypothetical: NO
  anti-sense: NO
cgagatatggagggttatgcaatgaaaataagccatttaggaaataatatacagaccataagaaaatttagaggaatgaaacaacaggaacttgcggacaaaatcggtatcaatatgcagagcctttccaagattgaacgaggattgaattatcctgcttatgaaacgctggaaaagataatggaagtgctggacgttacgccgaatgaattgttgtcgggggaatggaaatatgtcaatcaatccgaaaaggaagtctgccagtttttaagagcagaagaacgactaaatgcagagctgaaacatggacactatgataacttctttgacagcgaggaagaatggctggaatatgagttagaaaagttacgggaatacattaccgactacatcaatggaacaaacattgaagcgtccgacctttacccaatcaaagaatttatccagcatttgaagtttcaaaaactgttagaccgctatgatgatttatacagcatggatatgtttggggaaagcatagagggacataaatataggacaccttatcaagtggtcaaaatgataaaccctaattcaaaagaagatatggaattattacgggaagtattaaggaataaccattttgatgatgaggacgaataa

SEQ ID NO: 1913 - DNA (genomic), 363 bp, Enterococcus faecium; double-stranded, circular
  misc_feature (B) LOCATION 1...363
  hypothetical: NO
  anti-sense: NO
ttgggtatggaaaaaatatcttttgaaacatttaaaagacctaatggtcatgatgaatttttagaatggttggaaacattaccaaaaaaagatagtgcgaagcttttacgtacaatagaagaaacagaaaagaatgggatgctagtagctcaacggttgaaatgggtgaaaaaattagacactaatttgtacgaattaagaagtaaggtaggatcaaacatccaaagagctatctatttccatgtggtcaatggaaggtatgtcattacccatggatttactaaaaaaacggagaaaacaccaataagtgaacttaaacatgcaaaagaacttagagaggagtggttcacaaatgatgattaa

SEQ ID NO: 1914 - DNA (genomic), 1194 bp, Enterococcus faecium; double-stranded, circular
  misc_feature (B) LOCATION 1...1194
  hypothetical: NO
  anti-sense: NO
ctcatcatggaaatcaaaagaagcttaaacacaaaatttgccgaaacattcggacctaaaaaaactacacaatacttctcaccaggacgcatcaatttgattggtgaacacacagattacaatggaggccatgtcttccccgcttccatcacttatggaacgcaaggtgtagcagcacctcgagacgataataaaatattagtttattccacaaactttgacgatatcggtgtcattagttttactttagatgagctagaatatgataaaaaagcaaactgggcaaattacgtaaaaggaatggtccttaaattaaaagaagctggacactcaatcgatcatgggtttgagttattagtggaaggaacaatccctaatggtgcaggactttccagtagcgcttcattagaattattagtaggtgttgtattagaagatctgtttgatttaaaaacagatcgcttggaactagtccaaacaggtaaaaaagtagaaaatgaattcatcggtgtcaattcaggtatcatggatcagtttgccatcggcttcggtgagctagatcatgcaatcttattagatacaaatacgctgaaatacgaaatggttccagtgaaactagatggttatgcaatcgtcatcatgaatacgaataagcggcgggaattggcagattcaaaatacaatgaacgccgtagcgaatgcgaagaagccttggcacgtttgcaaaaaactttgcctatctcttctttaggagacttagatgaagaagaatttgaatcaactattgaccaaatcggcgatgatacattgatacgcagagctcgccatgccgtttctgaaaatcagcggactttgaaggcaaaagctgaattagaagctgggaacttagaagcatttggtcaactgttaaatgattctcaccactctcttcgctatgattatgaagtaactgggatcgaattagatacactagtagatgctgctcaaaaacaagaaggtgtcttaggtgcacgaatgacaggagctggatttggtggctgtgcgattgctcttgtcaaagaagaaaatatacctgccttcaaaaacaatgtctatgatgaatacatgaaagttgtcggctatgctccggaattttatgttgcacacattggaaatgggacaacaaagatcgatccagaagctgttcatgtttga

SEQ ID NO: 1915 - DNA (genomic), 195 bp, Enterococcus faecium; double-stranded, circular
  misc_feature (B) LOCATION 1...195
  hypothetical: NO
  anti-sense: NO
ttttacatggaggattacccaagtccggctgaagggaacggtcttgaaaaccgtcaggcgggtaaaaccgtgcaagggttcgaatcccttatcctcctttttcatattatcgcgggatggagcagtctggtagctcgtcgggctcataacccgaaggtcgtaggttcaaatcctgctcccgcaattaaaaactaa

SEQ ID NO: 1916 - DNA (genomic), 186 bp, Enterococcus faecium; double-stranded, circular
  misc_feature (B) LOCATION 1...186
  hypothetical: NO
  anti-sense: NO
gataacatggaaaaaatgacatgccctaattgcggaaaaaaatttgcatacgaagaagtcaataatgtagtcgaacataatgataaagaaatgccagtcgtctgcccttattgccgaactgaagcggcaagaatcgttactcatggttatttcattactgaaaagattgaagattttttaaaataa

SEQ ID NO: 1917 - DNA (genomic), 381 bp, Enterococcus faecium; double-stranded, circular
  misc_feature (B) LOCATION 1...381
  hypothetical: NO
  anti-sense: NO
gcgaacatggataagatgaagatccaagagattatagtcgttgaaggaaaagacgatacaagaaggctgcgggaagtagttgatgcagatacgatagaaacaatagggtctgcaatcaatgaagagatcctgatgcaaattgaacatgcccaagagactcgtggagtgatcgtttttaccgatcctgatttttcaggagaaaaaataagaaagatcattatggaagctgttcctcaggcaaaacatgattttttgccgcgcaaacaagctaaaccaaagaaaaaagggaagccttggtgtcgagcatgcaagcgatgctgttattttagaagcattgaaaaaggtcgtgacgccagacatttcccaaacggctgtttctga

SEQ ID NO: 1918 - DNA (genomic), 1272 bp, Enterococcus faecium; double-stranded, circular
  misc_feature (B) LOCATION 1...1272
  hypothetical: NO
  anti-sense: NO
gagggcatggaaagggatacagatagggagaaaatgtggcaggctttatcagatgaagacttgtcacaagcacaaatctttttagaaaaagcattaaatgcagacccagcagatatattagctgaagtaggcgaagaattgctggctattggctttttgatcgaagcaaaacagatttttgaacaactgatcaaccaatacccagaaaatgacggactgaacatcccgttagcagaaattgcaatcgaagataatgagatcgacttagcttttgaatacctggaaaaagtggataagcaaagtgattactatccgcaaagcttattggcgatagctgatttgtaccaagttatcggaatccctgaagtgagtgaagcaaaattgaaagaagcagctgggttgcttcctgatgaaccattgatccagtttgcgctagctgaattgtatttttcagttgatcgtttcaaagaggcagcagtggtttatgaaacattgttggcaagcgggataaatgaaatttcaggaatctcgatgcaggaacgtttaggacaatccttaagtatgcaaggagaattcgaagcagctatcgtacctttagaagaagcactgaaagaagaaaggacagatgatcgactgttccagctagcttttacgaatcttcaattgaaagaaaatcagcaggcaatcaactatctggaagaacttcgagaagttaatccgcattatcaatcgttatatctatatctaggacaagctcttcaagaagaagaaatgattgaagaagcacaaacagtgttagaagaaggaatcaaagaaaatccttaccaagtcgaactttatcacctggcctcggaaaatgctttccgtctgcatgatagacagcgagcagaagaacttttactgaaagctttagaagtaggagacaaacaagatgaaacattacttactttaagtaatctttacttggatgatgaaagatatgaagatgtgatacaagtgatcaatcagatggaagaaactgctaatccttatgcagaatggaacctagcccatgcttataatgaattagaagactttaccgttgcagctgtacactatgaacaggcttatcatgaactatcacatgaaccagatttcttgaaagagtatgcctttttcttaagagaagaagggcagctgaaaagagcgcaagaattattgacttattatttaacacttgaaccaggagatatggaggcactgtcattattagatgacctaacagagaggtga

SEQ ID NO: 1919 - DNA (genomic), 411 bp, Enterococcus faecium; double-stranded, circular
  misc_feature (B) LOCATION 1...411
  hypothetical: NO
  anti-sense: NO
atcttaatggaggaggtgtgcaatatgtcagataacgacgaacgcgtaaatgcccagttgattcgattctttgaaaaggtcattttgaacaccgctaatacttattataaaaaacaagaagaaattcaaaaacatgaacaacttgatcaactcccaccatatttgtttactaaagatactataaaatttaaacaaccgattaatgttttaaatgtgactctccttgttgaagatataaaattagcaaaaatccttcctttgttgaaagaacctgaacaaatttttcttatcgaaaaatttatctttgataaaactgataaagaaattggaaaggttctggggattacaagacagggtgcgacaaatttaaaacatcgactttacaaaaaaattcaaaaaatgctggtttaa

SEQ ID NO: 1920 - DNA (genomic), 339 bp, Enterococcus faecium; double-stranded, circular
  misc_feature (B) LOCATION 1...339
  hypothetical: NO
  anti-sense: NO
gtgataatggaggaagaaaagatgaataaagaggaattacaaatgcttggttttgagatcgttgcatattcaggcgacgctcgcagtacattattgaaattattgaaagaagtaagacaaggaaactttgaacatgttgattcggcgttgaaagaagccgacgaaaatttaacccttgcacataattcgcaaacaaaaattttagcggaagaagcatctgggaaagagatggagatgggattcatttttatccatgggcaggatcatttaatgaccactttattgctgagagatctgattcaagactttattgtactgtacagacagaatcaaggatag

SEQ ID NO: 1921 - DNA (genomic), 399 bp, Enterococcus faecium; double-stranded, circular
  misc_feature (B) LOCATION 1...399
  hypothetical: NO
  anti-sense: NO
caaacgatggatatcataacaaaatttgctgagggatttatgaggctgttccaaacaggtgcagaaacattcataagctggatgacaggaatcgtaccagttgtcttgatgctgatggttgcaatgaatacgctgattgcttttttaggtgaagaccgagtaacgaaagtagccaaattatcagcgaaaaatccgcttactcgtttacttgtgttaccgttccttatctgcttttatggggggaattctaatttaatacaacagtgtttttttttctcccgagaaaacccaccccccggtagggtgttccaaccaattttttataaagacaggggtttccccccccctatttttaggggaggttttttttggagggggggggggtgttttagaggttag

SEQ ID NO: 1922 - DNA (genomic), 231 bp, Enterococcus faecium; double-stranded, circular
  misc_feature (B) LOCATION 1...231
  hypothetical: NO
  anti-sense: NO
tccgcgatggatgcgtataccaagaaagtttcagtatcatgcttgatctttgtccatcgagggcggaaagaaggaaaagtggatttgaaatattcggatgagttcttgctcctctattttcaagcaatggtagaaggaatttctaagccggagatatacgcaaaactgcttccatatacagcagaatggacagaagtcctgatcaagggaatcgcaccgaagaagaaataa

SEQ ID NO: 1923 - DNA (genomic), 309 bp, Enterococcus faecium; double-stranded, circular
  misc_feature (B) LOCATION 1...309
  hypothetical: NO
  anti-sense: NO
gcacagatggattctttgtcgaaaaaacttgcgatccaagtattaaatgatgaagcagaacggatcaaacgattaatccgaaatcaaaacaacagtctctgtatctcacaatgcaaagccttcgaagaagtggtagatacacagatgtacggcttttcccggcaagtcggttttgctgtccgtataggagtaatcggaaagaacgagggccagctgatgttaagtgagctagaacgagaattgaatcagttatatagtgaggtttaccaagaaatttatgataaaaaagaagttggcaaggaggaatag

SEQ ID NO: 1924 - DNA (genomic), 1584 bp, Enterococcus faecium; double-stranded, circular
  misc_feature (B) LOCATION 1...1584
  hypothetical: NO
  anti-sense: NO
gtcactgtggacgctttatgtctgcagtttttttatgaaaaaggagttattatgagtatactgacattaaacaacattacccaacaatttggcgacaaaatcctctatgaaggtgtcgatctgcaattaaatgctggcgaacatcttgggctgattggacaaaacggagccggtaaaagtacattgattaaaatcatcactggtgagatcttaccagatgacggacagatccattggcaaaaaaatattcacaaaggttacctcgatcaatatgtggaagtcgatgaaacattaacaatcgaagaatttctaaaaactgcgtacgcaaaagaatacgaaaaggaagaaaaaattgcttttctttaccaaacatatagcgagaccttcgatgattccttgctggaaaaagctgggaaactccaaacggaattagaccaaggagtgttttatcaaatcgacaccttagttgctgagatgagcagcgggttggggatcgatgtcttaggtttagattcactgttgaaaaatctaagtggtggacaacgttcaaaggtgattttagcaaaactacttttagaaaacccagatgttctgatcttagatgaaccaaccaatcacttagatgatcagcatatccaatggctgacgcagtttcttcaggattttgacggtgcgtatatcgtgatttcccatgaccaagaatttcttgatcagatcaccacccatatcgcagacatcgagtttggaaagattactaagtatactggccatctaaaacaagcattgaaacaaaaggaacaaaatcgcgaaagctatttgcgccaatatcatgctcaacaaaaacaaatcgaaaagaccgaagcttatattcgaaaatacaaagccggttcccgatcaacgatggcaaaaagccgacaaaaacaattagataaaatcgaacggctgacgcctccagcttcagcaagtaaagctgtctttgattttccattctcgcctattgtcacgacattagcagtggaaacaactgatttagtcatcggatatgatcgaccgctacttgcacccatcaatttgaccatccgctttggtgaaaatattgccattcgaggcttcaacgggattggaaaatctactttattaaaaacactgatcggtgagattgaaaaaataagtggcgatttccacttcccagataacacaaaaatcaattacttttcacaagatctgtactgggaaaatccattagaaacaccactacaatatttaagcagtcaatttccaaaagcgactatcaaagaattacgtcgccaactagctaaagcagggttagttaatcaattagcaagtgaacctctcactacattaagtggtggggaacaaactaaggtgaaacttgcacagttgacaatgaaccaaggtaatttactgattctcgatgaaccgacgaaccatatcgatcaagaaacgaaagaaagcttacaagacgggatacagaaatttccaggaacagtaatcatcgtctctcatgaacaagaattttatcaagatcttgtgcaacgagtcattgagattgaaccaaaataa

SEQ ID NO: 1925 - DNA (genomic), 672 bp, Enterococcus faecium; double-stranded, circular
  misc_feature (B) LOCATION 1...672
  hypothetical: NO
  anti-sense: NO
tccatcgtggataaaagcttttcagaaacatatctagattttaaacaaatcaacccggaaacgatgaatcaggctatccttgatacactatatatgacattaatctcaatggtcttagtgacgatcatcggattagttttgggattgatcctttactctattggacgcaaaaacaaaccgtatgctcgaatcatttatggaatcgtatcgatcatcagtaatattttccggtcaacgccatttatgatcctgatggttttgatcattccatttactaaagcaatcgtaggcactatgctaggtgcgcaagcagccattccagctcttgttttatccgcagcaccattttatgcccgtctagtagagattgcttttcgtgaagtcagccctggtgtactggaagcagcagatgcaatgggagcaagttactgggaaatcatctggaaggtcttgatacctgaaagtattcccgcattgatttctggattaacagttacaacgatctcgatgatcggatttactgcgatggccggcgcgatcggcgcaggtggacttggaggtcttgcttggcaggaaggctaccagcgtggtaatctaacagtgacattcgttgcgactttaattattttactaatcgtatttatcgtgccagtgtccaccacaaggccaagg

SEQ ID NO: 1926 - DNA (genomic), 933 bp, Enterococcus faecium; double-stranded, circular
  misc_feature (B) LOCATION 1...933
  hypothetical: NO
  anti-sense: NO
tatctagtggaagacgtaggcaaagaattgaagaggatcatcagcaaacgcaattatcaagaaaagtatgctgaaatgatcgctgaagtcttaaatgatgcggatgttcaagcttttctaagcgcacaccaagaagaattgacacaagcggatattgaaaaaagttacgctaaattgtatgaattcgtgcaagaaaagcgtaaatatcaaaaaaacgatccaacgatgatcgctcccggctatgagccgaagctgacgttgaattttcattatgtggatgtcacttatgtaccaacggaagcattgttagcacggcaaagacaagaagaaatcagaagccgagtaaaagcaatggatatgccaaaagatattcaatcggcttcttttgaaaactttgaacgtacagatggacgaggatatgcgagcttagaagccctagattttgtagagaaatatactgctgatccaaaagggtatcataaaggactgtatctagtaggaagttttggtattggaaaaacatatttattaggagcaacagcgagagaattagcgattgctggattcaccacgacgctagtccattttccgacatttgccgttgagatgaaacaggcaatcggaaaagatcaagtggcagaaaagttagatgcagtgaaacgttcacctattttgatgatcgatgacattggtgcagatgcgatgagtagttggatacgagacgaagtattcggtgttatccttcaatatcggatgcaggaacagttaccaaccttcttctcatcgaattttacaatggatgaattggaacagcatttgtccgtcactcaacgtggagatgaagagccgctaaaagcgaaacggataatggaacgcatacgttatttgacaaaagaaatcgaaatgactggtcgcaaccgacgcaatggttga

SEQ ID NO: 1927 - DNA (genomic), 642 bp, Enterococcus faecium; double-stranded, circular
  misc_feature (B) LOCATION 1...642
  hypothetical: NO
  anti-sense: NO
ataggagtggaggaaagcatgaggaaaaaaagaccgtttcttctcttttggttattcggttttttcttactgcttattttatccgcagcattttcaggaaaaatgacagcagatcttgctcagaaagaaacagaaaaaatcgtagcaagcaaagaatcagtagataatttcaaaaaagaattctcaacttattggtgggcggagtataaaataactgccaattacgaaaaaggcgaattggacatttatttgccaaaaggaaaagaagaaaatcaatttattaatatcgatgacgtacttagtgcgatttctctcagacaatatcaatttaaagacaagcatttgaccgttttgcttttgactcatgatggcgacaaagtagcccgtttgaaaaatggaaaagtgatcaccgcttattctgaaaaagtagacaaaaaagtggtcgccgatcgtttagcggaatggaaaaagacaaatgaacaagtcaagaaaacaactgtctcttctcaaaaaaacgagtcgacaggaacaagtccttcagattctggcagtggacaaacgataacgggaagtgaagaaaatcaagcctcaattattacgaatgagtcatcacaaggacaatatcaatcctatggacaatga

SEQ ID NO: 1928 - DNA (genomic), 720 bp, Enterococcus faecium; double-stranded, circular
  misc_feature (B) LOCATION 1...720
  hypothetical: NO
  anti-sense: NO
acagaggtggaaccacgtataatacgtcctcttggcatttgccaagaggatttttttattttaaaggaggaaaagaagatggagtatttgattgaagttatgccgcaattattagtaggagcactcacaacattgaaattatttttatttaccttgattggctcattaccattagggattgttttagcattaggattgtctttgcattttaagccgctacgctacttgcttcaaacatatgtatgggttatgcggggaacaccgctgttgttgcaactgatttttattttttatgggttgccgacgattgggatcgtttttgatcgtttcgaagcagcactcattgcctttatcttaaactatgcagcttattttgcagagatctttcgtggagggatacaatcgattcctcaaggtcaatatgaagcagcgcaagttttgcaattaagtccctttcaaacggtgacgaaaatcgtcatcccacaagtgacaaagattgttttaccttctgtagggaatgaagttatcaacttggtcaaagattcttccttgatctatatattaggtttaggtgacgtaatgcgtgctgggaaaatcgcgatggaacgcgacgcgactttactgcctttgctaggcgtggcaatcatctatcttacattgactggtattctaacaatcgtaatgaaacaagttgaaggaaaattaaattattaccgctaa

SEQ ID NO: 1929 - DNA (genomic), 372 bp, Enterococcus faecium; double-stranded, circular
  misc_feature (B) LOCATION 1...372
  hypothetical: NO
  anti-sense: NO
aaggtaacggaggcgcccaaaggttccctcagaatggttggaaatcattcgaagagtgtaaaggcagaagggagcttgactgcgagaccaacaagtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttga

SEQ ID NO: 1930 - DNA (genomic), 372 bp, Enterococcus faecium; double-stranded, circular; identical to SEQ ID NO: 1929
  misc_feature (B) LOCATION 1...372
  hypothetical: NO
  anti-sense: NO

SEQ ID NO: 1931 - DNA (genomic), 912 bp, Enterococcus faecium; double-stranded, circular
  misc_feature (B) LOCATION 1...912
  hypothetical: NO
  anti-sense: NO
acaaaaacggaggtggcacttatcaaaggacaaatcagaaaagcaatcagcggtttttactatgtatacgcaaacggagagacctatcaaacaagaggaagaggaaatttccggaatcggaaaatcacgccgcttgtcggagatcaggtgatctttgagagtgaaaatcaaacagacggctatcttctggaaatcttgccgagaaaaaatcaattagttcgcccaccagtcacaaatgttgatcttggaatcattgtcacaagtatcgtagagcctgcattttcttataatctacttgaccgctttctagttaccttggaatacgagtcgatcgaaccgattatttttttgacaaagaccgacttgtcagacgacccagaaaaaatcgaagagatcaagcaaacctatactaaaataggctatccggtgattgtacccaatcatacgggtgatacgacagaactgatccgttacttcccagaacggctatcggtctttatgggtcagtctggagcaggaaaatcgacgctactgaatcaaatatcaccggaactgaatttagcaacaggagagatttctgatgcacttggaagaggacggcatacaacacgtcatgtggaactgattcctatctatggcgggttagtagcagatacaccaggatttagctcgattgactttttgacaattgaagcaggagaactgccgagacaatttcctgaatttgtagaagcttctgtccattgcaaatttagagagtgcatgcatgctaaagaacctggctgcgaagtaaaacatagagtagaaacaggtggtatcgcacagacacgttacgacaattatttgcaattcttacaagaaatcgaaaaaagaaaaccaatgtatgcaaaaaaagaaggtaaacgaaaatag

SEQ ID NO: 1932 - DNA (genomic), 231 bp, Enterococcus faecium; double-stranded, circular
  misc_feature (B) LOCATION 1...231
  hypothetical: NO
  anti-sense: NO
aaaaaaacggaggactcttatctgttgttcgatacagaaccgacgccgtatcaagaaaaaagaaatggtgagccgtctgtacgaacattcaatcgcacaaaaacgttagaggaaacaaagcagtcagaagaaaaaaaatcgaaaaaaagccatggtatcttagaacgctcattacaaggattgatcgatgatcaaggaaactctttgggagaaaatagctattttaaataa

SEQ ID NO: 1933 - DNA (genomic), 582 bp, Enterococcus faecium; double-stranded, circular
  misc_feature (B) LOCATION 1...582
  hypothetical: NO
  anti-sense: NO
gaaaaaacggaaataataggggaggtaatgctaatgccgatttatgaagctgcaacaatagacgaagctgtccaactaggtctggctgatttgggtttggccaaagaccaagtcgaaatcgaaatactggaagaaggaaaaaaaggtttcctaggaatgggtcgaaagaatgcacggctttcgatccagccaagtatcagcgaaaaagtttctgaaacagtagaacagactgtagaagaaattttggaagaagaaccaacagctgagatcgaggtagtcaacgaaacgattcttgaagaaaaaacagaagaagtaagtgagctaggtgatgaagcagctttaacggaattggcagtttatcttactgaaatttcaaaacagcttgatgctccagctcttgtcaaaatggaaagagaatcaaataatatggttgtttcccatggagagacacaaaagcaaggcatactgattgggaaacatggaaaaacactgaatgcattgcaatatctggcacaagtcttcatccatcgtttagcaagaaatcaagctgtctgtagtagtcaatgtaggcaattaccgtga

SEQ ID NO: 1934 - DNA (genomic), 243 bp, Enterococcus faecium; double-stranded, circular
  misc_feature (B) LOCATION 1...243
  hypothetical: NO
  anti-sense: NO
ggaaaaacggaattgttcgtgaccctcagacccatcaaaaaggttttagaagacattttgtcatttgcggcacaaggtggatatgatgtgctggaattaagttattctccgatcacggggggagaaggaaatatcgagttcttggctcacttgaggaaagtacccgaaagcggaacaatcaattcagctattaatatggcagaagtggtttcaaatgcacacgaacagtttgaccataaataa

SEQ ID NO: 1935 - DNA (genomic), 729 bp, Enterococcus faecium; double-stranded, circular
  misc_feature (B) LOCATION 1...729
  hypothetical: NO
  anti-sense: NO
aggagaacggatatgagtgtttttaataataaagttatgttagggaactgttatgtgaaccacattggtttttacgatggaggaacatacagagttttattcttacgtttatctgtttttagttactcaaaagatggaaaggggcattatgaaaatattaatgcacaaatttcttgtcctttagatagaaatggggaaaccacgactacaagtagtcaccctaaagccttgatgaataaatttatctttgaaaagttggatcgcaatttggttgaggggatgaagataagtattcatggaaatattcgtggaacagaacaagtgcttcttaacagtggttggaaaaactttggtcaattatcgcctttagaaaaagaagaatatcaaaaaattcctaaaaatgaattagtaacaagaaatcaaacatatatctatatagaagaggtaagtatgccagaaaaagaagaatttagaaagtctcaatctaaggtaacaaaagaagatgtggaagttgcagaaccgaatcaagcagatgaaattttatccgatgatactgatccagtgaatgatgaaggagaggttattgaagtttttgaagctgaaattatcgaagaggaagaagaaattaaaagttttgataaaagaatgtatcgagagaaaccaaaaggttatgtgaattttgaagatatgtattatgacgaatattctaatgaaccaccgatcaattag

SEQ ID NO: 1936 - DNA (genomic), 660 bp, Enterococcus faecium; double-stranded, circular
  misc_feature (B) LOCATION 1...660
  hypothetical: NO
  anti-sense: NO
aaaaagacggaagaaataattattgcgcatgtcaaaaatacaggtagaggaaaagaggtcctgataccaggcgctgaagtggctattgtatttgctcctggacctaaacggaaaaccgcctatgatctgattgctgtaaaaaagaagggtgactggtttaatatcgatagtcaattgcctaatcggctggcaattgatggtattttagacggcacgatccttttaccaggattaactggtccatttacggtatacaagcgtgaagtaacttatcttcactccaaatttgatatttatttagagacggtggtcggacaaaaagcatttgttgaagtcaaaggtatgacacttgaaaataaagcgattggtgcttttcctgatgcgcccacactcagaggattgaaacatataggagaattaacgtatgccgcacaagatggttatgccgcttatgtcttgtttattgctcagttcgaacatcttcatctggcaacgatccatgaagaaatgcaaccagcactagctgatatggttcgacatgcgcagcaaagcggagttcaaatcctcgcctataattgtcaagtatcggcagatgaggtaactgtcaagcaggccattccatttgatgtagatatcccttttgaagatcctatacaatag

SEQ ID NO: 1937 - DNA (genomic), 555 bp, Enterococcus faecium; double-stranded, circular
  misc_feature (B) LOCATION 1...555
  hypothetical: NO
  anti-sense: NO
aaagagacggaggtaagaatgatggggagagtaacaaattatagtaaagaatatttgctgttcaaaagtatggtatacgtggaagaatatggaatgaagtcaattactgcaagagagttagcagagttctgcggttgttctacatacccgatttatacacatttcaaatcaatcagcgggttaaaagagaagatattagaagaaatcactgtttattttgaaaactacttagctgaatgcagttccgatgatgttttaagcattgtctacttattgaaagattttttttctatccatgaaagtattcgtgaaatcattgcaaaatctgatttagacatggattcgctatttaagcggccatttttctcatatgtcaaaggtcacacgaagatcaaagaagaaaagtcgcttgaattggtatggcttaatgcattgggaagtttgcgctcagatgattcttctcaagattttcttgaaatgatgaacgctgtttgggataaaaacgaggtgacggatgaatacttggaaaatatcttaaaggaacagtcaccttag

SEQ ID NO: 1938 - DNA (genomic), 1068 bp, Enterococcus faecium; double-stranded, circular
  misc_feature (B) LOCATION 1...1068
  hypothetical: NO
  anti-sense: NO
agaaatgcggatggtactatcggaccaagaatttaccaagatttgatgaacggggtatcacacatgttaccttttcgttattggtgggacgattccctattgcgcctttctttcatgatcgaccaatttattggcgtgccacatgatcaattatcaaatctagggaattacaatcaagctgctagctggttcaaccaaatcggacaagctgcatttggtttcatgctgccggtattagcaggatttattgcttcaagtatcggtgaccgccctggtttgatcgttggatttgctgctggtgcattanctaatacaggcggtgcaggattcttaggtgcactgattggtggattcttagctggttatgtcatcgtatttttacgtaaattattcaagaacttaccaaaatcattggatggaattaaaacgatcctcttttatccagtgtttggcttactgattactggtttcttgatgttgctggtcaatgtccctatgaaagcaatcaatgatgcattgaacggtttcttgacaagtatgagtggttcgaatgctgctttacttggtgcattattagctggaatgatggcggcagatttaggcggtccaatcaacaaagccgcttatgtgtttggtacagcaactttagctacgactgttgcaactggcggaagtgtcgtgatggcttctgttatggctggaggaatggtacctccattggcaattttcgttgctacacgtttgtttaagaataaattcagcaaaacagatcaagatgctggtttgacgaacatcgtgatgggactatcgtttgtcacggaaggatcgattccatttgcagcagctgacccgattcgtgccattccaagttttattattggttctgctttaactggcggattagtcggagctttcggaatcaaattactggctcctcacggcgggattttcgttgtattcttactgagtcacccggtcatgtatttggtgtttattgctatcggagcagtcgtatctggtgtgatttatggtttattgagaaaagctcctgcagtagcagaagcatag

SEQ ID NO: 1939 - DNA (genomic), 354 bp, Enterococcus faecium; double-stranded, circular
  misc_feature (B) LOCATION 1...354
  hypothetical: NO
  anti-sense: NO
ttgggtgcggattgggggtgtggatcaaacatgccttcttttgagtttacattgctgactattttaggttgtactttagcaacttggctttctagggtcctaccatttgtcttactgaaaaaattcgatttaccgcaaccgttgcttgagtatttaagttttgtcccgatcgtcattatgtctgctttatggttcagcagtctatttacccaaaatatcggacatctgccgcagatcaatctcgaaaatgctttggcttcagttcctacacttttagctgctattctttcaaaaagcttattggtgatcgtcttggcaggaattctttccctttcgttgattcgcttattataa

SEQ ID NO: 1940 - DNA (genomic), 606 bp, Enterococcus faecium; double-stranded, circular
  misc_feature (B) LOCATION 1...606
  hypothetical: NO
  anti-sense: NO
aatagagcggaaaaggaggagaatatcatgcctaaaaatcgtcttgaagcatttacagatgctgtaatcgcgattatcatgactattttagttttagaacttcatgaacctaacggagacacgtgggaggcgctcgctgcattaggttaccgattttttatctatattgtcagttttatcattttagcgatttattggaacaatcatcatcatttatttcaagttgtacataagataaatggacgggtcttatgggcgaacagtttctttgtttttgcgctttcgctttttccgtttgcaacttcatggatcagtgagtacatcaatagcctggctccagaaatgacttatggttttgttaccttgaccgctaatattgcgtattatatcttggcaaaagaacttgtcaaagcaaataaaggccacgagaaagcattgaaggcgatgttgaataattacaacaaatcgtatctatcgattggtttgaatgtgttaggaattgtcttagggtatttactancgccagtagccgtgctgatcgcaaacatcgtgattctagctgcttggatcatcccaagtcgtaccatcgaatcacaatatcggtaa

SEQ ID NO: 1941 - DNA (genomic), 261 bp, Enterococcus faecium; double-stranded, circular
  misc_feature (B) LOCATION 1...261
  hypothetical: NO
  anti-sense: NO
agaatacaggaatacagaaaagtatatgatttgcttgtagaatgtgtttcggttgtagaaatgcctacaaaatatgggaatttcaaagcacattgttatatcaataaattgaatggagaacatcatgttgcattggttatgggagatttgaataatggaaacgatgtgctatgtcgtgtccactcagagtgcttaacaggagatgcctttggctctttacgctgtgattgtggacagcagttagataaagcaatgtgctga

SEQ ID NO: 1942 - DNA (genomic), 954 bp, Enterococcus faecium; double-stranded, circular
  misc_feature (B) LOCATION 1...954
  hypothetical: NO
  anti-sense: NO
attatgcaggaacctatgtttttaaaaccagtttttcaagaaaaaatttggggaggaagtcgtttacgttcagtctttggttttgatatccctaacgataaaatcggagaagattgggcgatcagtgcgcatcctcatggtgtcagtgtagtagaaaatggcgaattcaaagggaaaagattagatgaactatggtcagaacacaaggaattgtttggccatccttcagaaccagtgtttccattattgatcaagatcttagacgcagaagatgatctatctgtacaagtacatccagatgatgcctatgggatgaaacatgaaggtgaattaggaaaaactgaatgctggtatatcatcgatgctgaacctggtgcagaaatcatctatggtcatcatgcaaagacaagagaagaactagctgagatgatcaaagatgggcgctgggatgaccttttgaagaaagtaccagttaaaaaaggtgatttcttttatgtaccaagcggaacgatccatgctattggtaaaggaatcatgattttagaaacacagcaaagttctgacacgacttaccgcgtgtatgactacgacagaaaagatgcgcaaggacaaacaagagagctgcatatccaacaatcgatcgatgtaacaactgtccctgcgaaaacaccagaattacaaatcaaagaagtccgaaaagggaattcatcgatcgtcacttatttagaaactgagtttttcaatgtatatgagtgggatattaaaggaatcacatctttcaaaaaacaagccccttatacattgatgacggtaatcgaaggagcaggagaccttgtcgttgacggaaaaacatatccattagaaaaaggaacaagctgtattattccaaatggcgtttctgagtgggcggtccaaggtgaactagcaatcattgcgtctgaaccaggcaaatag

SEQ ID NO: 1943 - DNA (genomic), 417 bp, Enterococcus faecium; double-stranded, circular
  misc_feature (B) LOCATION 1...417
  hypothetical: NO
  anti-sense: NO
tggacgcaggaaaggagcagtaaacagatgccgaaacgtacagatatcaagaaaattatggtgattggatctggtccgatcatcattggtcaagccgcagaatttgactacgcaggaacacaagcctgccttgccttaaaagaagaaggatatgaagtggttttagtaaattctaatcctgcgacgatcatgacggataaagaagtggcagatcaagtatatatcgaaccgatcacacttgaatttgtatcaaggattcttcgaaaagagcgtccagatgctctccttccaactttaggcggacagacaggcctcaatatggcaatggagctggcagcatcaggtattttagaagaattgaacatagaacttntcggcccnnnnnnnnntnntattagangcttcaccacgattgcg

SEQ ID NO: 1944 - DNA (genomic), 972 bp, Enterococcus faecium; double-stranded, circular
  misc_feature (B) LOCATION 1...972
  hypothetical: NO
  anti-sense: NO
aagaagcaggatttgaagccagcgcgctatgcaactacaccagaaccagattcagccaagaatgaagcatgtagagtcgcagaactaggttttgatctagtagtggcagctggtggcgatggcacaatcaacgaagtggttaatggaatcgctccgcttgaacaccgtcctaaaatggccatcatcccagctggtacaacgaacgactatgctcgagcattaaaaattcctagagataatattaaagcagcagcagaagtgataaaaaaacaccaaaccgtaaaaatggacatcggcctttctgataacagttacttcatcaatatcgctgcaggtggctatttgacagaattgacttatgaagttccatcagaactaaagagtatttttggttatcttgcttatcttgcgaaaggagcagagatgctccctcgagtaaagccaatcaaaatgcgcttgaagtatgatgaaggggaatatatcggaaatgcttcgatgtttttcctagggctgacgaactctgttggaggattcgaacagatcgcgccagatgccaaattggatgatgggaagttttctttaatcattgtgaagacagcaaatatctttgagatcttgcatattgcagcactcatgctgaatggcggtcgacatgtcgatgatccaagaataatctataccaaaacaagcagtttgttcgttgaaacagaagatgatatcaatcgaccagtaatgatcaacttagatggtgaatacggcggggaagcaccgatgcatttccaaaatcttcatcaacacattgagttctttgccaataccgatcagattcctgatgaagcaatcacaggtacagatgaagaagaattagaggttgtcagcaaagaattcgtaaaagaagtcgaacgtttaacggatgaagatatcgacggtgacggaaaaatagcagacgaaacacctaatcaaaagaattaa

SEQ ID NO: 1945 - DNA (genomic), 246 bp, Enterococcus faecium; double-stranded, circular
  misc_feature (B) LOCATION 1...246
  hypothetical: NO
  anti-sense: NO
gcacttaaggaggaatctgtgaaaatagcttttcatatttttgcagattttgacttaatgccgaaggtcagctttgcgattaccgtttatcgagaggctgtaaaagcaccgtgtagctccgatgacaataagcaagcatttttagagctaggtttccttgattctaaatatgcggcttatttcaatgagttggtgcttgaacgcgattttaagaaggtcgaaaacaggcacgacttttcgacgtaa

SEQ ID NO: 1946 - DNA (genomic), 294 bp, Enterococcus faecium; double-stranded, circular
  misc_feature (B) LOCATION 1...294
  hypothetical: NO
  anti-sense: NO
ataaataaggagaatcttttgaaaatgattcttctttacagaattgtgcttatagttggcacggagttaaaaatcttaaagaaggagcagttattcaaagtgaaagaacatcataatcagttactatgtattaaaacgggtacgatgaacattcaataccgaacagaatatttagaattaacgaatcaaactgattttttgtcgattcgagagcaacataagcaagaaaaattaatggctacttatagccaattgattgatgagtgggaacaattcaaggaatctaaaacataa

SEQ ID NO: 1947 - DNA (genomic), 885 bp, Enterococcus faecium; double-stranded, circular
  misc_feature (B) LOCATION 1...885
  hypothetical: NO
  anti-sense: NO
aaaagtaaggaaaatgatggaatggtaacgatcaaagatatcgctaaagcagctggcgtttctcatacgacagtttctcgtgctttgaataacagcagtttaataaaaaatgaaacaaaacaaaaaatacgacaactagctaaggaaatgaattattcgccaaactatagtgcaaaaggtttagtgaatcaaaaaaaatatctaatcggactatttttctcaagtttgcataaaggaacttcatcaaatttcctagcagattccattgcaggcatccattcagtattagacacaaattacagtttatctgttgaaagtatcgatgttgttgatttaacagaaatcaacctgcaacgctacgatggactgatcgttatgagtcaaagtgatgatgatcagcctttcatcgactatctcaaagaaaaagaatttcctttcgttgttgtcaatcgtcacatcaatgatccagcggttatcaacgtcactgccgatgatgcggccggtgttatgcaggcagtagattacggtattggatgcggacatacgaagatcgcttatattggcggaaagaaaaattttcgttcgacaaaagaacgggaaaaaggggtattgaaaagtctaaaaaaagcgagcatccctgtcaatccagcctattttttaacaggagattacagcttagaaagcggcctccaaaacatggaatacctattatcactttctgacctgcctactctggttttttgcggcaacgacgacatagcgattggtgcattgagagctgtacatttagctggcctccgtgttccccagaacatttctctgatcgggttcgatgattctccagtcgtctcctatctcaatccgccgcttaccaccgtacgttag

SEQ ID NO: 1948 - DNA (genomic), 645 bp, Enterococcus faecium; double-stranded, circular
  misc_feature (B) LOCATION 1...645
  hypothetical: NO
  anti-sense: NO
atatccaaggaagacggactaacagttattttgtttgtcggtgttaatggtgtagggaaaacaacaagtattggtaaacttgcccatcagttcaaaaacgaaggtaaaaaagtattgatggcagcagcagataccttccgcgctggagcaatcgaccagttagttgtctggggcgaacgcgctggtgttgaagttgttcgtggcaatgcaggaggcgatccagcagctgtcgtattcgatgctttggaaagagcaaagacagagcaggcagatgttttactagttgatactgcaggccgactgcaaaataaagtgaacttgatgaacgaattagaaaaaataaaacgagtaatccagcgggaattaccagaagcaccccaagaaacacttcttgtattagatgcaaccactggtcaaaacgcgatggttcaagcaaaacaattcaaagaaacaacagatgtgaccggtcttgttttgacaaaattagatggtacagcaaagggcggtatcgtacttgctatccgtaatgaattgcatttaccagtgaaattggtcggtcttggtgaaggaatcgatgacttggagccgtttgatccaaatgattttgtcgttggattgttcaaaggattactaaaagaagaataa

SEQ ID NO: 1949 - DNA (genomic), 1548 bp, Enterococcus faecium; double-stranded, circular
  misc_feature (B) LOCATION 1...1548
  hypothetical: NO
  anti-sense: NO
aatataaaggagtgtatccacatgtctaatgaaaaaaatgtattgtttacgatattcggcggtacaggtgacctagcccagcgtaaattgtacccgtctttgttccgcctttacagaaaaggaaatttaggcgagcattttgctgtaatcggaaccgctcgccgtccctggagcgatgagcactaccgtgaagttgtcaaagaaacaatccgtgcattgaatccttcagatgaagaagcaactacctttgcaagccatttttactatcaatcccatgatgtaaatgattcaacgcattatcagacattaaaagaattgtctgaccgattagatggacactatcaattaaacggtaaccgtgtctattatttggctatggcacctcaattttttggaacgatcgtttctcatttgaaatcacaaaatattatgacaaaaaatggcttcaatcgtttgatcatagaaaaaccgttcggttctgattaccagtctgcttttgaattgaaccagcaaatcagagaagtattcccagaacaagatattttcaggattgatcattatttaggaaaagaaatgatccaaaacatctcagctatccgttttgccaataatatttttgaggctcaatggaacaatcgctatatcgacaatatccaaattacttttggcgaaaacctcggtgtagaagatcgcgggggctactacgatcatagtggcgcacttaaagacatggtgcaaaatcatattttacaggttgtagcattacttgcaatggaaccgccagtagcattttccgaaaaagaaatccgtacagaaaagatcaaagcattgaaagctatccgcatttataacgaagaagaagtgttagaaaacttcgttcgcgggcaatatgctcaaggtgaattggatggtgtacaattcaagggctatcgcgaagaagacaaagtggatgctcaatcagagactgaaacattcgtcgcaggcaaattcactatcgataacttccgttggtcaggtgttcctttctatgtacgtacaggcaaacgtttgactgaaaaagggactcggatcaacatcgtattcaaacaagttcctgttaatgtattcaaaacatctgtcgatgaaccatgtgacgatacgacacttccacctaatgttctaacgatctatattcagccaactgaaggattttctttatccttgaatgggaaagaagtagggcaaggatttgaaacggaaccaatcaaattggaatttagaaatagtgcagaaatggttgaaaatagcccagaagcttacgaaaaattactattagatgcgttgaatggtgatggaacgaacttctctcattgggaagaagtcgctcaatcttggcatatcgtggatgtcattcgaaaagcttgggaccaaacacaaccggattttcccaactacaaagctggatcaatgggacctaaagcagctttcgaactacttgaaaaagacggattcgaatggatctggcaaccagataactggtatcgtgaacgtggaaaattaaacgattga

SEQ ID NO: 1950 - DNA (genomic), 612 bp, Enterococcus faecium; double-stranded, circular
  misc_feature (B) LOCATION 1...612
  hypothetical: NO
  anti-sense: NO
atagtaaaggagagcttgaaaatgaaaactgcgattacgtttctattagaggaatatgccgattgggaaggtgcttatattactagcacactaaaccaaaatgagaaatggcaaaacaaaactgcttctatccaatcagaggtcacttccattggaggattaaaaacaaaaatcgattacttaatcgaacaaatacctgaaaaagttgacctttttattatgatcggtggcaattcatgggacataaaaaatcatcatttatatcaaataatcgataaattgttaaaaacagacgtaccagtagctgctatttgtggggcagttgattatttagctcagagcggattattgcaaggttacaaacacaccggaaatgcgcaatttccttggttagaatcggaaaattatcagaataaagaagattttatagaacaacaagctgtgaaagatcgtaatttgattactgcgaatggaacagctcctatagaattcacagacttgattcttcaagcagtccattttgaaacagaagaaataagagaaaaaacgattcgtctatacaaacttggattctatgattactataaaaagtacggagatcctttctcctaa

SEQ ID NO: 1951 - DNA (genomic), 330 bp, Enterococcus faecium; double-stranded, circular
  misc_feature (B) LOCATION 1...330
  hypothetical: NO
  anti-sense: NO
cagaaaaaggacttatttacactgtttgtgaaacgcctacgaaatgtcagggataacagcgtgaaaaatgctttaatagaaaacagaggctactttgttaaacaaggattcactcttgaacgagcttctaaggatattaagaaactatacaatgtgaaagcaagcagtagttttttagtatatctagcgaaaggggcagggatagatgaagtaataaaagaattgatattatcaggagttgaattagttcctatttatcaatttacaagtgtaacaagagatgatggacggagagtaaggaatagaagagacccaattatattaaactag

SEQ ID NO: 1952 - DNA (genomic), 456 bp, Enterococcus faecium; double-stranded, circular
  misc_feature (B) LOCATION 1...456
  hypothetical: NO
  anti-sense: NO
aagaaaaaggaggcggttccaatgagtaaaagataccagaacatcatggtagcagttgacggatcaagacaatcgatcaaagcgttcgctgaagcccttgacttagcaaaggacaatgaagcccacttatttatcgtgtcaatcatcaacaaagttgagctgacccatagtgcctatgccttttcaaaaatctatgcagatgaaaaacaaagaacagaagtagccatgctgaaaaaaatcaatgatgccaaagagtacggcattgctgagatccacgcaatagttgaaactggagatccaagaaatttgattgccaatgtcatccctggacaagaaaatattgatttgatcgttatgggagcgacaggaaaaggtgctatacaacaagcattagttggatcgaccgcttcttatgtcgtatcacatgccccttgcagtgtgttggtcgtgaagtaa

SEQ ID NO: 1953 - DNA (genomic), 1803 bp, Enterococcus faecium; double-stranded, circular
  misc_feature (B) LOCATION 1...1803
  hypothetical: NO
  anti-sense: NO
tatgaaaaggagatagaaattttgcaaattggaaaaatcataaaagtctccggacctcttgtaatggctgagaacatgtctgatgccagtatccaagacatgtgtctagtgggagatctaggagttatcggagaaattatcgagatgcgtggcgatgtggcgtctattcaagtatatgaagagacttctggaattggtccaggcgaaccggttcgctctactggtgaagctttatctgttgaattaggaccagggatcatttcacaaatgtttgacggaatccaacggccattagatacctttatggaaatcacacaaagtaatttcttagggcgcggagttcaattgcccgcattggaccatgagaaaaaatggtggttcgaaccaacagtagaagccggagaaacggtgagtgctggagatgttatcgggatcgtagaagaaacaaaagttataaaacataaaatcatggtgccaaatgggataaaaggaacgatcaaaacaatcgaaaaaggttcattcactattgatgaaacagtatgtgtcattgaaaccgaaaatggtgacaaaaatttgacgatgcttcaaaaatggccagtaagacgtagtcggccaatcaaagaaaaattaaacccggatgcacccatgatcactggacagcgagtgattgatacattcttcccagtgacaaaaggaggagcagcagctgtacctggtccttttggtgcagggaaaacagtcgttcagcatcaaattgcaaaatgggccgatgtggacatggttgtctatgtgggatgtggcgagcgtggaaatgagatgacggatgttttaaatgaattccctgaattgattgaccctaatacaggagaatcgttgatggaacgtacggtattgattgctaatacatcaaacatgccagtagcagctcgagaagcttctatctatacgggaatcacaattgcggaatatttccgtgacatgggttatgacgttgctatcatggcagactccacttcacgatgggcagaagcacttcgtgagatgagcggacgtttggaagaaatgcctggtgatgaaggttatccagcttatcttggttcacggcttgcggaatactatgaacgatctggaagagtcattgcattaggatcagaaggtcgcgaaggaagtataaccgcaatcagtgctgtatccccgtctggaggggatatttcggaaccagtcacacaaaatacattgcgggtcgtaaaagtattctggggtcttgattccagtttagcccaaaaaagacattttccttcgatcgattggatacaaagctattctctttattcaacagaagtagggaagtatatggatcatatccttcaagctgactgggcatccatggtcaccgagggcatgcgtattttgcaggaagaacagcagctgaatgaaatcgtgcgtttggtagggattgattccctttcagataatgaccgtctgacattagaagtggcaaaatccattcgtgaagattatttgcagcaaaatgcttttgatgatgtcgatacattcacttcaagagagaaacaattcaaaatgttgaagatgatcttgacctttggtgaagaaggacgccgtgcgttgtcgttaggtgcttatttaagtgagatcatggacggtaccgtatcgattcgtgaaaggatcggacgaagcaaatatatcccggaaacagaattagaaaaactagatcaaattattggtgaaatcaagcaaacgatgcaaacgatcgtttcagaaggaggcatgagcaatgattaa

SEQ ID NO: 1954 - DNA (genomic), 558 bp, Enterococcus faecium; double-stranded, circular
  misc_feature (B) LOCATION 1...558
  hypothetical: NO
  anti-sense: NO
aaagaaaaggaatctgagatggataagtcaaaagtaatctatgtgtctgggtatcgaagtttcgaactcggtgtttttaaagaaaatgatcctaaaatccaagttgttaaaaatgttttaaaaaaagaactccatcagttagcagaagaagggctggaatgggtacttgtcagtgggaatttgggcgtcgaactatgggctgtgcaaatagtagcggaattgaaagaagaatatccggaactatctcttggtattttgtatcctttttctgattttggtaataactggaatgaagggaaccaagaaaaaaaacaattagcagaacaattagcagattatgtcgaagctgttagccatcaaccctaccaatcacctagtcagctaaagaatcacactcgttttatacttgagcatacagtgggctgtctgctgatctatgatgaagaattccctggaaaaacgaagtatttttttgaagatgcacagaattaccaagcagatcatccctacgaaattcggctgatcagtatggacgatcttcaaaattttagtgaataa

SEQ ID NO: 1955 - DNA (genomic), 684 bp, Enterococcus faecium; double-stranded, circular
  misc_feature (B) LOCATION 1...684
  hypothetical: NO
  anti-sense: NO
aatcgaaaggagaagaagatgaacaccggagaaaaaatacgaacttaccgcagaaattgtaagcttacgcaaaaagaattaggcgaaaaaattggtgtttccgataaaacgatttctagttgggaaaattctcgtacaatgccagaccttgaaatgctgtcacttttacatcatactttaggtctgccgattgattttccttctattgaatcagctaccgaatcaatagaaccaacattgccagatgaacctcttgttaacaagaaatcttattcatcaaaacaacccttctcactcaaaaagacactatctttctttctgctcgtcttttgtttggtctatctttttcttatcaattatcaatacaaaaatgaaacgatcgatcgattcaatccttttttgaaaccacaaatcggctataccacactccctgtaggatacgtggacaattccatcgaacgttgggtatgtaatgatatctttggccatggtacatggctgtcttttcacgctggagaggtagaaaaagagaaaaaccatgctgtaatcaaacacaaaggaaaacacgtcatgaacgttcgcctgctcacttgggaagccattccctcagattaccaagaaatcctcagccaagactatgacgacgccttaaaaagaagccctcaggagccagataggcattaa

SEQ ID NO: 1956 - DNA (genomic), 525 bp, Enterococcus faecium; double-stranded, circular
  misc_feature (B) LOCATION 1...525
  hypothetical: NO
  anti-sense: NO
ggcagaaaggagtggagaatgatttttactggatataagaaaaaacggcagatcgaaaaataccgtcacctgctgaatggactcatcgaaactgattatcaaaaaatgttccgtatcacgatgaattacgtacatgataaagaagaggccttagatgtgatgcaagatagttttcataaagccctgaactattttgaaaaagaaaaagagatcgagcattttagtgcatggttttatcggatattgatccgcacggcattagatagttggcgcagacaaaaaaggacgcctgtggacttatttgaaattcaagatatcccccaacagttacctttagaaacttccgttgcagagctccatatgattttagataaaatagacagtccggaaaaagagattctgatcctctacttttttgaaggatttcgtttgaaagaaattgcgactatcttggatatgaatgaaaacacagttaaaacgaaaatgtaccgctcattgaatgctttacgtcaaatcctagaatga

SEQ ID NO: 1957 - DNA (genomic), 567 bp, Enterococcus faecium; double-stranded, circular
  misc_feature (B) LOCATION 1...567
  hypothetical: NO
  anti-sense: NO
aagagaaaggaacgtagcatgctgagtttgctgattttatttttattgctaattgcgtttttttctggagcacgtcgcgggtttgctttgcaaatcatattcgcgattggatatgtattgtcatttattgctgcccagcatttttacaaaccattagcaagtcatttggaattatacattccatacccagctgtcaccccaacatcaaagttagcattttttgatcaggtatttgcttttcacctagatgaagctttttatgcaggaactgcttttctgattattttgctaattggctggctgcttacccgatttgtgggggtttttgtccatggattgacgtatgtgccgatcttgagacaggtagactggattgcaggaggcatcctgtcactaatcatggcttacgttactatatttttgattttgcagttacttgcctttgttccattagatgtggtccaaaatcaattcggcgagcatagtttcgctcgttttatcgttgagagaacgccatttcttaccaacaagatgtatgagctttgggtaacgaatattttgaattaa

SEQ ID NO: 1958 - DNA (genomic), 2115 bp, Enterococcus faecium; double-stranded, circular
  misc_feature (B) LOCATION 1...2115
  hypothetical: NO
  anti-sense: NO
aatcagaaggagatcatttctatgaaaacaagaacaattgaaatacttcacagaatcatgacagcccaatatccagtaaaagcaaaacatctagcaagtgagttcaatgtcagtcagcggacgatccgtcaggaagttcttgaagcgaatatctggttgagcagtaaaaagcttccggagatccgtacaattcgcaacaaaggttttttgttgaagctggaaaaggaaaagcaagctcgattagaaactgaaataaaagatgtgaaagacggctttttgaatcggcgcgaacgtatttttgatctagttttagccgttgcttacagccgaatcccgatccatctaaacaaaaaagaagaagaatttcaaatctctaaaagtacattagatgaagatatgagacggttacgagcaacactggtcagttatgggatagagatcgtcagttatggaaagcaaggactggtttataaaggttcagaacgatctatccgtacgatgatctatgattttatcaatcagaatctgggaatgaccgacttctttatgaatcaagatgcacaattaacaccggctcaaaaaatctttctccattattttcctttggtggaaatcaaaaaaatacaggagatctattccaataagttgttgaaacaagaagatgatatttataaaaaacaaatcctgctttttacattgatctggatccagcgaatcaggaaacatgaatttatctctgccattaattggaaaaatacagaaataaaagacagtagcttttctgcatttattgaccacatgatcgaggaatttcaattggacaatgtcccgcaagtagaaagaaattatcttcgtttcactattgagacgttcaatgctagagatatctccaattcaatcgagtgggtacaagctcaattactaacgatccaattgatccaatttgtagagaacgagacacacgtacctttccatctaaaggaagaagctttattcgaaaatctctataagcacatggctgcactgattgtaagaatcaagaatcatatccaagtcatgaatccattgaaagaaaacatccgaacaaattatttcccaatctaccgcgcagtcactcattttgttcctacgatcgaagaagtaattggtggcaagatactggaggacgagatagcttttcttgtcatccacttttcgacgatcgccagtgtaatcaagcgagacttgaattatgtttataaatcagtcgttgtctgtaaccatgggatggctactggaaatctgttagcagagaatctgaaagaaaagtttcctcagatcgagattactgcagttttaagttcaaaagaaatcgaattagtagataaattggatgtcaatctggttttcagcacctttcaattgaattatcgaaataagccgcttttagttgtcgatccgattttaactgagacgaatatcttggttatagaagactttttgaaaagaaatgaagaactacagcggttagagcctaacagtcatgaatcgacggagttattcactcaaataatagatgtcatgaaagaaagtggtggccgagtagatcgaatcatctatggcaagttagaaaaattattcgaaacaaacaatttagaaatcaacaaaagggagatccagcctatgttaaaagatattttgacggacagcaatatcatgatcaaagaaaaagccactacttgggaggaatcgattgaactagctgctagaccattggttaaagaaaacattgtcgaagagcgctatgtcgaagcgatgattcgtgcagtgaatgattacggaccgtatatcgtgattggcaaacacatggcactagcccatgcccgaccagaagatggggtcaataaattaggagtcagcgtagctacgattgagcaaccaatcgatttcggtaatcctgaaatggatccagtaaagattattttttgtttggcagcagtagactcctactcgcatctgaacatcatgaaagaactaattgaattgatcaacaacgaagagaagttggatcgattgattgaatgcacaaatatcgaagatttcaaacaactgcttttttcagtagttgagaaataa

SEQ ID NO: 1959 - DNA (genomic), 291 bp, Enterococcus faecium; double-stranded, circular
  misc_feature (B) LOCATION 1...291
  hypothetical: NO
  anti-sense: NO
ttatggaaggaggccattaagcgtatgactgaaggaagaaatcaacgcaaagtttatcaaggtcgcgtggtttcagacaaaatggataaaacaattaccgttgctgtcgaaacaaagaaaaaccaccctatctatggcaaacgcatgaactattctaagaaatacaaagtgcatgatgaaaacaacacagcaaaagttggcgacatcgtgagaattatggaaactcgtccattatcagctacaaaacgtttccgtttgttggaagtagtcgaagaagcagttattatctaa

SEQ ID NO: 1960 - DNA (genomic), 240 bp, Enterococcus faecium; double-stranded, circular
  misc_feature (B) LOCATION 1...240
  hypothetical: NO
  anti-sense: NO
tcatggaaggagagcggaataatggtaaataaaaaagaaacgtttaaagtaggtatggaagtacagggcgttgttattgggagcggagagcttatcgagggagaagtaattagtttgttagctaatgtagcggtagttaaagcaatcggaaaagcaccggtagtgatgaaaaaatgcagcatgatgtgtcttgatggtttaaacaatccaataactcaacgctttgagaacgtgatataa

SEQ ID NO: 1961 - DNA (genomic), 831 bp, Enterococcus faecium; double-stranded, circular
  misc_feature (B) LOCATION 1...831
  hypothetical: NO
  anti-sense: NO
ttgaggaaggaaggacccttattgaataaaaaattaattgccatcgatctggacggaactaccctcaatcaagattcgatgattacatctaaaacaaaagagactctgaaaaaagcaatcaatgccggtcatcatgtcagtattgctacaggacgcccattccgaatgagccatcagttttaccaacaattagaattaacaacaccgatggttaattttaacggcgcattagtacacatccctaatcagcactgggatggtgaaagagaaacgttgatcaatcgtgaaatcgcttttgaaatcttatcgcaaaaaaagcagctaaatttagattttatcgctgctgaaaatcgtgatactttttttattgacagttttgatttctttgatgaaaaaatttttgcttcttctcgtccaggagagaagaatttgctttctcctaaaaatttgacgacaaatcctacatctttgcttgtccgaacagacaaacgttttgcaggagctgtatctgctgaattaacacgtcaatttggcagttatgtcgatgttcggacatggggtggacctactgccatcttagagattgtttcaaaaggaatccaaaaagcaaaaggcgtgcaagagattgctaactacctgtctatcgatcaaaaagacgtcattgcctttggtgacgagcataatgatttggaattgttggattatgcaggttggggagtagctatggctaacggtactgaccaactcaaaggcattgcaaatgatgtcactcctttgagcaatcaggaagacggtttagctgtttatctggaaaaactacttaaactataa

SEQ ID NO: 1962 - DNA (genomic), 519 bp, Enterococcus faecium; double-stranded, circular
  misc_feature (B) LOCATION 1...519
  hypothetical: NO
  anti-sense: NO
agtagtgaggaagaaggagttttgcagatggatattcgattggcacgtatagatgatcgtttaatccacgggcaagtcgcaacagtttggtcgaagcaaacaggtgttgaacgtatcattgtgatcagcgatgtagtcgctcaagataaattgagaaagtttctactaaaagaagctgcaccgccggggatcacagcaaatgtaataaccgtgcagaaaatgattcaaatctatcatagtggattattatcacgagcaaaagtgatgcttttattcaccaatccccaagatgttgaagcggttgtccgctgcggtgtacagttgaagtcgttgaatatcggcggtatgagttttactgaaggcaaatcaatgattaccaattttgtttcagtaaatcaacaagatattgattcctttcgttacttgaacagtcaagaagtggagttagagattcgaaaagtacctgctgacaggaaaatccttttgatggaactactagcgaaaatcaaaaaggtgtag

SEQ ID NO: 1963 - DNA (genomic), 429 bp, Enterococcus faecium; double-stranded, circular
  misc_feature (B) LOCATION 1...429
  hypothetical: NO
  anti-sense: NO
ttaagtgaggatagttcacaaaatccattgttaaacttcacgaaagtggtaaaactcaaaatgctttatataggattacagcatcgctctttcttcgattgcgcgttgggtaaaaaatattatgaagtaaaaattgacgatgacacgttccttacggctcatcagatgaaacagctacaaaaacgaaatgatcaactcgaagaaaatttaattctaaaaaagcgattgccatattcacgcctcgctcgacgaattattaaagtccaagatttaactgaagaatcatcttttttagggaaattggaaactttttatgttgcacaatgcatttataatactacaatgatgttttcaccagatattcctcttagggtgcggtgtaatgaaacagatacacttgcaaaagaaaattcaccgcgaatttactaa

SEQ ID NO: 1964 - DNA (genomic), 215 bp, Enterococcus faecium; double-stranded, circular
  misc_feature (B) LOCATION 1...215
  hypothetical: NO
  anti-sense: NO
tatgtagaggaagctctcagccaaaaaaattataagctttttttgtgtaatgcgaacggcagtgcggaaaaagaaaaagaatatatccaaatggtcaagcagagtaaagtagacggaattataggtattacctattcagacattgataaatatgtatcatcaaatttaccatttgtcagtatagaccgccatttttcggaacaggtttcttatgt

SEQ ID NO: 1965 - DNA (genomic), 453 bp, Enterococcus faecium; double-stranded, circular
  misc_feature (B) LOCATION 1...453
  hypothetical: NO
  anti-sense: NO
aaaggagaggagatctttatgcataaaggaacggaaatagattttgtattaaatgatagtttgaaagcactagaactgtatcaaacaatctttgatgaaatacaactgattgaggcaacagattaccctagaggcaataatgaagtcatttttaccttgtatggcacgagattccatatgctggatgaaaacacgtctcttggtttgactgctcctactgctgaacatccaaatacgatctggttcaatatcatcgtctctgatatcgaggacacacataataaagcattacgaaatggctgtgtagagattcaagaaatgacagaaatgatggactttggtgtgactaactcaatgttcagagatccttttggttatttatggatgcttcatcaggtccatcgtgaagtaagttttgaagaaagaaaacaactttttgagaaatatatgtaa

SEQ ID NO: 1966 - DNA (genomic), 1398 bp, Enterococcus faecium; double-stranded, circular
  misc_feature (B) LOCATION 1...1398
  hypothetical: NO
  anti-sense: NO
ttattggaggaaaaatttatggaagaaacaaaaacttattcatggaagcaattattgatggtcagttcacttatcttcgggatgttcttcgggtcaggtaatctgatctttcctgtccacttaggtcaaatggctggatcaaactggatcagcgctggtgtaggatttgccatctcaggcgctcttttcccattattagctatcttagctgtagtagtgacaaaaagtgatggtctgtatgacttagctaaacctgtcggaaaatggtatgctgccttgttcttgatccttgttcatttaacgatcggaccattctttggtacaccgcggacagcagcaactgcttttgaaatggctgctaaaccctttttgcctgaaaaatatgattcattaggtatgtttttattctctgctcttttctttttacttgcttatttccttaatgtacatccaacacgtttggtcaaatatgtcggaaagtatttaaactccttgtttcttgcattattagctatcatttttgtcgtttctttattccaacccatggggaatctaaaccaatctgctgcagattcttatcagacgaacgctttgacaaatggcgttttagaaggatacaacacggttgatgcagtagctttacttgctttaagtgtcacttttgtccatgcagttcgtgatcttggttttaaagataaaaaagtcacagaattaacagcaaaagctggtagcctgagcgttgcgttagaagtcatgatttattttggtctggtccttctcggtgcgatgagtttgaataagatgcctttatcagaaaatggcggaactgcactttctcagatcactaatttttatttaggtaacttcggtgctagcttcttaggggtaatggtcacattaggtgtcttcactaccgctatgggactcgttgtttcttttgcacaagatttccataaactgttccctaaagtcagttatatgacatggctgcggttaacgacttttgtctcttttgtcgttgcgaatgccggattggataatatcatccaatggtctttaccagtattgatgcttttgtatccattgtcacttgcgttaatcttgctttccttaacagcaaaattcttccaaaagagtccatttgtctatcaagtaacgatgttcttttctgccgttccagccgtattggatatgttggcaaattcgcctgcattagtgagtcagcaaactgtcgtagcaagcttactaggattttatcatcatcacgttccttttgctgcattaggacttggctggatggtcccaacgttacttggttacgctggcagcttactcttttattacgcctatcgcctatcagggtataaacaagaagcaaatgaactaccagaagaataa

SEQ ID NO: 1967 - DNA (genomic), 456 bp, Enterococcus faecium; double-stranded, circular
  misc_feature (B) LOCATION 1...456
  hypothetical: NO
  anti-sense: NO
ctattggaggaatgtatgatgattaaattgtatacaggttctggctgctcgtcttcaagacgcgcaaaacgttggcttatcgtccatgatataccgtttatcgaacagaacttaattcgtcaaccactaaccaaaaatgaatttatccacttactaaaattgacaaacaacggcgtgaccgaaatgctctctactcattctattagttataaaaatcttgttcacagaatagatgaactcagtttgagtgaactatatattgagattcgtacatccccttctttattgaaaaaaccgattatctacgaccaatctgcaaaacttttgactggatttagcgaagataaaatcaggatgttcctttctaaaactaaaagaaagcaagagctcaacgaactcttgctttctggtcatcttgtcgattttaaagaaaataatctttttgcaatgtcttaa

SEQ ID NO: 1968 - DNA (genomic), 876 bp, Enterococcus faecium; double-stranded, circular
  misc_feature (B) LOCATION 1...876
  hypothetical: NO
  anti-sense: NO
aaaatggaggaagaaagtatgagaatcgcatgttacggtgttcgtccgaacgagataaatntttttgaaaaattgaatatttaccattatgatctcagtctttatgaagaactgttgacacatgacaatatcgtgtcagcaaaggaacatgatgctgtattgttgaggggaaattgtatagcagatgagaccaatcttgcaaaaatgcaggaatatgggattcgttatgtttttacacggactgtgggagtcaatcatatcgatctacaagcggcagctgattttggtatgacagtagcccgtgtaccatcgtattcgccaaatgcgatagcagagttatctttgacttttgccatgatgcttttgagaaatactgcgtatacgacgatccgaacatctttcaaagattttcgagtggatgagcaaatgtgtagtcgtgaaatcagaaattgcacagtagggatcataggaacaggcaggatagggttgacggaagctgttttgtttaagggactaggagccaaagtgatcggctacgatattcatcagacagaagctgctaaaaaagtattgacgttccactcgcttgaagagttattagccaaaagcgatattgtcagtattcatgtacctcatatcccaggtgaaaacgatcaaatgatcaatgaaggatttttagctcaaatgaaaaaaggtagcatcttgattaatacagcccgtggagagcttcaagataatgaagctattttaagagctttgaaaagcaatcatttagctggttttgcaaccgatgtttttgcaaatgaaacagaggtttttttccgatccttccaagccatgggacgacgattccagaccctgctatccagcaattag

SEQ ID NO: 1969 - DNA (genomic), 237 bp, Enterococcus faecium; double-stranded, circular
  misc_feature (B) LOCATION 1...237
  hypothetical: NO
  anti-sense: NO
caaacggaggaaactatggcaagacgaagaagaaaatcaagagggaaaaaaatatttttgattattttagcagttcttatcgtattagtattagcaattgtaggagtaggaagcaaaatatatctggatctctcacattctattgagaaaacttacgaatcagtggaacgaaaccccaaggagaacgaacgacaccagttgatctggacaaacaagaatctttctctgttctattga

SEQ ID NO: 1970 - DNA (genomic), 903 bp, Enterococcus faecium; double-stranded, circular
  misc_feature (B) LOCATION 1...903
  hypothetical: NO
  anti-sense: NO
cagcaggaggaaggcatgaaaaaagaaaaactaaaacggttcttggatcaagacaatgtggtcggttacgtatttgcttctccattcatcctaggatttctattgataacagtgataccgatgatcttgtcactttattattcgttcaccgattatcgtttgggaaatccagtctcatggatcggcttggataattatataaagatgctgagtgatgcccgttttttgaactccatccgagtcacttttctctatgtatttgcatctgtacctgtgaaactgatctttggtctattgattgcttatcttttaacgaggaatatcaaaggaacgactttctttcgttctttgtattatgtgcctagtttgatcggtggcagtatttctatcgctctagtttggcgggagttgttttctaaaaacgggttagtgaatattttcctggaacgattaggcgcacctgcgctttcctggtttagcgatcaaaaactggtcatgatccctcttgttttgatgtctgcttggcaattcggttcggcaatgatcatctttgctgcaggtatcaaagagatcccaggctcgtattatgaagcggcagagatcgatggagcgaacaaatggcagacgttttacaagatcacgttacctcttctttcgccgatcattttgtataacttggttatgcagacaatcgcggcgtttatgacttttacgcaggcatttatcattacccaaggtggtccgaatgatgccacgaacttttatgctctttatgtgtataaccaagctttttcttttaattctatggggtatgctagtgctatttcgtggatcatgctgttgattatgggagctgtcacctttctgattttcaaatcatcaaaaaaatgggtcgttgtgtga

SEQ ID NO: 1971 - DNA (genomic), 699 bp, Enterococcus faecium; double-stranded, circular
  misc_feature (B) LOCATION 1...699
  hypothetical: NO
  anti-sense: NO
tcgaaggaggaagataaaatgactgatttctttaaaacatatttgcccaatgtttatttgattccggatgaatttgtcgaagcgacgaagcaaacactatatatgtctttttggacagcattcattggcgggatgattggaatcatcttaggtgtgacgttagtagtgacacgccctaatggattactagctaaccgtctgctatttgaaatacttgataagctgatcaatatcattcgttccatccctttcattatcttgctttctcttttagcattgactactcgtttcttagttggaacgacgattggtgcgaaagcagctttagtgccattgatttttggagttgttccgttttttgctcgtcaaatcgagaacgcactgctagaagttgatcctggggtgatcgaagcggcagaagcgatgggaaccagtccaatcggtatcattttacgtgtgtatttgttagaaggtttgcctggtatcattcgggtctcggcgttgactatcatcaacgtgatcggactgactaccatggctggagcagtaggtgcaggcggattagggaatcttgctatatcgagagggtataatcgattccaaacagatgtaacgattgtggctacattattgattctaatcttagtttttttaagtcaatttatcagtaatcaactgattaaaaaaattacacattga

SEQ ID NO: 1972 - DNA (genomic), 1305 bp, Enterococcus faecium; double-stranded, circular
  misc_feature (B) LOCATION 1...1305
  hypothetical: NO
  anti-sense: NO
ttggaggaggaacacatggatagaaaaaatgtgacaccaaagatgaaaaaaagtaaaaataatagcctctggcgtaagttaggtctggggcttgttggagggatcgttggaggactactgacagctggcattttttatgcagcgatgggcactggcaacaatagttctactgctacaagcggcaatcagaattctgccggtgaaacagttgtggaaaatgtcaaagtcaatgtagattctgatatcaccaaagcggtagataaagttcaagacgctgtcgtttctgttatcaacttacaaagtcaaaaccaatcaagcggttttggcggactattcgggcagcaagaagaaagtagcagctcagatgatagtaatttggaagcttatagtgaaggaagcggcgtgatctacaaaaaagacgggaatactgcttatgtagtcacgaataatcacgtagtagatggccagcaaggtcttgaagtcttgatgaaagacggtacgaaggtaaaagctgaattagttggaacagatgcttattcagatttagcggtgttgaagatcaattcagacaaagtcgaaacagttgcctcttttggtgactcaagtgctctgaaggttggtgagcctgcgattgcgattggttccccactaggatctgaatatgcaaattctgtcacttcaggaatcatttcttccttgaaccgacaagtgacaagtacgaatgaatcgaacgaaacagtcaatatcaatgcgatccaaacagatgcagcaatcaaccctggaaattctggtggtcctttagttaatatcgaaggacaagttatcggtatcaactcaagtaagatcgcaagtacttctgaatctacttctaatgtaagcgtagaaggaatgggatttgctattccaagtaacgatgtagtgaatatcatcaatcaactggaaaaagacggaaaagtgacacgtccagctctaggtatcacaatggtcgacttatctgccgtttctactcagcaacaagaacaaatcttgaagattccttcatctgtaactaacggtgtcatcgtgacaaatgtccaaacagctacaccggctgaaaaagctggattgaaacaatacgacgtcattactaagatcgatgacaaagaagtttcttctggtgtagaacttcaatctgctttgtataagaaaaaagtgggagattctgtcaaaatcacttactatgaaggctcgaaagaaaaaacaactactgttgaattgacgatcgatcaatcggcattaaaacaaaatcaaaatagtgaaaattaa

SEQ ID NO: 1973 - DNA (genomic), 2028 bp, Enterococcus faecium; double-stranded, circular
  misc_feature (B) LOCATION 1...2028
  hypothetical: NO
  anti-sense: NO
aggagggaggaaaaatttatgcgttctttagatgatccaatcactatgctggcaggagtcggagaaaaaagagcagctagtcttgccagcttgggcatccaaacgattgaagacttactgacttattatccttttcgctacgaagatattcaggaaagaaatctaaacgagatccaggatcaagaaaaggttactttgaaaggaatcgtagtctcgcctcctgtgatgaatcgatttggttataaaaaaagccgattgcaatttcgtatgatgcaagaacatgatgtgttcaacgtttctttttttaatcaaccttatctaaaagaaaaagtcattttatcggaggaaatcgccgtatacggtaaatgggatgcaaagcgtaaagccttgaacgggatgaagattttaggttctcaaacaatggatgacttttcgccgatatatcacgtcaacaaatcaattcgtcaaacgacattagttgatctaatcaaaaaagggtttcaagaatacggcacattgattgaagaaaatctgccaaacaaccttgtggagaaatatcgactgcttgaccgagcttctgctgtaagaagtatgcattttccaaaagaccacgaagaaaaccatcaagccaaacgacgtgtcgtttttgaagagttctttttatttcaaatgcgtcttcaaggattgaaaaaagcagaaaaagcagaaacgaatggtttggagatcctttatgatgtccaaaaattgaaacaatttactcaaaagctaccttttgaactgacaaatgcacaaaaacgtgtaacgaatgaaatctgtcgggatcttcgcagtccgcagcatatgcagcgacttttgcagggagatgtaggtagcggaaaaacagtggttgccgcgattgcgttatacgctaccgttacagcaggtttccaaggtgcgttgatggtgcctacagaaatcttggcacaacaacatatggaaagcttgcaacagctgtttgatcccaatgaagtaaccatcgcattgattacggggtcaacgaaagcaaaagaacgacgtgagctccttgaaaaactagagcaaggggaaattaacgtcgtgatcggcacacatgcattgatccaagatggagtcgaatttcagaatttaggtctagttattacggatgagcagcaccgttttggcgtgaaccagcggaaagtacttcgtgaaaaaggctggcgaccagatgtcttatttatgacagcgactccgattcctagaacattagctattacagcatatggtgagatggatgtatctatcattgatgaacttccagctggacgtatcccgatcgaaacacgctgggtaagaacacctcaattggacagtgtactggattggacgaaaaaagaactggcaagaggacatcaaatgtatgtcatctgtccgctgattgaagaatcagaagcattagatgtaaaaaatgcagtggaaatctatgaaaaacttcgtgaactatttgcaccaaaatatgaagttggcttgttacatggtaaaatgaagaatcaggaaaaagaagtaatcatggaagccttcaaagacaaccagatgcagatattagtttcgactactgtaattgaagtaggggtaaacgtgccgaacgcgaccgtcatgctgatcatggatgcggatcgatttggattggcacagctgcaccaacttcgtggacgtgttggacgcggaagtgatgcttcctactgtatcttagttgctaatcctaaaaatgaactaggtgtggaacggatgaaaatcatgacagagaccaccaatggttttgtactaagcgaaaaagatctggaattacgtggtcctggtgaagtatttggcttccgtcaatctggtctgcctcaatttgcgattgctgacttggtgacggatggaaatgttttggaggtagccagagaagaggctgcagccctttggcaaataaaggattggcagatgcttcctgagtatcagcctttagcgcgaaccctggcacatagt

SEQ ID NO: 1974 - DNA (genomic), 306 bp, Enterococcus faecium; double-stranded, circular
  misc_feature (B) LOCATION 1...306
  hypothetical: NO
  anti-sense: NO
ttttgctgggattccgctggcattctcttttattattttgttggggaatgtangtgtgctgaaaatgattttgccatttctagcggacttcaatttgtattcttggtggggattgaccatcacgtatacctatttccaaattccgttaggggtcttgtttttgtatcccagcatgaaggaagtgaaaaaggaatggctggagtccgcacaattgctgggcgcttcatcagcgtatgcttggttcaaggtggctttgccttttttgcgaccatcgattgccagcacctttgtcatcttatttgctaa

SEQ ID NO: 1975 - DNA (genomic), 507 bp, Enterococcus faecium; double-stranded, circular
  misc_feature (B) LOCATION 1...507
  hypothetical: NO
  anti-sense: NO
agattatgggaagaagatcctcgagaagaattggtcactcagcttttagaataccgtaaatataaatatgcagctgaaagactgacagaaaaagcagaggaacgaagtctttattacacaaaagaacctatgaacatcgatgggttagcggatgctgaaaagccgttgaagcgaggacaagtcaaaaaaatcgatttgatccgtgccatgcagaaaatcttagaacgtaagaaattttctcaaaaagtggaaaaaacgatcacgcccgatgacacaacgatcgaagaacgaatggtatttatcgaagagcgtataaaaagaaatgcgcatggctgtactttcgattctttttttgagtcaccttctaaaagtgaagttgtcactacttttatggctttgctagaattgatgaaaaaagggcagatcattgcgcaacaaaaagaaaactatgaatcaattatgctttatccagcagtaggagataccgaacatgacgaaattaagtga

SEQ ID NO: 1976 - DNA (genomic), 216 bp, Enterococcus faecium; double-stranded, circular
  misc_feature (B) LOCATION 1...216
  hypothetical: NO
  anti-sense: NO
agatcatgggaaataacatatactatccaatttttatttttggaacgaaaacaatggaaaaaacttgattggctccttcatatgaacgaagagatttcagaagaagaacagcggttgatcgaaaccgatctgcgacttctgcttgcagatcatccacctcactttttggcaagaaatggccaatatttttatattcatcggttaaaagttaactga

SEQ ID NO: 1977 - DNA (genomic), 870 bp, Enterococcus faecium; double-stranded, circular
  misc_feature (B) LOCATION 1...870
  hypothetical: NO
  anti-sense: NO
gaggaatgggaaatggctgaaataatggataatcaaacaggtgctcctgaagaaatcacgaaaaaagatgtaacaaaagcctatctgagatggcattttgcaaacgaaattcctcactcttttgaacgttacttggcgccatcactactatacggaatgatgccaatcttgaaaaaactttataaagatgaagactctttaaaagcagcatataaacggcagttactgttcttcaacactcaattaagctggggtggcggtgtgattactggcctaatgtcttctatggaacagcaaagagcagaagaagagtatgaagaaaaagagatcttgatgcaggatgacttgatgtataacacgaaagcgggattgatgggggcactagcaggaatcggagatgcaatcgattcaggaaccgtccaatatatttttatcgcaatcgcggtaccttgggcacaacagggaagtcctttaggcgcactttttccttttatctgctttgggttgtatcaggttttactaggggtatttttcgcaagacaagctttcactatgggccgtaatgctacaggcctaatgcaaaacactggtgttcagacagcgattgaaatgctatcagttttagggttgtttatgatgggggtgcttgcgggaaactatgtaaaagtagaatcttcattgaaatttgcgatatccggacgtgagtttgttatccaggaaattcttgatcaaatcgtgccagggatattacctttagctgtcgtaatgggtgtgtacttgttctatacgaaaaaaggattgaaagtcacacaagcattattatggctgactggaatattaattgtgctagcaggaatcggtattttataa

SEQ ID NO: 1978 - DNA (genomic), 753 bp, Enterococcus faecium; double-stranded, circular
  misc_feature (B) LOCATION 1...753
  hypothetical: NO
  anti-sense: NO
aaaaggtgggagaaagtgaaaatatttagacgaatactaattggcttagtcatcattttaggattactcggtggagccggttattactatatacagcaaaatacgtacgaaccatcgtcagaagcgcaagtgttggtaaaagaaggaaaaaacaaagaagattacttattttttgaaggagagaaaaagaatcatggaaagtctccattacttattttttatcctggtgctctcgtagagccagaaagttatagtatttgggcgcaagatttagcaaaaaacggcttttcagtcgctattgtcaaaatgccacttgatctagcagtgatgggcggaaacaaagcggataaggtcaaagaagattttccaaattccgattatgtgatcggtggccattcattaggtggcgtaatggcaagtcgttatgtcaataagaatcattcagacaaacatttaaaaggggtattcttcatggcaagttatcccgacaaaaaaggaacattgacagaatcagctgttcctgttttatcgatcacggcgacaaaagataaagtattgaatcaggaagcttatcaagaagctaagcagtatttaccggaaagaacagagtatgtatcaatcaatggcggaaatcatggaggttttggcagctatggtgagcaaaaaggagatggagaggcagaaatttctaacgcagaccagcaaactgtgatcgtcaatacattggaaaactggctgaaaaagttgaaataa

SEQ ID NO: 1979 - DNA (genomic), 540 bp, Enterococcus faecium; double-stranded, circular
  misc_feature (B) LOCATION 1...540
  hypothetical: NO
  anti-sense: NO
tcgtatcgggacagctgtttctctgcgagtattagagatctatctaaagaagcacacccaaatgttttattcgcaggaagcgatgtgcaagaagaagtaggcttgcgaggtgctcgaacaagtacacaccttgtaaatcccgatattgcttttgctttagatactggtacagcaggagacactccaggaatgacaccaaaagaagcagattcgattttaggaaaaggcccacagattttgatttttgatgcatctatgatcccgcataaaaaattattgaattttgttattgatgtagcagaggaaatggatattccattccaatatacagtgatttctggcggaggaactgatgcaggacaaatgcatttgacaagagatggtgttccgtctgtagccattaccgttcctgttcgttatctgcattcccatacatcagtgattcatgaagatgattatttgaatacagtgaaactagtcacagaattagtgaaacggcttgatagtgaaacagttgaaaaaattcggagttatgaataa

SEQ ID NO: 1980 - DNA (genomic), 213 bp, Enterococcus faecium; double-stranded, circular
  misc_feature (B) LOCATION 1...213
  hypothetical: NO
  anti-sense: NO
aagaaacgggatacgcaagcagcctatgctttcttaaaacgactccataaacagtttggtgagccgaaagcaattgtgaccgataaagcaccttctcttggctccgcctttagaaagttacagagtgtgggtttatacactaagacagagcaccgaactgtgaagtatcttaacaatttaatagaacaagaccatcgacctattaaacgatga

SEQ ID NO: 1981 - DNA (genomic), 909 bp, Enterococcus faecium; double-stranded, circular
  misc_feature (B) LOCATION 1...909
  hypothetical: NO
  anti-sense: NO
agtatgcgggaaaaacactattttaatcaagaccgtaatttttggatcaatgtacagcaaaacgatgtgctagctgttaaaaacttaaaagaagaatatggcattagtgacgagatgctgacttattctctagataaaaatgaacgggcgcgcgtagagtacgattcttttgatgaagcgttactgcttgtatcaaatgttccgcaccagcaaaaagtcgataatcattatgaaactagtcctatcgcttttattttaaaagaagacggtttgtttacatttaccacgccgaataccgagtacgtgattcgactaattcgatcgcttttggaacgaatgccagacatgagtgtatacagtttattgtttcgtacattgtttttgatttctgattccttttttcctttaatcgaggaagtgaatagtgaacgtcagcggcttaatctgaaattaagagaaaaaacaacgaacaagaatctgctgcaactttcagatttagagatcggtttggtttacttagttacaggaacaaaacaaaatgtagtacttttagaacaaatcaaggcattggctatttatcgcaagttgtcagaaaaggaaaaagaagagttggacgatgcgctgatcgaagcacgacaagcagttgaaatgacgaacttagcttcgcagattttagaccagctctctggcacttataataatttgctgaataacaacttgaatgacacgatgaaatttttgacggtctggtcgctgatcttgaccgttccaactattgtgacaggattcttcggaatgaatctccagttaccctttacccattccgttttcggatggggaatcgccttgatcatcagtttggtcttatctatttggatgcttattgcactgtggcggcggattcgttga

SEQ ID NO: 1982 - DNA (genomic), 225 bp, Enterococcus faecium; double-stranded, circular
  misc_feature (B) LOCATION 1...225
  hypothetical: NO
  anti-sense: NO
ttgtttagggataccagaataacgctgatcaaaagtggaaccgatatttttgaagaaaaagacgattccaatcaaaaacggaatgatgtagtagaacaggcgatagagcaagatccacacaacgactatttctcttggcacaccaatagcggacaacccgataatcatcattacatcgaaactcccaatttctcctggaatcatagacacgattcctatcactga

SEQ ID NO: 1983 - DNA (genomic), 378 bp, Enterococcus faecium; double-stranded, circular
  misc_feature (B) LOCATION 1...378
  hypothetical: NO
  anti-sense: NO
attcatagggagggagccttcgtggaagtgaaagtctatggatcagcgcactgtgtaacaagtctgaaggcgaaacaatggttagaacaccatcaattgccttatcaatttgttgacttagaagaacgcgatctaagtacagaagaagcagaagaattatgcagttttgaagaagtgcaagcagaacagctatttgcgacttggtctgaggcttttcacaacattgcgattgacctttcctgtgtaggaaaaaaacaactgatttttttatgcacacaacataccaatctcctcagacgtcctttgattattatcgatgaagttctatttattggatacaatgagcagttgatggaacagcttatcttaaataaatag

SEQ ID NO: 1984 - DNA (genomic), 603 bp, Enterococcus faecium; double-stranded, circular
  misc_feature (B) LOCATION 1...603
  hypothetical: NO
  anti-sense: NO
agaaaaagggagatggtgaccatgcgaagatttgcaattaacggttacggagaagcacaagatgtttttgaagaaatcgatgctcatcccagagaagtcggttctggacatgttcgtgtagaaataaaagcattcagtgtgaatccttatgatgttgccttgcgtttaggagaaatgaaagagatacgaacatggaaattcccttatgtaccaggtaatgatggcgctggtattgtgacagagattggttcagatgtcacaactgttcatgtaggtgatcgagtagctgtccatgcagtcggcgggacttacggagaaaaagtcgtgttgccatcagcaaaagtagcaaaaattccagataaaatgagttgggaagaagcagccggaatggtcacgccaggaattacggcttataatctaatcaaccatttgacggaaatccagccgacagatactgtaatgatactaggagcatcaggtgcggtcgggtcaagtctgatccagcttctccatgaaaagggaatccgaatcttaaccagtgcatccagtaaaaatgaggaaaaggttacaaaatttggagcttccccctttgctggcttatga

SEQ ID NO: 1985 - DNA (genomic), 1020 bp, Enterococcus faecium; double-stranded, circular
  misc_feature (B) LOCATION 1...1020
  hypothetical: NO
  anti-sense: NO
tcagaaagggagaaaaaaatgaaaaaaaatatggtttcagttgccgtactatttgcttttgtcttctcactattcagtgtgggatctctggcaaatgcagatgaaaaaacaccgagcgatgagtttcgcgtaggtatggaggctgggtatgcacccttcaactggtctcaacaaacagatgagaataatgccttgccaattcaaggccaaaatagttacgccggcggttatgatgttcaaatcgctaaaaaagtagcagatggtttagggaaaaaattagtcatcgtccaaacgaaatgggatggtctggctcctgcccttcaatcaggcaagatcgacgcgatcatcgccggaatgagccctactgctgaacgacgaaaagaaattgattttaccgatccttattacgaatcacaattagtagtagtagttcaaaaagatagcaaatatgcaaaagcaaaaagtttagcagatctttctggagcaaagatcactgctcagttaaatacattccactatactgtgatcgatcagataccagatgtgcagaaacaacaagcaatggataatttctcagcaatgagaacagctttagcttctggaatgatcgatggttatgtcagcgaacgtccggaaggtgtaacggcaactagtgtgaacaaagacttggaaatgcttgaattcagcggtgcagatggcttccagacaaacccggaagatgttcagatttctgttggtatgcgtaaaggcgacccggatatccaaaaagtaaaccagattctttctggcatctctaacgatgaacgaaccaaaattatggaccaagcagtcaaagatcagcctgctgcaactgatagtgaagaaaaacctggcatcatttctgatttcactacgatttggaaacaatacggcaatatgttcttacgaaggtgctggacttaccttgttcatcgcattgatcgggacagttgtcggtactacacttggattactgattggtgtcttccgttcggtacctga

SEQ ID NO: 1986 - DNA (genomic), 198 bp, Enterococcus faecium; double-stranded, circular
  misc_feature (B) LOCATION 1...198
  hypothetical: NO
  anti-sense: NO
aatatgagggactatttttccatttttttctctaatactcaggttaattcgctgatttcacaacctctcgataaatggtgttcaaaagccagtttctcggtattaagtccaatttatgcaaaaatgtggaaagccattttcacaaaatttttcttaatactcgaaactaagcggctttttcacagcctctttatttaa

SEQ ID NO: 1987 - DNA (genomic), 198 bp, Enterococcus faecium; double-stranded, circular
  misc_feature (B) LOCATION 1...198
  hypothetical: NO
  anti-sense: NO
gctcggagggagggaattaacatgtcaaaaacagtcgttcgcaaaaacgaatcacttgacgatgctcttcgtcgcttcaaacgttccgtgtcaaaagcgggtactttacaagaatctcgtaaacgtgaattctacgaaaaaccaagtgtaagacgcaagaaaaaatctgaagcagctagaaaacgcaaaaaattctag

SEQ ID NO: 1988 - DNA (genomic), 882 bp, Enterococcus faecium; double-stranded, circular
  misc_feature (B) LOCATION 1...882
  hypothetical: NO
  anti-sense: NO
aataggagggaaacctgtatggcaccagaaagctcgattacagttactgtgaatagtcgaaaagcagttagtggtaaaaaaatcattcgaacgattagtatgctagttatattgttggttattgcgtttccttttttgtggctgattatttcttcttttaaacacgaaaaagacattatctcatttccgcctagaatatttgcagatagctataccctagataactatattaaggtttggacaacgatccctttattagattacatcaaaaatacagtgatttttgctggagggacagtgatcacttctgtattctttgattctcttgcggggtatgcatttgctcgtatgcgtttcaaaggaaaatcagttttgttctatttcgttttgctgacaatgatgatcccattccaagtcttcatgattcctctatttattgaagtcaatttgcttggcatgcttgatacttatgcaggtttgatcattcctcgtatgacaactgcatttggtatcttcatgatgcgttccttttttattactttaccagattctttggaagaggcagcacgcattgatggattaagtgagtttaatatttttttgaaaatcatgttgccattgagcaaacctactcttttatcattagggattttcacgctgatgaatagttggaatgacttgctttatccattgatattgacaagtagttcaaaaatgagaactttaccagcagggttagctttatttacagggcagaacatttctttttatggacctgtaatggctggaacggttatttcaatgctgccattactagtggtttatatttttgcacagaaatattttgttcaaggaacagctatgtctggaatgaaagagtga

SEQ ID NO: 1989 - DNA (genomic), 453 bp, Enterococcus faecium; double-stranded, circular
  misc_feature (B) LOCATION 1...453
  hypothetical: NO
  anti-sense: NO
gaaaggagggaaataatcatgttagtacctaaacgtgtaaaacaccgtcgtgaattccgcggaaaaatgcgcggggaagctaaaggcggaaaagaagtagcattcggtgaatacggtttgcaagctgttgattcacattggatcacaaaccgccaaatcgaagctgctcgtatcgcaatgactcgttacatgaaacgtggtgggaaagtatggattaaaattttccctcacaaatcttatactgccaaagcaattggggtacgtatgggttctggtaaaggggcacctgaaggatgggttgcaccagtaaaacgtggtaaaatcatgtttgaaatcgcaggcgttcctgaagaagtagctcgtgaagcgttacgtctagcttctcacaaattaccaatgaaaactaagatcgtaaaacgtgaggaaatgggtggtgaatcaaatgaaggttaa

SEQ ID NO: 1990 - DNA (genomic), 552 bp, Enterococcus faecium; double-stranded, circular
  misc_feature (B) LOCATION 1...552
  hypothetical: NO
  anti-sense: NO
tggccaggggaaaatacacttcgatatattttgttaggtttattaagtaagaagaagatgacaggatatgaattgaatcaatcgttcaaaaatgaaataggagaattttggcaagcaaaacatagtcagatttatcctgaacttgcaaaaatggaagagcaaggaatcattcagcatcaagtagagatcacaggtgaaaaattggaaaagaaagtttatgaattaacagaagaagggaaggaacaattggcagagtggattcatacacccaccaatgaactaccggttaatcgagacgaatttgttctgaaattgtatttcgtcaaagacgtgaatgatccggcattagtagaaattattcagcagcagcgtgaccttcatgaagaaaaacgacttcatctattagagcgaaaaaaaacgatctttcctactgaaaaagaaaaacatgaaaattacggacactacctgattttagcgcatgcgatcaatcgggaaacagaatatgcaaattggctaacagatgtattagaagaaagtaaccgaaaaaaataa

SEQ ID NO: 1991 - DNA (genomic), 2109 bp, Enterococcus faecium; double-stranded, circular
  misc_feature (B) LOCATION 1...2109
  hypothetical: NO
  anti-sense: NO
aaaagaggggatgaagggatgaattttaaacactcgtggacaagacggttaaaatatgtttttcccataatgatgatgttaggtatattgtttgggttaaaaacagccaatgtctttgctgaaaaagttattgtcgatccgtcaaatccaatccagaacgtaaagaataattttattattccaaaagatgttcctaatgcaaaaacaaatattactgtaaacggagcgtcaaaagtttacaaatatcatgttgatgccaacaaaggtggttttacagacgactacgtaggattagtggagggaaacaaaaatatacgctatccttctttccaaaaagaatacggtgaaataaaccttgttttagaaggcgtaacaaccaacaccaaagtcaatattgactatggaaaaatcggtacgtataacgggaaaaaagtcaatatcaagctagttctatctaatattcacttatactcggatacgttgccgtggaatctactagataacaactatacaaaaactcattttcgagacgatggctataaaaatacgaatggtgcaatgagtaaatctaaaaaaagaacagtactttggatctcagacaatcttttctcaggaattgtttaccattcaacacaaatgaatgtgcagctagtagccacatatgaggacggtagccccgttcaattttcaggagatacatttatcagttttaactctttgaaccctgcaggaggaaaaagcacggatcttaaaggagaatatgcccactatgacaaaatgaatacgacagattggtatgtcagaaaagatacggttctttcagaatttaaatctttctacaacaatctgaacgtggtaggtggccacccaggaggaagctctaagctgacacaagcggataatgatttcaataatttgcatgataaattaggagatccgaagtttggtcaaggtactgtgtcctttaaaatatctgaagcaaatccgacgtttgtgattggttcttctaatgttcaaacctggtttactttatcttctgcgacaatctttagtgttgttcctgatcaacctgaaaaaacaggggttgataaaaatggaaataacgtgaacgataaaatgttgcaagtaggagacacgattcaatatcgaatcaaacagaaggtgaatcgattaggagtggatttactagcggtttacgatcgatttgagttaatcgataatttaccaaaagaagtaaattacgtcgatgcacacgttgaaagtggtacaaataaaaaattcgatgtatctggtgaagtgacctgtgacaaaacaaaacaccaggtaaaatatgcagcgaaagctgatacattaaaaaatcgaatgaagtataacggcgaaacttacgaattagtgatcaatgtaaaagtcaatgaattggccaatcaaaatagtgtagccaaaaatcagggaacgtcgatcattaataaagtagaaaaggatacaaatatcattaccgtttatttccctaaaattccagtgaaagaagtacaacaaaatggaaaagatgtaaacggacgaaatgacggtaagaagggtacgccgacagctcctttaaacgcaggatctgaagtacaatatctagtcacacaaaaatggcacacaaaaggcgtagacgctgcgtcagatcactacaaacaatttagtattcaagatccaattgaagctcgtttgacatataaagaagtttctgcgcaagtaatagataagagtaaaggaaaagatattacttctgaaggcacactaacttatgatagcaattcaagaacgctgaagtgggaagcttccgctgacttcttaagtaacaatcttttagatggacgagaaattcagctgatatttacagctaaaactccattacaatcagaaaaaaatattgataaccaagccgtagtagcagtagataatgtttctaataaaacaaatgttgtgacaattggggttgatcctaacttgccacaggtcattgttcctaaaacaggttctacacatttagtaacgatttcagcggtcagcttactattacttgtgttagcaacttttagttatgcggttctgagatacatttaa

SEQ ID NO: 1992 - DNA (genomic), 2568 bp, Enterococcus faecium; double-stranded, circular
  misc_feature (B) LOCATION 1...2568
  hypothetical: NO
  anti-sense: NO
acaggaggggataggatgaactggtacagattgacggtagaagatgtattgaaaaactatcaaacatcaacagaaggcttgtcgcaagaagaacgacagaaacgcctgactgatcaaggatataatgaaataaaagcaaggcagcagacaaaacgatggaaaaaaatagcaaagcattttactgatctgctgatgatcgtgttgatcattgcctcttttttgaaatttgcttctagtgaatatattgaaggaagtattattttattcgtagtgatcgtcaatggactcgttagttactggcaagaaagaaaagcggaagaatcattgaatggtttgaagcagctgatgggacaagaagcgatagtactatcaaacgggatgcaagaaaaaatccctgcgaaagaactggtaaaaggagatgtcattgtcttacgtgccggagatgtcgttccagcagatatccgattaatcgaagcacatgatttattagtggaagaatcgattttgacgggagaatcagaagcatctgaaaaaagtcatgccgttttgacagaagaagaatcgatcggcgaccagaaaaatatgggtttttcaggaacgcttgtacaatctggttctgcagtcggtgtcgttgtagaaacaggaaacacgacagaaatcggtaaaatcaatcaagcattgcaatcggtcgaacaacaaacgacgcctctgattaaaaaaatcaaccgattaaacaaacaaatttttcaaggcattctttgtttgagcctattcttagttatttttacgacatttcgatatggtatggattggcatatccttctttcggctacgattgctttggtggtgtcaatggtacccgaaggattgccagctgttttgaccatgattctatccgttggagtacatgaaatggcaaaagaaaaggcgatcatcaaaggacttccttcggtagaaacattaggttctatgacagtgatctgttcagataagacaggaacattgacaaaaaatgaaatgacagttgtggatgtagctgcaaaagaagaagcctgcgtgttgtccattatgaaaaactgtcaggaattaaaaacaaaagaagaacagaaaacagaaaatttaagtggcaatccgacagaagttgcgctgattcgacacacagaaacagccaatctacctttgaaaaaaatagaagcaaagattccgttcagttctgaatacaaatatatggcaacgatgcatgcggaggaaaaaggagcggtgatttacgtcaaaggtgcaccagaagtattatttgctaaatcaactctttcttctgcagaacaagaagcatggagtcagacagctgcagaatttgcgagaaaaggtcagcgtgttttaggatttgcttataaaaaagtagattcgaaacaggaactcacgcatgagactttaacccaattaacttttgcagggatcgccggattgatcgatccgccaaaagaaagtgcagtcaaagctgtaaaggaatgccaacaagcagggatctcagtgaaaatgattacaggggatcacaaagacacagcaaaagcgattgcggaacaaattggcttaaaacatactgccaaagttttagaagggatcgatttggatcttatgtctgatgaagagttgattcagcaagtgccaatagtcgatgtctttgctcgaacgacaccagaacataaactgcgaattgttaaagctttgcagaaaaatggagaaatcgtcggaatgaccggagacggcgtaaatgatgcacctgctttgaaaagatccgatgtaggaattgctatgggaatcaaaggtagtgaagtaagcaaacaggcagctgatatggttttaggagatgataatttccatacgattgcaaaagccgtaaaagagggccggcggattttggataatttgcaaaaaaccatcaatttcttcttgccaactgcattagctcaaggattgatcttgatttgggcacttatgctgaatcgcccgctacctttgtccccagtacagattttatgggtcaatatggtaacgacaatcactttatcttatgcactagggttcgagtcgccagatccagaaatcatgaagcgcccaccaagagatccaaagcaaggaatcctatctggttatcatttgtttcggatcatctatgtctccctactgatcatggttcctgcctatttattggctatgcagtttgaagggcaaagcttacagcaaaccattcttctgcaaaatatcgtcttagctcaagctgtttacatgatcaattgcagagagttgtccaagccgtcattgaaccaaggtcttttgcaaaacaaagcgctttttctttcattaggtatccttgctttattgcaagggatggttatttttctaccagtcggccagcagctgatcggtacagtaagtttaacgatgacacaacagttattgattggagcaaatgtgattcttctattcttagttgtagaaatagaaaaagggatcatgaacaaactgtttcgcaaaaaagaaaaaacagctagagaatacagtcgctag

SEQ ID NO: 1993 - DNA (genomic), 723 bp, Enterococcus faecium; double-stranded, circular
  misc_feature (B) LOCATION 1...723
  hypothetical: NO
  anti-sense: NO
ataaagggggagaatgaattgactaaacatacccatcatgaaattggcgaccacgcagcctgtatccgcttggttccaatattcaatcacttagaggatagcgcgatgaattacattgctgaaaaagcccacacgaaacagtatcaaaaaggagagtttctgtttcgttcacaagccaaagaggatactttatatattatcaatcgtgggaaaatccgtatttatcgattggcagactctggcaaagagcagctagtgcggatcttgagccctggtgatttcaccggagaatggaccttgttcaacctggatgcagtacacgaggaatatgccgaagcaacccgagataccgttgtctgtatgattcagcaaaaagatgtccaagattttctggaacaatacccagctatttctttaaaactattggcggaaatgtctacacggttagaaagttcagaacgtcaaacgacacaagtagccgtggagagtgtcattacccgtttagttttgtttttggcagaaaatgtggaacctgaaatgggcaactctcccaccatcaccctgccgatggcaaaaaaagacattgcttcctatttaggaacgacacctgagaccatcagtcgcaaatttggagaattggaggacgagggattgattcaacagctgtctgggaaaaggatcaagattcaggatttagatgatttattgctttacagcgaataa

SEQ ID NO: 1994 - DNA (genomic), 1626 bp, Enterococcus faecium; double-stranded, circular
  misc_feature (B) LOCATION 1...1626
  hypothetical: NO
  anti-sense: NO
ggaggcagttttatgagagaacaacagaattaccgagccgctatctattgccggctttcttccgaagatggagccgaccatgaatccatgagcattgggaaccagagggcattgctggccgagtatgtgcagaaacaaggctgggagattgttgacacctatatcgacgacggattctcaggtacaaatttcgaccgtcccggctttcagcggatgattgccgatattgaaaaagggcgcatcaatctggtcattaccaaagacctctcacgtctgggccgtaactacatcatgtgcgggcagtacaccgagatttacttccctgagcgtcatgtgcgctatattgccctgaacgatggcgttgacaccctgaaccagaccagcagcatggatattacgccgttcaagcacatcctgaacgatatgtacgccaaagatatttccacgaaaatcaagtctacgcttcataccaaagcaaagcgcggcgagtatcttggcgcactcgacccctacggctacctgcggcatcctgacgataagcacaaactgattatcaacgaagaaaccgcgccggttgtccggcggatgtttgaaatgtgtgcggccgggatagggtcaaagagcattgcaacgacattgaacagggaggggattttgtctccaacagagtacacccgtttccgcaagcacaacccggaacgtgacggcgaatttgagcgccgcagtttctggacacggacttatgtgcagttcatgctgaaaaacgaaatctatgtaggaagcatggtgcagggcaggcagtacacaccctcttaccgcagcaaaaagcgggaaccgatacccaaaaaggactggatcgttgttcccaatatgcacgaacctattgtatcacgggaactgtttgacgaagcgcagaaacgtatgggggcgcggaaaaagaccatcaaagccaaagacgaacccgatttatttgccggactgttcttctgcgaagcctgcggcacttcaatggttccgaaagtcagccagcagaaatacttctattatacctgcgggcgcagccatgcgattgggaatttagcctgctccgcccactacatcaaccgtgacacctttcatcaggctgtgcttgaggacattcggcgcaacgccaggctgttcagcgaggacaccgagaaagccgcgcaaaagctaatggaactgaaatgcgccgaccagcagaaacagaccgcagcaatgaagcgtgaccttgcatcagcaaaaaaacggctggctgacctggatgtgaaactgaaacgcacctacgaggacaacatgagcggcaaactgcccgaccatatctttgcgatgtttatcgcggactatgatacggaacgggaaacactgaaagcaaaagttgcagaactggaaaaagcactggaaaaggttcgggatgcaaaggctgatattgaccgcttcgccgcccttatccaaaaatacaccagctttgaaaaactcgaccgcttcatgctgcacgaactgattgaccggatcacgatttacgaaacgccgggtatggggcgctgccgcaagggtaaggaaaagcgcattaccacctactacaaatttgtcgggactatccaataa

SEQ ID NO: 1995 - DNA (genomic), 390 bp, Enterococcus faecium; double-stranded, circular
  misc_feature (B) LOCATION 1...390
  hypothetical: NO
  anti-sense: NO
ataactttactgctgtcagaaaggaaaaaaagacacttggaaaaagaattatcaaaaagaatcatcgatgagcttcttacttatctatattcccacgaaataactgaaatacgtattggcgtagaatttgctgaggagggacttttcatagaaatacagggcacaacagaatctcagccagaagatctagatgtacttgctgatttgctgaacaatcctcgagaccctagcatggaaatctactatcaggagctattaggtaatcctcgacatgatcgggaagattatcatctgctaggtagtttgattgacgatgtggaaatcatgtatgcccagccgattatcaatatcaaaatttttcggcgtgcttctcctcgcccttattattag

SEQ ID NO: 1996 - DNA (genomic), 1452 bp, Enterococcus faecium; double-stranded, circular
  misc_feature (B) LOCATION 1...1452
  hypothetical: NO
  anti-sense: NO
aaacgtttactagaagaggtaggaggaattcaaatgctttcacaaaatgctgttacagcaaatacaataaaaaaagaaaaaaaggaatttgggatttccgataagataggctacatgttcggtgatctaggtaactgttttattttaggtttagtcaatagtttcttgatgatttattatacgaatgttcttggcgtttcaggggcaatcgtaggtacgttattcttgatttcgagaattttggatgcgtttgctgatgtgatggttggaagattatgtgatgtctcagagttaacagaaactggccgatttattccttggatcagaaaaatgaagtatccattttgcttagtgactgtcattttgtttttgccattcgtccaacatcttccaatgacggtgaagattgcttatatttttgtttcatacattgtttatgggatttttctctcaacaatcaatatcccgtatggagcaatggcagcagcaattagctcaaatcctaatgaccgcacctcgttgtccacgttccgaagcattggttctgcgattggcggatcaactacaggattcttcattccgattttaatgtatacccataacaagagtggacaacaagtcgtttcagggaatcatttcttttggatttcaatcggatgtgctgcaatagcatttgtcgcatatatgttaacttgtaaattgactactgaaagagtaagagttgtcaaaaacgaaaaagtatctgcttctcagttggtaaaaggtttgttagctaatcgagcactgattattttagtcattgttgacattttcattgtgatcaatcagattttagctgggacgaatatgacttatttattcaatgattacttccataataaacaagcaatgtctgttgctcttttatttacttacggaacagtagtagttttagcaccatttgctacaaagctgacaaaattatttggtaaaaaggaagcaagcgtatttgcgttacttgcttcttcatgtatgtacttgctgatgtatttccttcatataacaaatgcatgggtatatctgattcttttatttatcgctactttaggatctggtttattcaatttgatggtctgggcattcattactgacgtgattgattatcatcaatataagacaggcttaagagaagatggaacagtatatggagtaaattcttttgcgagaaaagtaggacaagcatgtgcaggagcggtaggcggatttatgctggcactcattggttaccaatcgtctacaacaggtggagccatccaatcagttttagtacaagaaaggatttatacgatggcaaacttgttaccagcattctgcttatttgtatccgcaatcattttgctagtaggttacccactgaatcgttcaaaaactgtatttattggtgaagaattgaaaaaaatcaatgaaagatag

SEQ ID NO: 1997 - DNA (genomic), 204 bp, Enterococcus faecium; double-stranded, circular
  misc_feature (B) LOCATION 1...204
  hypothetical: NO
  anti-sense: NO
catgatctactcaatatgtggggattgctggcagtttatataggagtatgcatcggattgcgagatcattgtctcaacagaagagggaggttgattatcaaagataaagtggtaaatcctacatttgatttagtaattgttgaggggactagcggcacaaatctctacaaagcgatgcttctagatctatatgacacattttaa

SEQ ID NO: 1998 - DNA (genomic), 972 bp, Enterococcus faecium; double-stranded, circular
  misc_feature (B) LOCATION 1...972
  hypothetical: NO
  anti-sense: NO
aatatgagtttagaaaatgaaaaaccgtattatgtagttgttgggggcgttaacggcgccggtaagtctactatttatcaagttcaaaatttaaaaagaaaagaacttgatactgatagaattaatgcagatgaaattttgagaagttttggcggaaattggaaaaaacaagcagacataaaccaaagtatgcgtgaagttctaagagagatcaaaggtcattttaaagaaggaaaatcttttcaccatgaaacgacttttggtggtaatccatatcccgataaaatgagacttctaaaggctaaaaaattaggttatgaatcgtttttaatctatataggactagattcaccagaaagagcgattgaaagggttaaaatccgtgttgctaaaggtggccacggtgtacctgaagatttaataagaaaaagatacgaattttctttaagaaacttagcagagttagagaaatattttgataatgtaagtatctatgataattcagatgagttttcttatatttatgttaaagaaaatcatacagttgtagccaataatacgcaagaatatgcttgggttcccaaagctattcaagagaaaaatgctgaaactcctataagcaaacaaattatgatggatatatctcaagaagagatgaatccaaaagaaacccttgaaagaatatattcagcaagtgatgattttattagtgatcggttttcaaaagaagcgcaagtcgatgatttttataggaaccataaaaatgaaatcaaggaacggattctatcaattagtttttctacaggggtatctcaagatgaattagtaggtcaagataaaagaagaaattcttgtaaattggcatatattaatagtgtaggtgagcttttagtaaaaactgatagtgagctattaagtatggaattaaatagagatagaaatatccaaaaaactgattttgaagttgaataa

SEQ ID NO: 1999 - DNA (genomic), 927 bp, Enterococcus faecium; double-stranded, circular
  misc_feature (B) LOCATION 1...927
  hypothetical: NO
  anti-sense: NO
aagagaatacttgccatgacggaaatcgctcgtcagaaaaataattccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataa

SEQ ID NO: 2000 - DNA (genomic), 654 bp, Enterococcus faecium; double-stranded, circular
  misc_feature (B) LOCATION 1...654
  hypothetical: NO
  anti-sense: NO
ttttcttcacttttaacagagtatatatataagttcatgattatggtaaaatatatatataatcatgaactcagaatatttttaagaagggaaacaatagtgagctataatgtacaaccgttaaggacaaatgaagagatacaagattttcagttttggctaagaagaacaagtaatccagaaagagatagttttttatttttgtttggaatcaataatgggttacgtatgtcagatattataggattaaaagttggagacatacgaggtaaaagtaagcctattattgttgaacataaaacaggtaagcgaaaaccgatttttatagataatttgagagaagagattttattatatactgaaggtaaagaagaaaatgattggttatttccaagtcggcaacaaggtcgacatataacaagggatcgtgtctatcagatatatgcagatatagcagaaaaattaggaagagatgatataggaacacatacattaagaaaaacttttgggtatcactactacaagaaaactagagacattgctaccttaatgtttatttttaatcatagctcgcaagcaattacaaaaaggtacattggtataactgaagatgaaataggggcatcgttacgtggttttaaattgggaggctaa

SEQ ID NO: 2001 - DNA (genomic), 960 bp, Enterococcus faecium; double-stranded, circular
  misc_feature (B) LOCATION 1...960
  hypothetical: NO
  anti-sense: NO
gactattcacttcgaggtaaattatttgcctttccaataataaaaagaaaggaattagttgtgactatcgaattaaaaaacgagtatcttactgttcagtttaaaacacttggtggtcaactgacttcgattaaagacgaggatgggatagagtatctctggcaagctgatccaaattattggaatggacaggcgcctattctatttcctatctgtggtagtttacgaaatgattgggctatttatagacctcaagaaagacctttttttacaggtcttattcgtagacatggttttgttcgaaaagaagaatttattctggaagaagtcaatgataatagcgtgacctttagtattaaaccaaatgctgagatgcttgataattacctatatcagtttgaactgagagttgtttataccttgaatggtaaatcaattagaaccgaatttcaggtaacgaacttggaaatggaaaaaacaatgccttactttattggagcccatccagcattcaatagttctttagtagaaggtgaaaactatgaggattattatattgaatttagtgaggttgagtcttgctcgataccaaagagttttcctgagacaggattattagatttgcaagatcggataccttttttggaaaatcaaaaaattctcgatttggactactcacttttttcccatgatgccattacacttgaccagctcaagtctcgtagcgtaacgcttcggtcaaggaagtctggtaaaggtcttcgagtagattttgatgattttccgaacttgattctgtggtctacaactaataaaagtccattcattgctttggaaccttggagtggtctctccacttcacttgaagaaggtaatttcttagaagataaaagacaggtaacgaaaatttcacctcaagaaacttctagaaaaatctatgatattactatccttaattaa

SEQ ID NO: 2002 - DNA (genomic), 441 bp, Enterococcus faecium; double-stranded, circular
  misc_feature (B) LOCATION 1...441
  hypothetical: NO
  anti-sense: NO
caagtatcactgagcttcaattattggaaaaagaacacacaatttctttttatgtacactttgaaaatggagaagatggatatgccatatggacaaaaaacgatcagtagaaaatgttataagggctctattttattttctgtcttgcttttatttcttttatgtacgtttttattgatggcagcattagaaagctaccgtttgtcaatggatcttaatatacgaatcagaaattattatatagcaaaaataatgaagcagatggctttatcggaacagtctacgcttgccgaaagttcggaaggagttttttactacacaactggatctgtaacatatcagtgggtacaacagtccctattcttagaggtggaagtctcaccgtttatctttcggttcacagaagaagtaaaaaatgatacagatactagtacagaatga

SEQ ID NO: 2003 - DNA (genomic), 1110 bp, Enterococcus faecium; double-stranded, circular
  misc_feature (B) LOCATION 1...1110
  hypothetical: NO
  anti-sense: NO
gtcgatggtttgggacgaccgaaagatacggaaccagagatcgtgcgtgaaaggcatttggatattaacggagaagtaatcaatccagtagctcgggattatccagatgagtttatccaaacaggtatctctgcaatcgatcatttgaatacattagttcgtgggcaaaaattaccagtattttctggctctggtcttcctcataaagaattagctgctcagatcgcgcgacaagcaacggtactcgattcatcagatgatttcgccgtagtctttgctgctattggaatcacttttgaagaagctgaatttttcatggaagattttcgtcaaacgggcgcaatcgaccgttctgtcatgtttatgaatttagcaaacgaccctgcaatcgaacgtatcgctactcctcgtatggctttgactgctgcagaatatcttgcttatgaaaagggaatgcatgttttggttatcatgacagacatgaccaactatgcagaggcattgcgagagatttctgcagcacggcgagaagttccaggaagaagaggatatcctgggtatctttacacgaacttagctactttattcgaacgagcaggaagaatccgcggactaaaaggatcggttactcaaattccgattctaacaatgccagaagacgataaaactcatccaatccctgacttgactggttatattacagaaggacagatcatcttgactagagagctttacaagagtgggattcagccaccaattgatgtactcccgtctctttcgcggttaaaagataagggaactggacccggaaagacaagagaagaccatgcagctacgatgaatcagctttttgcagcctatgcacaaggaaaacaggcaaaagaattagccgtagttttaggtgaatctgctttatctgatgtagacaagatctatgcgaagtttgctgagcggtttgaaaaagaatatgtcaatcaaggattctacacgaaccgttcgattactgaaacacttgatctagggtgggaactgctatcgatgttgccaagaaccgaattaaaacgaatcaaagacgacatgctggacaaatatctgccagaagggaagtga

SEQ ID NO: 2004 - DNA (genomic), 789 bp, Enterococcus faecium; double-stranded, circular
  misc_feature (B) LOCATION 1...789
  hypothetical: NO
  anti-sense: NO
aaaataccactactatacttacattgtggttatagccagttaggagagacatcgatgcaaaatacctttcaatcaaaatcactttattatcagctggtagaaatattgaaacaacgaatcgaaaacagtatggtcgctcatgacaagctgccatcagaaagagagttgaccagtttttatggcgttagtcgcacgacggtgcgactagcattgcaagaactggaaaaaatgggctacatttatcgacaacatggaaaaggaacctttgtttcggaattaaggacaaatgcgactgatctagctggcgcatatagttttaccgaacaaatgcgggcaatgggcaaacatcctgaaaccaagatattggccttcaagaagattgaagcaactaaatatttagcgagtcatctgaatgttcaactaggtgagcctttatttcaattagaccgattgcgcttagctgatgatttgccaatgatgatcgagaaatcctatttgccagtgaagctatttatgtccctttctcaagaaattctatttctgaaacctttatataatttgttttcagagaatttcaatcaaatcgtacggttggctgacgaggaattttatgccagcattgtccagaaagaagatagtgagttgctaaatattccagaaggatcaccagtgctccatttagttcgctcaacctataatctcgagaacgaagtgattgaatttacattaagtgtagcgcgggctgataaatttcattataagatcaggcatctgcgttccactaactga

SEQ ID NO: 2005 - DNA (genomic), 507 bp, Enterococcus faecium; double-stranded, circular
  misc_feature (B) LOCATION 1...507
  hypothetical: NO
  anti-sense: NO
aaaggtggtttactcatggctttaactccattagatatccaaaataagacattcccgacaaaaatgcggggatataatcaagacgaagtagatgatttcttagatttagttgttcgtgactatgaggaattgactcaaagaaatcgagaattagaaaaagcagtcaaacattctgaagaaaaacttgagtacttcaatgaattaaaagatgctttgaaccaatcaatcatcgtagctcaagatacggctgataaagtaaaaacaagtgcaagcaaggaatccgaagtgatcgttacttctgcacaaaacaaagcagatgagttagttgcgaacgctgaaaaacgtgcacatcaattaacaactgatgcagaagaaaaagcaagaaaaatcttgacagatgcaacagaaaaagcaagacagcttgcgacagaaactgaagatcttaagaaaaaaacacgagtattccatcaaggtctcagcttgatgcttgagtctagctacgcctga

SEQ ID NO: 2006 - DNA (genomic), 237 bp, Enterococcus faecium; double-stranded, circular
  misc_feature (B) LOCATION 1...237
  hypothetical: NO
  anti-sense: NO
acagcagcactcacaaaactaaacatgttcttgtcgtctttcaactgctgctgtctattaatttatgtattggagggaagaaaaatgaaattatcagtagaaggcactccagaagaaatacaagaattgctccaagctattggtagtagcaaggagcaaaaggtaagtgtttctaattcagatattgacggtatttgcaattgtttaaacagagaaaaaatatctaatccttactaa

SEQ ID NO: 2007 - DNA (genomic), 222 bp, Enterococcus faecium; double-stranded, circular
  misc_feature (B) LOCATION 1...222
  hypothetical: NO
  anti-sense: NO
aaaggagcactagttatgttaaaaataagctataaaccatcgacagattcaaaagaaatgaaaaaagaatatgaaacagtgaatgattttctgcaagggcagtacttagaagttccgccattgcaagaccattttgtcgttactactgttactttagatggtaaggaaatagaaatgccagatcaaacgattagcggattgtttaattactttaacaaataa

SEQ ID NO: 2008 - DNA (genomic), 234 bp, Enterococcus faecium; double-stranded, circular
  misc_feature (B) LOCATION 1...234
  hypothetical: NO
  anti-sense: NO
aacagaggtttttttccgatccttccaagccatgggacgacgattccagaccctgctatccagcaattagtagaaatgtaccctagagttcttgtaaccccgcatgtaggttcaaatacagatgaggcattatcaaatatgatttcgacaagtttcgagaactttcgtgaaataatagaaactggaaaaacgaaaaatgaggtatctcttcctaaagcccgtcaattaagataa

SEQ ID NO: 2009 - DNA (genomic), 228 bp, Enterococcus faecium; double-stranded, circular
  misc_feature (B) LOCATION 1...228
  hypothetical: NO
  anti-sense: NO
ttgcttcaactaaacggtcggcgtcttgcgttgtgttgtagaaataaaagctcgcgcgagcagtcgctgatacttcaaggtacttcaatagcggttgcgcacaatgatgacctgcctctgacggctaccccttccatgtctaaagctgtcgcgacatcatggggatgtaacccatccaaattgaatgcaacgactcctgtccgaaaattcgggtcttgtggaccataa

SEQ ID NO: 2010 - DNA (genomic), 1029 bp, Enterococcus faecium; double-stranded, circular
  misc_feature (B) LOCATION 1...1029
  hypothetical: NO
  anti-sense: NO
aagttacaacttaagtcctatgacatttttactgaatcagtgcataatatggatgtaaggaaaagcttgcaaacaattttgcttaaggaggcaatttccatgaaagaaagagaacgtattttagatttagtgaaaaaaggaatcctttcgactgaagaaggcttagatttattagaaagcatggcaactgaaaaagacgaaaagcaaatcaaaaaagaagcagacaaggtaactgctagtcataaagaaaaagatcaggcaagtcaattgatcgataaacttgaaaacggcgaagaagaaatttctgagccagttgatccaaaggaaagagaaagacaagatcaagaaaacttagaaaagatcttagatgaactagcaactgaagcgaataaaacttcggcgcgtctagatgaagtaaatgctcaattcgctgacaataaggcagcacgcaatgagaaacaggaagcattgatgcagctgaatacaaaagaagaattaggcgagttgacagaagaagaattagcacagcgtcagacgttagaagcagaaatcaaagaattagaagctagtggcgatacactgttagaagaacaattgaaattagaagcagaattaaaagatatccgtaagaatcaatggtctgagaaaaaagaaacgtttactgataagtttgaattgccagatgattggaaagatcaagcaacagatacactgaatcaagtaggcgaaaaaatgtcagaagctggatcacagttaggcaaattcttgaagaaaacattccaaactgtttcagaaacagtgaatgacaacatggaatggaaagatgtcagcttacgtgtccctgggattgcgacaacgaaatttgagcatgaattttactatgaagctcctgcagcaagtatccttgatatcaaggcagcaaacggaaacgtgacgttaaaaacgtgggacagcaacgatgtgaaagttgaagctaagatcaaactttacggaaaaatgggtgctgaaccatttgaagcatttctctga

SEQ ID NO: 2011 - DNA (genomic), 189 bp, Enterococcus faecium; double-stranded, circular
  misc_feature (B) LOCATION 1...189
  hypothetical: NO
  anti-sense: NO
ttactacaactgttattaatcgtttgtttttcattttttcactcctgcaaagtcaatctttttatttattataatcaggcaagtatccagtctacacaaaaagacaatggccaaagcggtcattgtctttacacaaaaaaccgcatagattctaatctatgcggcagtcaatgttcatgtctagcatag

SEQ ID NO: 2012 - DNA (genomic), 369 bp, Enterococcus faecium; double-stranded, circular
  misc_feature (B) LOCATION 1...369
  hypothetical: NO
  anti-sense: NO
tatcaacaactaccaaagagtccggctcagataaatgatagaacttggaagttagtaccgagtacaattcccaacggaccaggagtaacccatggaaggttggcagagaatgagttcatgttcaatgtgtcaacaaagaatttaaagatccaaacgttgacaatcggagcgaaaatgaacggtacaaagaaaatcggattcaatacgattggtgcaccaaataagattggctcattaaccccaaagaatgttggaacaactgaggcacgtccgatggcacggttacgttctgatttacaaatccacatgaacaagaatggaacaatcaatgtagctcctgttccacccatggtaacaataaacatttga

SEQ ID NO: 2013 - DNA (genomic), 2472 bp, Enterococcus faecium; double-stranded, circular
  misc_feature (B) LOCATION 1...2472
  hypothetical: NO
  anti-sense: NO
agatcaaaactggtatttctccgcggattccttatttggacgcggttgacttctatttatcaacattatctattgaaggagaaagcaagaatggcaaatgaacaaactagaagctctagacgacagaaacagcctactcctaaaaagagtgtgaagaagaattctggcaaaggttctggaaagtcctctggaacacataaaaaaggattatttatcaagatccttttaggaatactctcatttttctgtatcctctttttagcaggtgtaggacttttctggtattacgcaaaagatgcgcccgaattgacggataaaaaattagacgctaccgtatcttccaaactatatacacaagatggcgaactattcgaagatttaggcgcagaaaagcgtgaaaaaatttctgcgaatgaattaccgaaaacattagaagatgcgatcgtgtcggtagaagatcgccgtttttataaacacatcggggttgaccctattcggatcatcggttctgccctctctaactttacctctggcggactgcaaggcggaagtactttgacacagcaattgatcaaactttccttcttctccaccagtgccgaggatcagactctgaaacgcaaggcccaagaagcgtggatggctgtaagattggaacaaaaaaaatcgaaacaagagatcttgacctactacgtaaataaagtgtatatgtcaaacggcttgtacgggatggagacagcttctgagatgtactttggtaagaaattatcagaactttctttaccgcaaacagcattgcttgctgggatgcctcaagccccttccgcctatgatccttatgtttatccagatcaggcgaagaaaagacgagatactgttttgtatacgatgcttcaaaacgaaaaaatctctcaaacagaatatgatcaagctgttaatgtaccggtaacggatggtctgcaagaactaactcaatccgatgacaatactaagatcgtcgataattatgtcaaagaagtcatcaatgaagtacaagaaaaaacagataagaatgtctacacagacggtttagagatttatacgaatttggatctggacgcccaaaagaaactatatgatatcgtcaacacggatcagtatgtctcttacccagacgacgagatgcaagttgcctccacccttatcgacaccaataccgggaaagtaaaagcccagattggcggacgtcacatcgcagaagacgtaactttaggcaacaacttagcagtgaatacttcccgtgattttggttctacgatgaaacctgtcacagattacggaccagcttttgaatatttgaaatattctactggaaaaactattactgacgcaccgtataactatgaagggacttcgactcctgtaggaaactgggataatcaatatatgggcaccattactttacgccaagcactttacttatcccgtaatgttccagcagtcaaattattcaatgaagtcggttcagataaagtggcttctttcttaaaaaatcttgggatcgaatacagtacgatccatcaatcgaatgcgatctctagtaatacggaagaacaagatgggacaaaatacggagcttcttccttaaaaatggcagcagcctatgcggctttcgccaatggagggacttattacaaacctcaatatgttaataaaatcgtcttccaagacggaacagaagaaacttatgagccagatggaaaaacagccatgtctccagaaacagcttatatgatcacagacattttaaaagatacgatcactgaaggaactggtacgaatgcgcaaatcgctgggttatatcaagccggtaagaccggaacatccaattacacagatgacgagtatgcaaaacttggtatttcttctggggtgtatccagatatcctatttgcgggctatacgccaaattattcgatttccgtgtggacaggttacaataaaaaaatgacacctgtcacttcagaatcgtcacacgtagcctctgatgtttatcgcgagcttatgcagtatgtttcagctaacgtgacaaatacagactgggagatgccaagcggattaattcgtgtgggcggtgaactgtactacaaagatcaatatacagctagatcgaatgcaattacaccatcaacaactattccatcttccagctatgtccagactcctggaagctcaacaacagagacaacgactcaaagctctagctctactagtcaaagcgaatcaactgctgagtcctcaaaagaaagcacgacagcagaaacaagcgagccagcgtcttcaacaacggttccttcttcttcatccgaagaaagctcgacaccgtcttcatctgctcctcctgcttcttccagtgagccagcaactagcggagcggatgctgcaaatgaccatacaccatccagcagcacctcagcttctggaaacagatag

SEQ ID NO: 2014 - DNA (genomic), 1173 bp, Enterococcus faecium; double-stranded, circular
  misc_feature (B) LOCATION 1...1173
  hypothetical: NO
  anti-sense: NO
ggagggggttttatgtatcacgttcatttgattgatgctattccagaacaagagatagaaaagttacaaggggaatatttcaaaataatagatgatttgccagccgaaggaatagttattcgtagtacgaaagtgaaagatgaatggcttacaccagatttgctagcaatttcaagagctggtgttggggtgaacacgatcaacgttgaaaaagcttctgaaaacgggacgatcgtcatgaatacaccaggtgtaaatgctaatgcagtaaaagagcttgttttgtgctgtttgctcttatcttcccgtccgataatcgaagcaagtcgtatggtacaaacactaacaggtcctaatattttagaacaggcagaaaacaaaagaagtgcttatgtgggacgagaattgcaaggcaaaaccatcggtcttcttggtcttggagcgataggcacaaaagtagcgctaagttgctatagcttagggatggatgtcttgggttattctatccgcgatgcccagttggattatgttcggcaagcagatttagaaacagttctttctacctcggattacatcgtagtcatgctgccgttgacagaagatacaaaaggattgatcgatcaggcgaatatagaaaaaatgaaaaaagatgctgtacttatcaatgtaggaagaagtgaaattgttgataaatatgctgttatgcaagcattggaaaaacaacatctggctaaatacttgactgattttccagaagaagagttcttagaaaatgaccgtatacttatgttgcctcatctagggggatcgactcaggaagctttggcagacagcggacgtttggcagttgaagccttaaaagattatcttttgttcggtacggttagagaagcggtcaattatccatccgcacgaatgtttttccaagcgccgtttcgattcactatattttatcaaaagaaaaccaatatattagcagagatattttctctgctgaatgagaacgagctagcgatcgcagatatatcgcgtaaccataagaatgagcatgtctacatattgattgacatagacagtactgattttgaacagctcaatcaagtgaaacaacagctagaaaaaatttctggagtacgaaaggtccgcttattaaagaaaccagaaaggccataa

SEQ ID NO: 2015 - DNA (genomic), 651 bp, Enterococcus faecium; double-stranded, circular
  misc_feature (B) LOCATION 1...651
  hypothetical: NO
  anti-sense: NO
gttcaaaaactagcttttctcaacaaatattacataaaaaattctatgttttttgttaaatttatttgcttttttcaaaagtatgttacagtaatttcccaaggaggttttacagaaatgaattttgttgccatggattttgaaactgccaatcatcagccttatagtgcttgttctcttgcgctagtcatggtaaaaaatagccagatcgttgatgaattctatacattgatacagcctgagactccttttttctggcgaaatgtccaaattcacggaatccatcaagaagacatacgcaatgcgccgaaattcccagaagtctggcaaactatccaaccatattttcaaaaaaatcgtttagtcgttgcacataatgctgcttttgatacaaaggtcttagcgggatgcttagattattatcatcttgaacagcctaattatctttctttatgtacagtgaaaagtagccgtcgcctgtttcctgaatttccaaatcatcgattgaacactgtgtgcgaaaatttgaacatccaattagatcatcaccatgatgcattggaagatagtcgtgcatgtgcggaaatcctgctttatcaagaaaaaaaattcgggacagatccattgaaaaaacttgtgactataaagtaa

SEQ ID NO: 2016 - DNA (genomic), 783 bp, Enterococcus faecium; double-stranded, circular
  misc_feature (B) LOCATION 1...783
  hypothetical: NO
  anti-sense: NO
attattttttgtttgaaccagacaagcaaaaagccgatcaaagctcccccaatactagaaactactagactcatccccgcgtttactgctgaaaaagatccggtgatcagcgcaccaagagcaaactggaaggcagtaacaccagatgcatcattcaaaagaccttctccttccaaaatatgcatcgcctttttagggatattcactcgtccagaaagagaactgactgctaccgcatctgtcggacctaacgctgctccaaaagcaaagcaggcagcaagtgggacacttggcaacaggaatgataacgtcgcacctaccccgacaagggtcaaaatgactcctccaaatgccaagaacaaaattgtcccgaaatttttgagaatcgaagaaatatctgctttttctccttctctaaataacaatggtgcaataatcataactaagaacaattcaggttcaaaatcgattgattgtccccactctgtcagacctaataccactccaaggaaaatttggatcagtggagctggaatcattggcaaaatgcggctagctatgttcgataaggtgatcgttactgcaaatacaataactaactcagcaaattccatcgtccatcccctttattttttattttgtgtaagcatttttaaaaattgttcttttttctttaaaattttggtttcgactacttcaacctgtgtttggttcccctctaattcacactgtacacgttttgactccaaacgaagcagatcatgtttcagacgttccaactga

SEQ ID NO: 2017 - DNA (genomic), 219 bp, Enterococcus faecium; double-stranded, circular
  misc_feature (B) LOCATION 1...219
  hypothetical: NO
  anti-sense: NO
tttgttttttggtggttggcaattgatctcccattatttccaacaacagatcgtcgaacagcaagaaagctacctgacaaaaaaagcacaactactgatccggcaattagatgtcgaaaacctccaagcagcgcaaaacaaaactgctttggaagaattcgtccatcagtcgaacgaacggatcactttaatggatgctactggaaaaatcttatttga

SEQ ID NO: 2018 - DNA (genomic), 1449 bp, Enterococcus faecium; double-stranded, circular
  misc_feature (B) LOCATION 1...1449
  hypothetical: NO
  anti-sense: NO
aaaaatttttgtacactgaacaatcagtggaagatgattgccgaaaagcagcggaaaatttttcagctgaaaatatggggaaatcctattaccaattatacgaaaggattattaaatttaaagctgatgaatagaataattaattttatcataatcctattttttgtatctaacgttttcttgttactgacggtgccgacatcattttttgtaagtataagttttttattatttttagtgattttaattgttggttttgttcgagaattaatcacgagtaaaatacgtttatctttgtttatatatatatttggttatttttttatgtatttgtcaccaataatgcaactacaatatggtagttttccaaattttatcatgtacaatacagataaaattctaaaaacaaatataatcatatgtgtattctattttctatatcttataacagatattttcacacgtaaaaataatgcaaaacaaaaagatacatctttccaaaatttgaaatttaattataaaatgcaacagtattattttgtatttaccctaatctttagtataattactttttttatgttcaggtttgaatactttactacgcgttatacttattcaaatttaattactaatagctcattatatttgattttttttagtgctactaaaggtatcgcaactgccagtttgattatggaagctcaaaaatttttaactcatcataaaaatatacggcgtttactagttagttcttttctttttatttataatgtaaatccttttaatgtaagtcgttattatataagctatgtggtaattttgtttatgttaattttttttacaaaaaagattaaggtaaatcagatgttaattttacttattctaggaatgttttttatatttcctttattaaatttttttagaaatggattaacttttgttgatttttctagttatatcaacctaattcgtgaacaatttgtatcattacattttgatagttattctcaattagttgctgatttatattatgtggatataaacgggtatacgaatgggtggcaattcctatctgcccttttcttttttattcctagagcaattttcccaggaaaaagtgagggatctggggctttaattgggcaatttttaaatgaaaatactggtttttattatatagcacgaggtttttcgaatgtttcaaatccttttattggagaaatatttttaaattttggttttataggtgttgtgttcgtaccgattctacttgtttattttatgaaatgggtcgaatataaaaatgaatttatttatatgattatttgttcctatgctatatttatcatgcgtggagattttatgtcttcatttgcttacgctataggttcaattgtttttatttcaattattccacaaataaaatacgaaaggaataaacaaaaatga

SEQ ID NO: 2019 - DNA (genomic), 1221 bp, Enterococcus faecium; double-stranded, circular
  misc_feature (B) LOCATION 1...1221
  hypothetical: NO
  anti-sense: NO
agaaatttttggtgtagatctttaccaagcagagcttggcagaaaaatagaagaaatgttcatcaagatggtagcaggaccgaatgccgtacgaaaaacattacaggattacttacaagaacatggaggaaatttatcatggaaatgacttttagatggtacggatcacaggaagaaaagattaccttagatgaaatcagacagattcctgcggtcaaagggattgtaggcacattgatggatataccagtaggagaggtatggcctagggagaggatcaaagaactaaaagaagaaattgagtctcgtgggttaacactaaaagtaattgaaagcgtcaatgtgcatgatgccattaaaattggattaccttcccgtgagcagtatatcgaaaactataagcagacaatccgaaacttggcagaatatggaatagaagtcatctgctataattttatgcctgtatttgactgggtgaaatctgaccttgactaccgcttagaagacggctcatccacgttagcttttatatctgatgatattccagatgatccaagagaaatcgtcgcgcgcatcgaacattccagcaatgaatttgaattgccgggatgggaacctgagcgcttagctcatatcaaatccttgcttgaagcctatgcatcagtagacgaagaaaaacttcgagaaaattttgcctattttctccaatcaatcatcccaacatgtgaagaggtaggggtcaaaatggctgtacatccagatgatccgccatactcgatttttggattacctcgaatcgtaaagaatcgagaagatttagattggttgtgccgcatagtagacagcccttataacggaatcactctttgtacagggagtattgcagaagatccagaaaatgatgtatatgggattttagcagaattttgtcaaagagatcgaatcccatttgcacatgttcgaaatattaaatttttagctaatcgagatttctatgaggcaccgcataaatccgaatacggttcattagacatgtaccgcatactaaaaacaatgtatgacaacggatttaacggatacatccgtcctgatcatggaagaatgatctggaatgagacaggaagaccaggatacggcttatatgatcgagcattaggtgctgtttatctaaatggattatgggaagcaatcgaaaaaggaaacaaaagtaaagataattag

SEQ ID NO: 2020 - DNA (genomic), 255 bp, Enterococcus faecium; double-stranded, circular
  misc_feature (B) LOCATION 1...255
  hypothetical: NO
  anti-sense: NO
aagagtttttggattatgttagtatgcaacagtaagggagttcttattatgaaaaattttgacacatattatgttattgttttttcgatatctttgctgttaatattactaactttaatgcagtataaagagtatccagagtattttattttaacttttgtatatttagtaagtagctacacacttctatataaattcagaagttcttctagagtttctaaagtttgtttcttaattagcttattgattctataa

SEQ ID NO: 2021 - DNA (genomic), 1164 bp, Enterococcus faecium; double-stranded, circular
  misc_feature (B) LOCATION 1...1164
  hypothetical: NO
  anti-sense: NO
atcctcttttgcatgtcttggatagattttattcaaggcatgtatttttttggaggtgtaaaaatgagcgatacagaatacatgaaattagcaataaaactggcaaaaaaaggtgctggctatgtcaatcctaatcctatggttggggcagtaattgtaaaagataatcgaattataggacagggataccatgaaatctttggtggattgcatgcagagagaaatgcattaaaaaattgtagggagtcacctgtaggagcaacactttatgtaacacttgaaccatgctgtcactatggtaagacaccaccttgcacagaagcaattattaaaagtggcattacaagagtagtcgtcggaactttagactgtaatcctattgtgtctggaaaaggtgtaaaggtacttgaggaaaacaacattcaagttgtgataggaattttagaaatggagtgtcaacagttaatcaaagtttttagaaaatatgttacaaggcatattccttatgtttttatgaaatatgcaatgacaatggacgggaaaatagcaacttatacaaatcaatcaaaatggataagtggcgaaaaagcgagaaaacaagtacatcaattcaggcataaggttactgcgatcatggtaggagtgaataccgttattcaagatgaccctttactgacatgccgattagaaaacggggaaaatcctattcgtatcgtatgtgatacagatttaagaacacccattacatcaaaaattatcaaaacagcgaatgacattaaaacatatatcgctacttcttctattgatgaaagtaagattgctctttacagaaaatgtggttgtgaaattatttatacgaagaaaaaaggtaatcatattgacttaatgaatttaatgcaatgtttaggaaatatgcagatagacagtctacttttagagggtggaaatgcaatgaattggagtgctcttgagcaacagattgttgatgaggtgcaaatttatatagcacctaaaatatttggtgggagtgcaaaaagccctgtaagtggtcaaggtgttgcttttcctaatgacgccattatgcttaaaccatatgctttttctcaagtgggaaatgattatttcatagaaagcgaagtgatttatccatgtttacaggaataa

SEQ ID NO: 2022 - DNA (genomic), 1077 bp, Enterococcus faecium; double-stranded, circular
  misc_feature (B) LOCATION 1...1077
  hypothetical: NO
  anti-sense: NO
aacaccttttggattagtcattgcattgattggcgttccgtttttactgatacaagtaaggagggaacgacggtgaaaataatatattggacgttgtatttcttgctttttctacttatcgtcttgtctgtaggtagtttgatgattggcacgccttttatttatcttgatcagctttttgacacgttcatagggaaaggctcctcttctttggcgctgattgttggagagtttcgagttccccgattactgatcagtttattaacaagagcttgtcttggcgtttctggctatatcttgcaaggagtgacgagaaatgaattgacagattctagcatattggggattaatgcgggagctggatttctagtgatgctttatttaggtttcttttcacaatattctctgccgtttctgttgctagttgtagcctttataggtggtattctcgctgcttgctgtgtgtatcttgcggcctatgatcgaaatggatttttagggatgaatcgtatcttattgtctggtattgccgttaatgctggtctttctgcattaacgttgttgtgcaccatccaattgtcaaaggaaaattatggatttgtcaatgcatggttggcgggatcgatttggggtgcgagctggtcctatgtttgggcgcttcttccatgggcgattatcttgattccgctaggaggattttatgcgcaacggattggcttgctatcatttggccaagaacgcgcgcaaggattagggctaaatgtgaataaaagtcaaaaaatccttttgttgttagctgttgctttagcaagcggtagcgtagcggtgacagggaatttatcctttgtaggactactggctcctcatgctgcgaagctagtcgtacgtaaagaaaatcattggacctttattttgagcagtttgttcggttccgtttttgtacttagcgcagatattgttgcacgagtgattctaccaagtggggaaataccgacagggattttgatcgccttttttggtgcgccatattttctgtatgtattgtttatcagacaaaaacacgtgctgagcagttga

SEQ ID NO: 2023 - DNA (genomic), 1317 bp, Enterococcus faecium; double-stranded, circular
  misc_feature (B) LOCATION 1...1317
  hypothetical: NO
  anti-sense: NO
tctaacttttggggtgcacatcaaaacatgggcgttatcaattttatcatcgaaaatattttgactcaggcatcgatcaccattgcattgattgctatgttgggtctactactgcagaagaaatcagcaggacaagtcatctctggcacgttaaagacactcctaggatttcaagtgttgagtgccggttcgagcatcatcgttggaagtttaacttatttcgggaaaatctttactgaaggatttcatatgcaagggatcatcccttctattgaatctatcaatggtcaagcaatgaatgatttgggtttaggtagagatattgcactgacgttcttagccatttttgtattcaatattattttggctcgtttcacaaaatggaagtacatttttttaactggtcaagcaattttatggatggcaacgatgacgacagtctttggctattttgccggtctgcgagggatcgtattgatcttggtcggtggttttatcggagcttgtttcgccattgctatgccggcagtagcgcaaccgatcattcgtaaaatcactggatcaaatgatattgctttaggtcatttttgtacgatcgggtacttatttgaagccggtgttgctaagctttttggtgagaaaggcgaaaataaaaagtcgatcgaagatatcaagttgccgacacatttcgaatttctgcaagatacttatttgtctgtcatggtcgtgatggtcccgctatatatcatcactgttttatttgcaggcgaaccattcgcttctgaattatcaggagatcaaaactatatcatgtttgcctttttacaagccatccaattcgtagtgggtgtgtatgtattgctagctggtgtacgtctactgttaggtgaaatcgtgccggcatttcgagggatagctatgaaattagttcctgatgcgatccctgccttagattgtccagttttctttccttatagcccaaatgctgtcattttaggtttcattacgacaacgattggtacgattattgccatgtttactttgcccatgttcggcttagcgatgattttacctggtatgctaaccaatttctttgccggagggacagcagggatatttggcaacgcagttggcggacgccgaggagcgatcattggcggtattgctcatggtttctttattacattattgcccgctttgctagtaacgatctttaattcgatgggattcaacaatgctacagcaaccgatgtagatacagtagccgcagcactcttatatgcctggatcttaagcccagttttgaaagcattttaa

SEQ ID NO: 2024 - DNA (genomic), 1752 bp, Enterococcus faecium; double-stranded, circular
  misc_feature (B) LOCATION 1...1752
  hypothetical: NO
  anti-sense: NO
aggaacttttgtaaaatgagaaaaaaaatcaaagagcatgaactctttgccaaacttctgttcattttgttcatcggtctttttctgcaagccatcgtcatttctttgtttatttatcatcgatcaagggatgcctatatccagctgttcaatcaatcgaatgatgtggtactaaaaaagattcaatctgaatttgaaagtttgaatgatacaatcgagaatacattagccgcttttgattctaatccagctgtcaaaagctatttttccaatgatccagcccaacatatggaacagcttcagcaactaagaacaatccaaaaaatgaatgactctctttcaaaaatccatccaatgatcgattacgatgtattgatctttggagaaaatggaagaacttttgtcggaaacgacatgctcactgccgtatctgccgattctttttttcaatctgcgattgctcagagagtgaatgaacgtgctgctgatacacaaatgctttttgcacaccacggattgactcttcgcgataagaaagcacccagcgtcttctttgtcaaaaaactgaaaaatacattgaatcacgtttacggatatgctgttttatcgatctcatccaagcaactagcgaatctttttcaatctgtagtaaatcctgagatatcgaagatctccttcatgaacgaagaacagacgatcatcgcatcaaatgaagaaaatacaattgggagccgatcaatgattttcaaaaaactaacagtaggtgaaacaacgatttcaaatggacagcagttgacccgtcttcctctgtaccgccaggattgtacattactcagtcaagtcgatcttcattctttatctaaccaaatgggcgtgatttttccgattattttgtataatatcgtgacacttgcttttgctggctcattggtatttatgtatttggatcgacacacaaaatcgatctaccgcttgattgattcgctaaaacggctagaggaagatggcttaaaagctactgttcctgtacaaggaagccatgaagtccaattgctagggaatacgatcaatcaattgctaagtaatgctcagcatcattatgaacagacgatccaagacgaaaagaagaaacgttcgcttgaaatccaaactatgcaagcacagatacagccccattttatttataatacgctgactagcttgaaatttttgatttggcagaaaaaaacagatgaagcagttcaaggaatcgacagtttcattactttactaagaagtacgattgggaaaaaagaagaagtgattccagtcaaggaagaaatcaaaagcgtacaaagttacatcgatcttttgagtatgcgatatggcgaaagaatctcggctaaaataatgattcctgatgaactgcagtcattatctatgccgaatatgatccttcaaccaattatcgaaaacgcctatcttcatgcttttcacaataaaacgcaaggattcatcacggtgtacggcaaaacaaaaaatcagcttcttttattcgaagtgattgataacggcgatggcttcgatactgaaaataccaaacaaaaaaatgatcatttttcaggaatcggcatcagccatgtagatgagcggatacgcctaatgtatggcgatgcatatggcttaacgatccaatcagtgattgggacaggaacgactgtaacgatttgtctaccgcttcttcctaaaaatcaatcagaatatcaaaaataa

SEQ ID NO: 2025 - DNA (genomic), 1017 bp, Enterococcus faecium; double-stranded, circular
  misc_feature (B) LOCATION 1...1017
  hypothetical: NO
  anti-sense: NO
tccagaaaactttttttttttttctttaacaggcggtcatatggaaacacaagaaatgagaaatatttggaaacaattcataagggagcatttatgaggatgaaagacaaactgataattggaaagaatgctatagataccccgacggattttgaaactatccaagaaggaatcgattatttggcaggcctgccggatagccatccaaaggtcttgatagtaaaagaaggaagatatgatgaatatatagaaagcagattatccaattttaaacttgtgggagcaggaacagtagttatctccggtaatcgttttgcaaaacaggagtatcttgacggtagccagttagggactttccgaagtgctacttttttcttagaaggatcgaatgtcgtattagaaaatcttcacatcgaaaatacagcaggtccaggagaaaaggtaggacaggctgttgctttattcaattcaggagatcgcgtatctttaaaaaactgtcgactatctggttatcaggataccttatgcacgggtccgttgcctgatttgcaaaaagatggtactcctttttgtacaccggcttctgccaatcctgagtattgtcgtcagacctatgaatattgctggattgaaggaacggtggatttcatatttggtggggcagatgccgtttttcatcagtgtcatatccatagcttagccagtaaaaatcctggatacatcacagcagcatctacgccgaaaaatcaaaaaacagggtatcgttttgaaagctgtaccttgactgcagaacctgatactagaaacgtctatttaggaagaccgtggcgtccgtatgcaaatgtcttatttgaagcgtgtaagataggtgggcatgttcacccaactggttgggataattgggatgacaagaaaaatgaacagactgtcaaattctctgaacgtaataacaattatgaaacatcgatcaaaagacctgaatggatacatttagaaaagcagggggttcagaaatga

SEQ ID NO: 2026 - DNA (genomic), 651 bp, Enterococcus faecium; double-stranded, circular
  misc_feature (B) LOCATION 1...651
  hypothetical: NO
  anti-sense: NO
aagtcattttggcttttgcgacagccgcttgctttattcatcaccttgttaaggagagagaccatgaaagtccatcaagctgaaattatcataagtgcagtggcaccaaaacaatatccagatacacaattgccagaaatagctctggcaggacgatcaaatgtagggaaatcttcttttatcaacacattgattgatcgaaagaatttagcccgtacttccggtaagccaggaaagacccagacattgaatttttatttgatcgagaacgcattacattttgtcgatgttccgggatatgggtatgcaaaagtatccaaaactgagcgagcaaaatggggaaagatgatcgagacatatttaacgactagagaccagctacgtgcggtcgtttctttagtagatttgcgtcataagccttctcaagaagatatccagatgtatcaatttttgaagtattatgatatccctgtaattgttgttgccactaaggcagataagatccctcgtggtaaatggaacaagcatgagagcgaaatcaaaaaagcgttggattttgatcgcaatgacacgtttattctcttttcttccgttacaaaacagggaaaagaagaagcgtgggcagcaatcgaacaagcaattgaatcataa

SEQ ID NO: 2027 - DNA (genomic), 390 bp, Enterococcus faecium; double-stranded, circular
  misc_feature (B) LOCATION 1...390
  hypothetical: NO
  anti-sense: NO
cttatgttttgtaaggattatgctatactctgggaagaggtgagtatgatggagctaacacagacagaattcgttttatgccctaaatttgaaaaaacattctctattttaggaaaaaaatggaacggattgattatcgatgtactactcgaaaacggtccgcaacgctttgttgagcttgcggcaaaaatcccgatggtcagtgatcgagtattagtcgaacgcttgaaggaattagaaaaagaaggaatagtcactcgaaactttgcctgtagcgaaaagagccgttcagaatatctcttgactgaaaaaggagcagacttgcaaaaagcgatgcgtcaaatacaagtttggagcgaaaaatggatcacagaggaagaatgcggttga

SEQ ID NO: 2028 - DNA (genomic), 810 bp, Enterococcus faecium; double-stranded, circular
  misc_feature (B) LOCATION 1...810
  hypothetical: NO
  anti-sense: NO
gagaagttttgtaagaaaggaagaacctcaatgattgtacaagcagtcttattaggaattgttgcatttgtcgcacaatcagaatatgcactagggacatcgttgctttctcgtccgattgtgacggggctgtttacaggaatcgtgttaggtgatgtaaaaactgggatcattatgggcgcaactttagagttagcatttatcggatcgttctcagtaggtgcttcgattccacctgatgttgtgaccggtgggattttagggacggcttttgctattacagctggagccggtacagaaaccgcgcttttactaggtttgccgattgctacgttgacattgatattgaaaaatatttacttagggcttttgattccaattatgaaccataaagcaaacaattatgcagaagaaggaaattataaaggagtcgagcatatgcacttgcttgccggtatcggtctttccttgatgcttggtgttgtggtaatggtttcttatatggtgggaagcaatacgatcggaaatctattaaatatgattcctgacttcgttcaaaaggggttgtcagtagctacagggttgattccagctcttggttttgcgatgcttgctcgtttgctgatcaacaaacaagttgcaccatattttttcttaggttttgctatagcttcttacttagagattcctgtgaccggagtagctatttttggtgcgattttagcagttgtggtagtcaatattatgaatgtccgtcaactaccacttcaaacaactgcaggggaggtagaagaagatgaagaattctga

SEQ ID NO: 2029 - DNA (genomic), 804 bp, Enterococcus faecium; double-stranded, circular
  misc_feature (B) LOCATION 1...804
  hypothetical: NO
  anti-sense: NO
tcgaatctttgctgcaggcgcagtagaagcagcggactggttgaaagatcagtcaccaggttattacaaattagaagatttattaatggacaaaggggtgtaaaaaacgtggaagctcaagaaatcatccgctacattcaaacggcatctaaaaagacgcctgtgaaagtctatctgaatgtaaccgagccaatcgaatttaaagaaagtaaagtttttggtgaaggaagcagcttcgttgtttttggtgactatgagacgattgctccggttttagaagctgaatcagaaaaaatcattgaaatcgaaatcgaaactgctgcaagatacagcgcagttcctttgctagatattaaaaaaattaatgctcgtatcgaaccaggtgctattatcagagatcaagtgtcaatcggcaacaatgccgtgatcatgatgggagcgattatcaatattggtgcagtaatcggtgaaaacacgatgattgatatgggtgctgtcttaggtggacgagcgacagtgggcaaaaactgccatattggtgcaggagctgtcttagcaggtgtgatcgaaccagcatcggccaaaccggttatcgtagaagacggcgtactggtaggtgcgaatgcagtgattgttgaaggtgtccatatcggaaaagatgcagtcgtggcagcaggagcagtggttttagaagatgtggcagcagaaactgttgtcggtggaatacctgcacgtgtattaaaaataagtgatgatcagacaaaagaaaatacagcattgattgctgcgttacgcgaattatag

SEQ ID NO: 2030 - DNA (genomic), 939 bp, Enterococcus faecium; double-stranded, circular
  misc_feature (B) LOCATION 1...939
  hypothetical: NO
  anti-sense: NO
tttatgaaactttggatgaaaatccttttaggcgtcgctttagctctgattgttgcgttagtgtttgcagggaattatttttataattatgctgttgtgccttctgagaaagactttttagacgaagatacacctggtacaacacagacatccaaagaaacggatgcacataaatggtttagttcaaaagaaaaccgaagcgattggaccatcacttcaaaagacggtctgaaattatcagcgatttatcttcctgctgaaacgaaaagtgaaaaaacagctcttgtggctcatggctatatgggaaacgctgaaacgatgaccaattacgcaaagatgtttcatgatatgggttacaatgtccttgttcctgatgcaagaggacatggaaaaagcgaaggggattacattggatttggatggccagagcgtaaagactatgtacagtggataaacaaagtgctagaaaacaatggaaaatcgcaagaaatcgttctatacggtgtcagcatgggagcagcaacagttatgatgactagcggagaaaaactaccagataatgtgaaagcaatcattgaagattgcggttattcttccgttcatgatgagcttgcttatcagctagacgatatgtttagtcttccagcatttccgcttatgcaagtaacgagtctagtgacaaaagtccgtgctggctactttttcggtgaagcaaatgcagtggaacaattgaagaaaaaccagcgcccaatgctctttatacatggagacgaagatacatttgtaccatttgaaatgttagataaggtctatcgtgcaacgaagggaccaaaagaaaagtatgttgtaaaaggagccgagcatgcggaagcatacaagacagatcctgaaaaatatcagcaagtagtccaacaatttttaagccaatatgttcattga

SEQ ID NO: 2031 - DNA (genomic), 2097 bp, Enterococcus faecium; double-stranded, circular
  misc_feature (B) LOCATION 1...2097
  hypothetical: NO
  anti-sense: NO
gacggcctttggactttggtaaatatggttgctccaggagcttatgaagagcgttgggcaaaatggtctttagaaaatttgcctattttcccagaaaccttccgttacgaagttccaatggacaaacgtgcacaattttcgatcgtaaaacgagaattgcagtcagccgataccatcattattgcaacagatggtgatcgagaaggtgaagccatcgcgtggtcgattattcgacaagcaaacgcattttctaaggaaaagaactatttacgtttatggatcaattctcttgaaaaagaagcaatctatgaaggttttaagaatctccaacctggaaagaactattttccaaaatataaagaagcgcaagcaaggcagaacgctgattggctgattggaatgaatggaagtccattatatagcttgctacttcaacgaaaagggattgatggcagtttttctcttggtcgtgtacaaacaccgacactctatatgatttatcagctgcaagaagaaatcaaacacttcaaaaaagaaacgtactttgaaggagaaggtttaattacgacaaacaaagggcagttttctggaaaaatcgtaccaaaaaaagcatttaaaacccaagaagagttaacgaaggaaatagaaaaacttggagcgcatttaggtaagcaaaacggacggattcttgaagttacgaaaaaggaaaagaggttgcatagtccacgtttattttcgctatctagtttgcagacaaagatgaatcagctaatgaaagcaagtgccaaagctacacttgatgctgctcaaggattgtacgaaagcaagtttctaagctatccaagaacggattccttttacattacagaaaatgagcatcagtatctggttaaacatctgcaaaattataaaaaatttttaggaatagaagaagtacagacaactgagatcaaagcaaagaaacgatatgtcgatgcgaaaaaagttcaagaacatcatgcaattattccgacaaagacgattccgactcctgcacgctttgcgaagctttccaaattacagcaagcaatctatttgcaagttttgcgcactactgtggctatgtttgctgcagattatatctacgaagagacgaccgtaatgacgggcgtacagcaattaaagctaaaaagcatcggaaagatcccattacagcaaggttggcaggaaatcttacgcatcaagtcaaaaaagaaagaagctcagactcttcctcctatcgtagaaaatgaagaagcagaagtagaactgaaaagtatggagaaagaaacacaacctccaaaaccctataccgaaggaacgttgatcacagcaatgaaaactgcgggaaaaacgctggataatgatgaagcgcaagaaattctcaaagaagtagaaggaatagggacagaagctacacgagccaatatcattgaaaatcttaagcagaagcattacatcgaagtcaataaaaacgaaataactgttacgccaaaaggaatcactctttgtaaggcagtagccaatgaaccattactgacgagcgcagaaatgactgcgcgctgggaagggtacttgagaaaaattggtaaacaagaggggacaccatctgtttttttagagaatatcaaaaaattcatcctacatttattggcagaagttcctaatcaaatcgacaaggtagacttttcagatgagattagcgggacacgtcagataaaagcgatggagaagaaaaacgatcaattaggaagatgtccaaaatgtaaaaagggaatagtcatgctttatcctaaaatcgctacatgcttgaatccggaatgcgacttcaaattgtggccaacagtagctaaaaagaagctgactaaaacgaatctcagagatttgctttcaaaaggaaagacaagtaaagttgtcaaaggttttactggtaaaaaagggaaattcgatgcagttttagtattaaaagaagatatgacaatcggtttttcttttccatggatcgaaaacagtggaacaaaagcagttgatggaaacaaagaaacatcaagaaaaaataatgaaaacgaagtagagtaa

SEQ ID NO: 2032 - DNA (genomic), 216 bp, Enterococcus faecium; double-stranded, circular
  misc_feature (B) LOCATION 1...216
  hypothetical: NO
  anti-sense: NO
tactcgaaactaagcgactttttcacaacctctgataaacggtgttcaaaagccagtttctcggtattaagccaaatttatgcaaaaatgtggaaagccattttcacaaaatttttcttaatactcgaaactaagcgactttttcacaacctcctgataaacggtgttcaaaagcttgcatctgcggtaataagcccaaccaaacgaaaaatataa

SEQ ID NO: 2033 - DNA (genomic), 2238 bp, Enterococcus faecium; double-stranded, circular
  misc_feature (B) LOCATION 1...2238
  hypothetical: NO
  anti-sense: NO
ttcatgctttgtcaaaactgcggcaagaatgaggcaacgattcacttgtatgccactgtcaatggtcagcggacacaactcgattactgtcagagctgttatcaaaaaatcaaaaatcaacaaaatggaggtctgactaatatggcccaaaatgatccatttggatttggcagtttggacgatcttttccgttccatgtctcgccaaatgcaacagcaaggaaattatgagcaaacaccaccaacacaatttggcggaaacaacaacttcaatggtggtcagccacctcaaggcaatacagaaggtttattgggagaatacggaatcaatatcacagaacaagcacgacaaggtgatatcgatcctgtgatcggacgcgatgacgaaatcaaacgagtcattgaaattttaaatcgccgaaccaagaacaatcctgtcttgattggagaaccaggtgttggtaaaacagcagttgttgaaggtttagcacaaaaaatcgtagatggtgatgtaccgcaaaaattaatggacaaagaagtcattcgtttagatgtcgtatctttagtccaaggtactggtatacgaggacaatttgaagaacgtatgcaaaaattgattgaagagatccgtcaagcagaaaatgtgatcctattcatagatgaagttcacgaaatcgtcggtgctggttctgctggtgatggaaatatggatgctggtaatattttaaaaccagctttagctcgaggagaattgcaaatggttggtgctactaccttaaatgagtaccgcatcatcgaaaaagacgctgctttagaacgtcgtatgcaacctgtacgggtagatgaaccaactgtcgaagaaacgatcagtattttgaaaggtttgcaaaaacgttatgaagactatcatcatgtaaaatatactgatgaggccatcgaagcagccgcaactttatccaatcgttacgtccaagatcgcttcttgccggataaagccatcgatttgctagatgaaacaggttctaagaaaaacttgacgatccaaatcgttgatcctaaaacaatcgagaaaaaactgcaagaagcagaagaacaaaaagttttagcttctcgagaagaagatttcgaaaaagcagcttattatcgcgatcagatcaataaacttcaaaaaatgaaagaacgtcagctcactgaagaggaaacacctgtgattaccgaaaaagatatggaaaaaatcgttgaacaacggacaggtattccagtgggtgaattaaaagaaaaagaacagacacaactgaaaaacttagcagatgacttgaaagctcatgtcatcggacaagataacgctgtagatcgagtagcgaaagcgattcgccgaaaccgtgttggattaaacaaacagaatcgtccaatcggctccttcttatttgttggaccaactggtgtaggtaaaacagagcttgcgaaacaacttgcctacgaactattcggttcacaagattcaatgattcgtttcgatatgtctgaatatatggaaaaacatagtgtctctaaattgattggttctcctccaggttatgtcggatacgaagaagctggtcaattaacagaaaaagtacggagaaatccttacagtcttgtcttgttagatgaagtagaaaaagctcatccagatgttttgcatatgttcttgcaaatcttagatgatggtcgattgacagatgcacaaggaagaacggtcagctttaaagatacgatcatcattatgacaagtaatgccggaactggtaaagtagaagcaaacgttggttttggtgcggcacgcgaaggtgttactcgttctgtattgaaccaattaaacaactactttacaccagaatttctgaaccgttttgacgggatcatcgaattcagtgcattatcaaaagaaaacttgatgacaatcgtcacactaatgctagacgatgtcaaccaaatgctggcagcacagcaacttcacatcgaagttcctacgaatgtcaaagaaaaattagttgacttaggctatgatccatctatgggtgctcgtcctcttcgacgcacgatccaagaacaaatcgaagatggtatcgctgaattttatcttgatcacccttctatccatgagttgaaagcaaaactggataaagatggaaaaatcatcgttacttctaaaccagaacgtttggctaaagaatcagccgaagaaacggctgaataa

SEQ ID NO: 2034 - DNA (genomic), 327 bp, Enterococcus faecium; double-stranded, circular
  misc_feature (B) LOCATION 1...327
  hypothetical: NO
  anti-sense: NO
agagttatttggaaaatgaatacagttaatcggcaaaaagccatgaatctcatcggtctagcgatgcgcgcgggaaaactaatcacgggtgaagaactgaccattgctgaaatccgcaaacaaaaagcaaaattggtgtttgtggcaaccgatgcaagcgagaatacaagaaaaaagataaaagataagagttcatattatgaagttccttgctttgagctattttctgaagcagaaatcacgcagatgatcggaaaacctcgcaaggtattcggaataatggatgccggatttgcgaagaagaccaaggagctaattgaaggttag

SEQ ID NO: 2035 - DNA (genomic), 333 bp, Enterococcus faecium; double-stranded, circular
  misc_feature (B) LOCATION 1...333
  hypothetical: NO
  anti-sense: NO
ctggatatttgggccgatgtggaccttactgtatatattgatggtatttctctttatttgttacttaatcacaacaacaaaagacagcgaaacaatctggtcggtctttttgtgattcagttcatttttaattttatatggtctgctgtattttttaatttaagaaatattttcattgcagcaatcgatattacacttttagttattttcttgtcagtgcttatgtatcagttgtggctgcatcatcgcctggcaatgtggctcatgattccttattatttatgggtactattcgcaactctattgaattattcaatttattttttaaactaa

SEQ ID NO: 2036 - DNA (genomic), 531 bp, Enterococcus faecium; double-stranded, circular
  misc_feature (B) LOCATION 1...531
  hypothetical: NO
  anti-sense: NO
cgtgcaatttgcaatgatcttttcgatacagaacccctctcacacggcaataaaggcctgatccgttcattgcaccatcgaggaaaaacaagacatacaaaaaatcatgtcgagtctcgtggaaagatttgccttactcattcgatccatggccgtccaaaatccgcagatgatagaagtgattttggtcattggaaagccgatattgtagctggcaaaactggtggtacttgtttagtgactttgacagacagaaaatcatgcttccttttagcaggaaagaaggtccccagaaagaaagccgcttatgtgagcgagaaaatgattgaacttttaagcagtattccaaatgaggcggtcaaaacgatcactccagatagaggaaaagaattctccaatcatttcgcagttacagaagcattgaataatatgcccttttattttccagatcctcatgcccttggcaacaatgaacaaattaaaatacgaatagactcattcgagaatacttgccaaaatcgaaagagatag

SEQ ID NO: 2037 - DNA (genomic), 633 bp, Enterococcus faecium; double-stranded, circular
  misc_feature (B) LOCATION 1...633
  hypothetical: NO
  anti-sense: NO
cataaaatttgtggtggaggtacgtatgagatgaaagataaagttgtgaacaaattattagaagccttattcagcggagacaaatcggaagaagatatggtgtatgtccaagtaaaatttgtcttagaagttttattgaataatcttggaaaactagcggtcgttctagtcttttctctggtgacaggctcatgggcggaaacaggaatcacctttctttcttatatctgcatccgcagatatgcttatggattgcattccgactctgaattcgtttgtctgctgtggacactactttatttatggggcgttcccttggtgatgaaacatctgcaattgactatctccttcccaatgatggtctttttgttaatcagctgctttttgttactgcttcgctatggatcaagaggtacagcaatcaatcccattgaacccgagaaacgtcccccattattaaagaaggcgatcagcatgtttctaattttttctctcattacgttatttttctcagcttcttacttttctacctatttgctacttgggattgttttagaaatagctacgttgcttcctattacaaactacttgatgaattttggaggaatctttcatgaaaaaaacaatcattaa

SEQ ID NO: 2038 - DNA (genomic), 417 bp, Enterococcus faecium; double-stranded, circular
  misc_feature (B) LOCATION 1...417
  hypothetical: NO
  anti-sense: NO
ctaaaaatttggataatgggttcgaggaggcacttgccgatggaagatgcaataaaacaaggtcagctttttttatcagaattaacagctgaagaacgttcctgtctatataatgatttgctgtcgatcaaagacgtttatttatgcaataaagatactagtttttatacattccgaaaaatccgccgagcaaccaagcgctgtgctgaatgccgtaaaaggacttttctttatcagacagaacacaaaggcgaactttcaatcagtcagattcatgaacagaagcgtttcaaaaatcattatcgtatccagatcttattcaatggacaagagatggaatacgcttttctcgaaaacttgctgcaacatctccataaccagcattttagttataatagccaagccatttacgcttaa

SEQ ID NO: 2039 - DNA (genomic), 1209 bp, Enterococcus faecium; double-stranded, circular
  misc_feature (B) LOCATION 1...1209
  hypothetical: NO
  anti-sense: NO
aacggaatttggaataggagtgattatttgagttatttattaggtattattggtttatttgtcacattagggcttgcttttttgatcagcagtaacaaaaaagcaatcaaattgaaaccactaattgtgatgttcgttttacagcttgttcttggtttcgtattattacgtacaacttttggtacagcggttgtttctgtattggcaaaaatgtttgatcatcttcttgcttttgctgggcaaggtgttgactttgtttttgccggtgtagcaaataaaggaagtgcacctttctttctttccgtattgatgccaattgtatttatttctgctattatcggtattctacgctatatcaagattcttccattatttatgaaagctgttggtctaggattaagtaaaatcaacgggatgggcaaattggaatcttataatggagtagcttctgctattttaggacaatcggaagtttttatttccataaaaaaggaattacccttcctatctgagaaacgtttgttcaccatgagtgtatcggctatgtctacagtttctatgtcgatcgtcggatcttatatggcactgatcgattctaaatatgtgatcactgcccttgttttgaacttatttggcggttatattctggcttcaattgtaaatccctatgtattagaagaaaaagaagatgagctgatcattgaagaaaacaaagaacagacatttttccaaatgttgggagaatacattcttgatggtttccatgtggcgatcacggttgctgctatgcttatcggttttgttgctttgattgccatgatcaatgctatcttccacgggatattcggcatcactttccaagagatcctaggttacatctttgcccctcttgccttcatcagcggaatcccatggaaagaagcagtggatgccggtagtatcatggcgactaaactggttacaaatgaatttgttgctatgacagaattagcaaatggtaatttccattttactgagcgtacaacagcaattatatctgtcttcctcgtttcatttgccaacttctcttctatcgggatcatttctggtgcgatgaagggattaaatgaagaaaaaggaaatcttgtcgcaaaacacggattgaaaattttgctaacagcgactttagtcagctttttaagtgctattgtgactggcttgctggtataa

SEQ ID NO: 2040 - DNA (genomic), 756 bp, Enterococcus faecium; double-stranded, circular
  misc_feature (B) LOCATION 1...756
  hypothetical: NO
  anti-sense: NO
tcaaggatttgtgaaaaaatcaatgaaaaccgaaaggcgtgtaaaattttgattaaatcagttgtgtttgatgttgatgatacgatgtatgatcagcagcagccatttcgaaacgcggtcaaaagagtcgttccgcttgtttcagatgcagatatgcatccactatatatccggttccgccatcatagtgatgaaaacttcccaaaagtaatggcaggagattggacactagaatatatgcgagcacatcggatcagccaatcactaaaagatttagactaccctcatattacggaagaagatggcctcttatttcaaaaaatttacgaggaagaacttgataatatctgcttgcatgaggaggtcaaaaaaaccctcgatttcttgaaggaaaagaatgtcccattaggaattatcacaaatgggccgactgaccatcagacaaaaaaactgaagcaacttcaattgaacaattggattccttcccgcaatatgctcatttctcaagcaacaggtttccaaaaaccagaaaaagagatttttcagctagctgagaaagaatttcatatgcttccagaagagaccttatacgttggcgataattacgacaatgatgttctaggtgcaaaaagtgctaactggcaagcgctttggttcaaccatcgagaacgcaaaattgaacagactccaatttgcgatatcgagatttcttcttttgatcagctgttagagacaatgaagacaatctttgtataa

SEQ ID NO: 2041 - DNA (genomic), 192 bp, Enterococcus faecium; double-stranded, circular
  misc_feature (B) LOCATION 1...192
  hypothetical: NO
  anti-sense: NO
tccatttcttgcattactaaaaacggcgatgacaaattttttttattttcgattatctttcctttggtagggcgaataatcttcatgagtattcttagtaaggttgttttccccacaccgtttttccctaccaaaccaataacatctccaactttgacatcaaaatttatgtcttttagaatattttcataa

SEQ ID NO: 2042 - DNA (genomic), 219 bp, Enterococcus faecium; double-stranded, circular
  misc_feature (B) LOCATION 1...219
  hypothetical: NO
  anti-sense: NO
ataagctcttgtttggtttgtgtaggaaaacaatccagagaaagtgtcactggttctcccgttttctctaattctttattgacgaaacttgaacaacgcagtgcagccggaccagaaataccgaaatgggtgaaaagtaaatccatcgtatgttcagtcaatacacggccttttttatttagaacacgtaaagtgatgtcctgtaaagaaagcccttga

SEQ ID NO: 2043 - DNA (genomic), 207 bp, Enterococcus faecium; double-stranded, circular
  misc_feature (B) LOCATION 1...207
  hypothetical: NO
  anti-sense: NO
ataagctcttgtttggtttgtgtaggaaaacaatccagagaaagtgtcactggttctcccgttttctctaattctttattgataatcggtgtagaaccagagggctctgtgttaaatggtggtgatccagcccctcacgaaattgagggtatcggtgtagaattcattccgccgttctttctcccctttcaatcaatcagtcattga

SEQ ID NO: 2044 - DNA (genomic), 213 bp, Enterococcus faecium; double-stranded, circular
  misc_feature (B) LOCATION 1...213
  hypothetical: NO
  anti-sense: NO
caaaaatcttgtcacagtcccttcttccgaacaaacggtgttctcctgccaactcctcggtcacaagtcacaatattcaacaaacatgagaagctgttttttgaacttgttccttgtgactcggagctggacggcaggctcacgacctctttcttaaacggtgttcaaaagcttgcatctgcggtaataagtccaaccaagttaaaaacataa

SEQ ID NO: 2045 - DNA (genomic), 1422 bp, Enterococcus faecium; double-stranded, circular
  misc_feature (B) LOCATION 1...1422
  hypothetical: NO
  anti-sense: NO
cgaagatcttgtcaaaagaataaaaatgattcaagggaggaactatcaatggataaattgttgaatttgtttgtgtcaatcgtcagtcagccctccatcctcgtttctttgattgcactgcttggtctcgttcttcagaagaagaaattttcagaagtgatccaaggaactatcaaaacatttgtcggattcctagtactgatcggcggtgctggtttaatcagtaattcactaaccccttttgcttcgatgttccaaacagctctgcatactcaaggagtagttcctagcaatgaagcagtagtggcgattgctttgcaacaatacggtacacctactgctttgatcatgctagtagggatgatcgtgaatattttacttgctagattcacaagatataaattcatttttcttacaggtcaagcaatgctttatgtttcttgtctaacagcagtcattttagtaagcgcggggtttactgcaaatttgtggatgatcttattaggcggggtcttcgaaggaacactattaactattacgcctgctctttgtcaaccgtttatgaagaacatcactggaaacaatcaagttgcgttagggcataccggaaatatcggttatgcttctagtggatggatcggaaagttttttggaaacaaagaccgttctacagaggacataaagattcctaaaagtttcagctttttgcgagattctactgtatcgatcatgctcttgatgtcgatcgtatatgtcgcacttgctttgttagctggtcctggatttgttgaaagagaactaagcaatggagacaacgctgtaatctttgcactgatccaagctggaacattcacagctgggtttgttatcgtccttcaaggggttcgaatggtgttggcagaaatcgttccagcattccaagggattgctaaaaaactcgtacccgattctaaaccagcattagatgttcctatcgtttttccatatgcacctaatgctgtattaattggcttttttgttagcttctttgtaggaacactatccatgtttgctatgataggcttgcaaactacagttatcattcctggggtagtaggacatttcttctgcggagctgcttctggtgtcttcggcaactcgactggcggtagaagaggggcggtattaggttctgctttcaatagcttattgattagttggctgccattatttatccttccagtattaggagatcttaaaatcgcttcttctacatttgccgatactgattatctagtaccaggacttgtacttgggaaactaggagaatacggtcaaatagccttgacagttggaatcatcgctttctttttacttgtcgtattatctagctttctttttgccggaaaaagaacaaacattgtttctaaagaacagaattaa

SEQ ID NO: 2046 - DNA (genomic), 204 bp, Enterococcus faecium; double-stranded, circular
  misc_feature (B) LOCATION 1...204
  hypothetical: NO
  anti-sense: NO
caaaagtcttgtcgcagttccttttttcgaataaacggtgttctcctgccaactcctcggtcacaagtcacaatagtcaacaaacatgagaagctgttttttgaaattgctccttgtgactcagagttaaacggcaggctcacaacctcttccttaaacggtgttcaaaagcttgcatctacggcactaagcccaatcagatga

SEQ ID NO: 2047 - DNA (genomic), 549 bp, Enterococcus faecium; double-stranded, circular
  misc_feature (B) LOCATION 1...549
  hypothetical: NO
  anti-sense: NO
ttgaatgaactttcaaaattgaaaaagattcaaaatgctgttggatttgatatttcaaaagaaagagtctacgcagctacagaacaatctgccgaagcattttggtgtgtagctgatttgaccaatttgccgtttgctgatcaaacattcaacgcggttttaaatatcttttcgccttctcattaccaagaattccaacgtgtactctcagaagatggaaaagtgttgaaggtggtgccacaagaaaattatttaaaggaactacgtcaggctttttatccgaatcaacctgaaaaacagagttattccaatgaacgtgtagtagccaagtttgctgaagcaatgaaattaactgaacgtcagcgtgtaacctatgaatttgagataccagaggaaaatcaaaaagatcttttggccatgtcacctttagaatggcaggtagaagagcgaatcaaagcagacttatataagaatcctttgaagaagattacaattgacatagaattattaaaaggaactaagagaaaacgtttttctagcagtttttaa

SEQ ID NO: 2048 - DNA (genomic), 1827 bp, Enterococcus faecium; double-stranded, circular
  misc_feature (B) LOCATION 1...1827
  hypothetical: NO
  anti-sense: NO
agaattacttgctcaatcagcagaatatcaggaaatcgtcgcatcacaggaggaagaatagttatgaaagtaaaaaaattatccttgcagacgctccgccgattcattccttaccttactgcctatgcaaaagacatttggctagctgtgatactaggaatcatcaatgggattgcaacagttgtgatgacgttacaaattggtcaaagtatcgatcaaatgattggagaaggacaggtccgcttcaatcgactgttccatttacttattctattcggtggtatcgttttaatcaacgtagtcagtcaatggctcatccaagtgttaagcaatcggttagcttacttatccgttgcaaaattaagaaaagatgcatttgctcatctgaatcgattgccacttcgttattatgatcaaaactcccacggaaatatcgtcagtcgatttacaaatgatatggacaatatttccattgcaatttctgcggccttcaatcaattattttctggagtggcaatcatcattctttcgtttatttttatgatgcgtctaagtccacttctgacattggtcgttctttgttctacaccaattattttccttgtgagttggatcgttgctcgtgcttcacaaacaaatttcgatagacagcaaaggattattggggatatctcgggctttgtgaccgaacgaatcggtaaccagaaaatcgtgaaagcttttcagcaagaagaagctagtcaacagcaatttgaactgctaaatgctgatctatatgaaaaaggacaacgggcacaattttcttcttccttgacaaacccgtcttctcgttttgtagatcaccttgcttatttatcgattggtttagttggcggcctattggcattgaagagtggttcgtcaatcactgttggtgtgatttccagctttacgatctactcaagtcagttttctaaaccatttatcgaactttctggaatcacgacacaactgcaaaccgctttttctggtctagaacgagcatttgatttgatcgatcagccagaagaaaagcctgatttgccagatgcctatgccttggaacccaaaaatatcaaaggaaaagtctcttttgatcatgtttctttttattatgaccccaagcagcgtttgatcgaagatttcaattttactgcttatccaggtcaaaccattgctatagtaggaaaaacaggggccggaaaatccacacttgttaatttgctgatgcgtttttatgacacaacaaaaggaacaattacagtcgatgaccatgacatccgctctatccaacgtgatacattacgtaaaagttttggaatggtgttacaagatacttggatatttgacagtacattgcgagaaaatcttcgttttgggaatccggaagcaagtgacgcagaaatcaatgatgccctaaaagcctcttatatgtatgaatttgtagaacgtttgccggaaaaattagatactaagattggcggtcaagggttaaagatatcagatggacaacgccaactgttgacgattgctcgaacgatgatcagtaatccccctatgttgatcttagatgaagctaccagctcagtcgatacattgacagagaaaaaaatccaacaagccttcttagcaatgatggaaggaaaaaccagttttgtgattgcccatcgcctgtccacaatcaaaaatgcggaccagatattagtgatggatcagggagctattgtcgaaatgggcacccatgatgagctgcttcaaaaagatggttattaccgacggctctatcaagcacaattcacagcacaataa

SEQ ID NO: 2049 - DNA (genomic), 348 bp, Enterococcus faecium; double-stranded, circular
  misc_feature (B) LOCATION 1...348
  hypothetical: NO
  anti-sense: NO
agcaacacttggatactccaccgggtgaattattctggtggtcaacgccaagcattaagcttgctgatggcgacgatcacagctcctgagttactattattagatgaacatactgcagctttagatcctaaaacagctacagcattaatgcgattaacaaatcaacggatcaatgaacaaaaattgactggtctcatgatcacgcatcgaatggaagacgccttgaaatacggaaatcgtctgatcgtactccaaaaagggaaaatcgttcaagatatttctgaaaaagaaaagcaacatttgacaatgggcgaccttttgcagttctttgaagaagtaatggattga

SEQ ID NO: 2050 - DNA (genomic), 315 bp, Enterococcus faecium; double-stranded, circular
  misc_feature (B) LOCATION 1...315
  hypothetical: NO
  anti-sense: NO
gctttcgcttgtgacggcttttctgctaaaataacggttttcatcatgacgatttcactccctttcttgttgtttgctttgttgaaacaacatcgcacgtttttgctttctgatctcttgttggtggatttcatgcttcaattgatcattccaatccttttttacttcaggtacaaattcatgttcatgatttttatagcttttgtagtattgttctgctttataagagaaaagaatctgagcattaatatcccctttttcttgataaaaacgatcaaaatcgtacgtaccatccacgcgttcacaaccttttaa

SEQ ID NO: 2051 - DNA (genomic), 1416 bp, Enterococcus faecium; double-stranded, circular
  misc_feature (B) LOCATION 1...1416
  hypothetical: NO
  anti-sense: NO
agactggcttggaatcggacacttaaatgtagaacatatcgaattgggaggaaaataaggatgcgtcatgacgggagaaaagcccaagagcttcgcaaactggagcttcaaacaaatgttttcaaatatccagaaggatcggtagtgatccgttttggtgatacaacagttatttgttctgcaacaatagaaaattctgttcccccttttttgagagaaacaggaacaggatgggtgacagcagaatatagtatgctgcctcgagcaacgagtacgagaaatcgtagagaaagcagcaaagggaaactttttggtagaacaatggaaatccagcgtcttattggtcgttccttgcgtgcagtagtagacttggaaaaattaggagaacgtagtatcatcgtagactgcgatgtgatccaagcggatggcggtactagaacagcaagtatcactggggcatttgtggcattgaaattagccattgaaaaacttttaagagaaaaagaattgtcagaagatccaataaaagaacatcttgctgcagttagcgtaggaatcttaccagatgggacttgcgtcacagatttggattaccaagaagattccgcagcacttgtagacatgaatcttgtaatgacagaatctggaaaattcgtggagattcaaggaactggagaagaagcaacgtttgatggtgaacagttgaatgaaatgctcttttttggaaaaaacgcgattgaagatttgatcaaagagcaaaaacatgctttgctaacagagtttgctcaaaatgatgagcggatagaagaaacaaaaacaatcatcattgcgacaagaaatccaggaaaagcagaagagtttcgaaatatgttcaaagaagcgggatatcatgtaaaaacattacttgactatcctgaattgccagatgtggaagaaactggcagcacatttgaagaaaatgcccgattaaaagcagaaacgattgcacaattgcttgatcagccagtcttagcagatgattcaggtttgaaagtggatgctttaggcggtatgccaggaatctattctgcacgttttgcaggggaacaaaaaagtgatgcggggaataacgccaaattattatatgaattgacagatgtgccggatgaaaaaagaacagcacaattccattgtacgttagtattcgcggcacccaaaaaagacagccttgtagtagaagcggaatggcccggtcgagtagcccgtataccatctggcgaaaatggctttgggtatgatcctttatttatcccagaaggtaagaaacaaacagcagcagaattatcgagcgaagaaaaaaacaagatcagtcatcgggctcaagcaatgaaaaaattgagtgccgagtggaaacaatggctggaaggagagagatag

SEQ ID NO: 2052 - DNA (genomic), 192 bp, Enterococcus faecium; double-stranded, circular
  misc_feature (B) LOCATION 1...192
  hypothetical: NO
  anti-sense: NO
cttatagaacttctgttttgcattcggttttgttatagttgttataaagttttattttattacagaacatttttaattaataaagaacagttagaagttaaaattgctgattcacatagagtttatgacttcttggaaattctttttcaatcagttttttcatctgtttatgaaattcttttttttcagtaa

SEQ ID NO: 2053 - DNA (genomic), 336 bp, Enterococcus faecium; double-stranded, circular
  misc_feature (B) LOCATION 1...336
  hypothetical: NO
  anti-sense: NO
gtgctttattgtatttttttgacgtacttaatcaagtacgctataattatatcagaaaaaggaggagagacaatggctaatacaacgatgaatcctagcactgctcgtaaaaatttttatcagttattgaaagaggtaaatgaaaatcatactgaaatcgagattattagtgatcgtagtggaaacaatgctgtattgattgggctggaagactggagagcgattcaagaaaccctttttcttgagcaaacaggtactttagataaagtacgagaccgcgaaaaagacgacagtagctttacgaatatcgatgatattgattgggaagctctttga

SEQ ID NO: 2054 - DNA (genomic), 969 bp, Enterococcus faecium; double-stranded, circular
  misc_feature (B) LOCATION 1...969
  hypothetical: NO
  anti-sense: NO
gcaatttattgttggagaaaggaggagaataggatgtcatttgctgcagatgtgaagaaagaactaactggtttggaagttcatcgagaacatgcgaaagcggaattagctgctttgctgcgaatgaacggctctttaggtattgtgaaccagcagtttattttgaacgtccaaacagaaaatgctgcaattgccagacgtatctattctcttttgaaagatcattatcaggtacgaagtgagctactcgttcgtaaaaaaatgaaattaaaaaagaacaatgtctatatcgtccggttgaagcaaggcacaaaagatgtgttgatggatcttgatatcatggatggtatgatgttcaatggacacgtttcggacgagattatgggaaattcgcaaaaaatgcgttcttacttacgtggtgcttttatggcctcaggttcagtcaataatccggaaacgagtcgttatcatttggaaatattttctatttatgaacagcataaccaagacatttgcgatatgttaaattattacggtctacatgctcgaacgcttgaacggcgcaatggctatatttcgtatttaaaaggagcagaaaaaattgctgatttcttaacattgattggtgcaaccaactcaatgctccgatttgaagatgttcgaatcgtacgggatatgagaaattcggtcaatcgtctagtcaattgtgagacagcaaatctgaacaagacgattgatgcggcttctaaacaaatcgaaaacatcgaattgatcgaagcaaaggtcggtatacatgcccttcctgaaaaacttcaggaaatcgcagaacttcggcttcaacatccagaggtcagcttgaaagaattaggggaaatgattccctcaggtgcaatatcaaaatcgggaattaatcaccgaattcgcaaaataaatgaatttgcggaaaaactgcgtgaagaagcagtttaa

SEQ ID NO: 2055 - DNA (genomic), 2493 bp, Enterococcus faecium; double-stranded, circular
  misc_feature (B) LOCATION 1...2493
  hypothetical: NO
  anti-sense: NO
atggaagaactttttactgaaagagcccaagcagtattagaaattgcacaagaagaagcaaaacggttgaaacatcaatcagttagttcagaacatgttttactagccttagtggtcgagcaaaatggaattgctggaaaagtattacgtgaaatggatttgaatgaaacggaaatttatgaagaaattgaacatctgattggttatggtggtatccgttcttaccctaaaggagtctttcttccatattcaccaagaatgaaacaagtttttgctttagctagcagcgaagtgaagaaaactggttctcaaaaagttggaacagaacatattttgatgagcttattaaaagatgaaagtatcatggctactcgaatcatgatcaacttaggtatcagcctttcaaaagcccgtcaagttctgaaacaaaaaatggggctagctggtgattctgctggaaaaggaatgaatcgtcgtagaaatgtaaatgtacaagataaacggcaaacaccgcaaggaacacctacgctagattcattagcacgtgatttgacgaaattagcaaaagaaaacaagctggacccagttgttggtcgttcgagagaagtgaaacggcttatccagattcttagccgacggacaaagaataaccctgtactggtgggtgaacctggtgtaggcaaaacagccattgctgaagggttagctcaaaaaatcattttaggtgaagtgccagaagacatgcaagaaaagcgcctgatgatgcttgatatgggatctttggttgctggtacgaaatatcgcggtgaatttgaagatcgaatgaaaaaggtcatcgacgaaatctataatgatggtcaagtaatcttattcattgatgaattgcataccttaattggtgcaggtggagcagaaggagcaattgatgcttcgaatatcttgaaaccggcgttagctcgaggagaattacaaacgatcggagcaacgaccctagatgaatatcaaaaatatatcgaaaaagattctgcattagagcgacgttttgctcgcattcaagtagatgagccaactcctgaagaagcagaagtgattcttcaaggattacgtacaagatatgaagagcaccatggagtggagatcacagatgaagctgtacgagcagcagtcaatctttctgttcgttatatcacttctcgtcaactacccgataaagcaattgatttgatcgatgaatcagcagcgaaagtccgtttggatcaaaccgatcacttaacaaaatcaactgtgatcaaactagaaatcgatgaactagtacaagaaaaggaagcagcgatccaaaaacaagactttgaaaatgctgctcaattacgcagacaagaaaaagcactacgtaaaaagctgcaaaaagtttctgcaattgaagcaaaacaggagcaaggttattctgatcgtgtaacagaagaagatgttgctacagttgtatcggagtggactggtgtccctctacagcagttggagaaaaaagaaagcgaacgcttgttagaactggaaggacttctgcatgaacgtgtcgttggtcaagatgaggctgtcaaagcagtttcacgtgcgatccgccgtgcacgaagcggattgaaagatcctgatcgtccaattggttcattcatgttccttggaccaactggtgtcggaaaaacagaattggccaaagcactttcagaagtcatgtttggaagtgaagatgccctgatccgtgttgatatgtcagaatttatggaaaaatacagtacaagccgattaatcgggtctcctccaggatacgtagggtatgatgaaggtggacagttgacagaaaaaattcgtcaaaaaccatattcagtgattctcttagatgaagtggagaaagcacatccagacgttttcaatttacttctgcaagtattggatgatggtcatttaacagattctaaaggtagaaaagtggactttagaaatacaatcatgattatgacttcaaatatcggagcgacacaaattcgagaagaaaaaaatgtcggattcaatgtccaagatgttactaaagatcacaaagccatgcaaaaacgtatcttagaagagttaaagaaagctttccgacctgaattcttgaatcgaatcgatgagactgtcgtcttccattcattgagtaaagatgaaatccatacaatcgtccaaatcatgagcaaagcgattatcaaacgattgaaagaacaagatattcaagtgaaaatcacaccatctgcaatcgatgtgatcgggaaagctggatttgatcctgaatatggtgcacgtccaatccgtcgcgcacttcaaaaagaaattgaagatcgattgagcgaggctttgcttggcggagaaattcgtttaggtgaccacgtaacagtaggtgcttcaaaaggtaagatcacattgaatgttcgcggacctaaaaaggaaacagtaggttccctatag

SEQ ID NO: 2056 - DNA (genomic), 648 bp, Enterococcus faecium; double-stranded, circular
  misc_feature (B) LOCATION 1...648
  hypothetical: NO
  anti-sense: NO
accggttattggaggagagcacaaatgaatgaatatttgaatgaagttgtggatcatcttcaagaaattcctgaagacgatcgttttgatttgatccagtattatgaggaatattttttagattctggaaaaacattagatcagatcattgatgaatatggtacaccaaagcagtttgccttaaaattaaaaatcagttacttttcagaagaagaacaagcagaaaacgagttagtgaaaaatccaaaaagacaaattcgcctgatttggttaatcattatcggtttatttgcttctcctgtcctcattccactagcactggggtttatattggttattgggggactattggttgctttactagcgctcatttttagtatctatgttttatgtatcagtatcttaggtgttggcctattcatgatcatctcaggaatcagtgtgtttggacaatcgattctgagtggattattctttatcggtgtcggtctgttcgccacaggaagcgcagtatttatttcgccactgttgctgaaaggaacaaaagggcttttttatgtcatgatgaactttgttaaatggatgggacgacgttttattacaaaaagagatctgcatttcagcgggcgtttgaaggaggacacataa

SEQ ID NO: 2057 - DNA (genomic), 261 bp, Enterococcus faecium; double-stranded, circular
  misc_feature (B) LOCATION 1...261
  hypothetical: NO
  anti-sense: NO
ttggactattggaacaaagccaacttgcttcactctatgtctaaaaagagttattcaccagataattcagcgtgcgaaggtttctttggacgattaaaaaacgagatgttttatcaacgtgactggaagaatacaacaatcaatcagtttataaacaaattggatgattatattcattggtataataatcaacgaattaagttatctttaggaaggctaagccctcttcaatatcggaagaagcaaagatatatttgttaa

SEQ ID NO: 2058 - DNA (genomic), 201 bp, Enterococcus faecium; double-stranded, circular
  misc_feature (B) LOCATION 1...201
  hypothetical: NO
  anti-sense: NO
cgcagatattgttgcacgagtgattctaccaagtggggaaataccgacagggattttgatcgccttttttggtgcgccatattttctgtatgtattgtttatcagacaaaaacacgtgctgagcagttgaagttcattaaaaggcaagaaggccaatcattgttaggtcttctttttcttttatttantacatttatttga

SEQ ID NO: 2059 - DNA (genomic), 1941 bp, Enterococcus faecium; double-stranded, circular
  misc_feature (B) LOCATION 1...1941
  hypothetical: NO
  anti-sense: NO
tcattgtattgcccagcagtgctggatcttcggtcaaatggcgaggcactgagtcagatcactacgttgaaaacagaagcgacttcttatctggatctaatcatgaaaaatatgattggtgtttatgacacgacaaaatacggatcgattccgttcgtttacgcaggtctgctaccattagtcctctgtctgttttattttgccagtcggaaagtaccgttgaaaaataaatttttgtacggcagtcttttcgccatacttatcgcaagtttttatcttgttccattgaatttgttctggcatggtatgcatgcaccgaatatgtttttattccgttatgcctatctgttctctttcttagtgctcctgcttgcaggaaaaggatgggaaaagatagaacaagacgatcgtgggctgttgttaggaatcattttggtcgtagctgctctctttgcggtggcatggggcatcaaacctgaaggaagctacacctatgtgacgatgacttcctttgtattgacagtggttttcttagggatttatgcttttgctgtgggattttatcagcataaaaaactttcattcaatcatctgagtatattgttattattgatcatgtctgctgaagcactggtcaatacgaacagtatgatccatggcattcttgatgattggaattatgcttcccgcagtttatatactgatccttatcctgacttgaaagctcttgtaaatgaaacaaaaaaagattccgactcgttttaccgcttggaaaatctggatccagtatctgcaaacgattcgatcaactatggttacagtggtatcagtttgttttcttctataagaaatcgtaattcttcctcttacctggataaattaggtttccgttcaagagggacaaatttgaatatccgttataacaataatactttgctgatggatgggtttacaggaatcaaatataacatttctaaaaacgaaagcacgttcagtaaatatggcttccgccaagctggtcaaagcggcgactatacactgtatcagaatgtcaatgcattgccactagcatttactgcaccgttgtccgttaatgatgttgagcagccagtgacagataatttgaccagtcagacaaacttgatcaatacattgtctggtctaaatgaacagtattttacattctatacacctactttgaagaatcagttgaatacgacgatcacaaagacaacgactggcgtcacttactcagaaacagcagataaccagccaaaagagctcacttgggaagtccatgtgcctgcaaatacacaagcttacttaagtttgttcccaaccaattttgcgcaattagaaagttctagtgcgacgatcactgtcaatggtacatcgcgaaaaacgcaaatcaacatttctggtcaatactatgatcttggctattatcctcaagagacaacagtgacatttactgcaagtttttatgggacgaaagaaataagtttcatggagcctaaagtcgttggtctagatgttgtagcctatcaagccgcaatgaatcagatcaaagaaaaaggtgtcgaaatggaagccactggcagaaaagcttctgggactgtaaataccgctgaagattccatgttggtgacaactattccttatgacaaaggatggaaagctaaaattgatgggaaaccagtcaaggtcagcaatttcaaagacgcattcttgatgataaaagttccagcaggtaaacatactgtcactttcagttacttgcctgaaggatttacgataggtgcaatcctttttgtcctatgtattgcattgtttattctttatgtctggtaccttgaccgcaatcgccccttttatggcacgattgatccagcaatagaagaacaaccacgaaacacacacagaagaagacgtagaaaataa

SEQ ID NO: 2060 - DNA (genomic), 651 bp, Enterococcus faecium; double-stranded, circular
  misc_feature (B) LOCATION 1...651
  hypothetical: NO
  anti-sense: NO
agatggtattgcgctatccaaatggccaaccttattataagaatgcctctcccgtcgaaaaaattcaagaaaaaagaaatcagatcactgaattcggcaatcgggggatgcgctttgagacaagcaatcaatgaaagtaataaatattatctttcccgcgggttggcggttatccataaaaagcctacccctatccaaatcgtgaaagtagactatcctaagagaagtgctgctgtgatcaaggaagcctactttacccaagcctcaactacagactataatggcgtctatcgaggcttttacttggactttgaagcaaaagaaaccaagaacaaaacatcttttccctttaaaaacttccatgcccatcaaatcgaacatatgaaagcatgcctcgaacaaaatggggtctgctttgtcttgttatggttttcgtctttgaagcgctgtttttatttgaatagtgttcatttgattgcttactgggacgcccaaaaggaaaaaggacgcaaatcactacctttatctttgatcgaagaactaggaatagagatcaaaactggtatttctccgcggattccttatttggacgcggttgacttctatttatcaacattatctattgaaggagaaagcaagaatggcaaatga

SEQ ID NO: 2061 - DNA (genomic), 1488 bp, Enterococcus faecium; double-stranded, circular
  misc_feature (B) LOCATION 1...1488
  hypothetical: NO
  anti-sense: NO
ccatatcattgcatttcatttccttggtttccggaactcagaatatcgtctcaaatgctttttttgaaaggatttatagttatgactaaaacacttcctaaagattttatttttggtggtgctacagctgcttatcaagcagaaggtgcgactcacacggatggtaaaggcccagttgcatgggataagtatcttgaagacaattattggtacacagcagagcctgcaagtgatttttaccataaatatcctgttgatttagaattagctgaaaaatatggcgttaatggtattcgtatttcaattgcctggtctcgtattttcccaactggctatggcgaagtaaatgaaaaaggtgttgaattctaccataatctttttgccgagtgccacaaacgtcatgttgagccattcgtgactttgcaccactttgacacaccagaagttcttcactcagatggagatttcttaaaccgcgaaaatatagaacactttgtagattatgccgctttctgttttgaagagttcccagaagtaaactactggacaactttcaatgaaattggcccaattggagatggtcaatacttggttggtaaattccctccaggcattcaatatgatcttgccaaagtcttccaatcacaccacaatatgatggtttctcatgcacgtgctgtgaaattgtataaagataaaggttataaaggcgaaattggtgtagtacatgcgttgccaaccaaatacccttatgatccagaaaatccagcagatgttcgtgccgctgagttagaagatatcatccataacaaatttatcttggatgcaacctaccttggacactattcagataaaacgatggaaggggtcaaccacatcctagctgaaaatggtggagaacttgatcttcgtgatgaagacttccaagcacttgaagcagctaaagatttgaacgatttccttggtatcaactactacatgagtgattggatgcaagcctttgatggtgagactgaaatcattcacaatggtaagggtgaaaaaggaagttctaagtaccagattaaaggtgttggtcgccgaatcgcaccagattatgtgcctagaacggattgggactggattatttatcctgaaggcttgtatgatcaaatcatgcgagtgaaaaatgattatccaaactacaagaagatttacatcactgaaaacggtcttggatacaaagatgagtttgtagataataccgtttatgatgatggtcgtattgattacgtgaagaaacacttggaagttttatcagacgcaattgcggatggtgcaaatgttaaaggttacttcatctggtcacttatggatgtcttctcatggtcaaacggatacgaaaaacgttatggactattctatgtagactttgacacgcaagaacgctatcctaagaaatcagctcattggtataagaaagtagcagaaactcaagtgatagagtaa

SEQ ID NO: 2062 - DNA (genomic), 183 bp, Enterococcus faecium; double-stranded, circular
  misc_feature (B) LOCATION 1...183
  hypothetical: NO
  anti-sense: NO
aatcaggaactttctggttttccaaggcttcttcgtacaacattcgataaagaaaaacctgttcttgtaaataaaagaaaaaccgacttttttgatagatccacgatgatagatgcaaaagatgtttatgacgcaagtagcattgttcttgtatggatactgtattcttttgcttgtgaataa

SEQ ID NO: 2063 - DNA (genomic), 849 bp, Enterococcus faecium; double-stranded, circular
  misc_feature (B) LOCATION 1...849
  hypothetical: NO
  anti-sense: NO
atgaataattggcttgagtattttcctgaaaacgttttggaacgcggttacagctatcatctgcacggttttgtccgtcatttgaactatacaagcaagtacttgtccgcaacagtttctggcacggaagattataaggtagtgatcacttgggatgaaaagaccaacatgacttgtgattgtctatatgccatagaaggaaaaaaatgcaaacacatggctgctgtcttattcgcttacgaagaacgtccaataaaaaaatccaactactcactttccgaactctcgtcccttgtttcctccgctagttcctctcttgtacgggagcttttaacagagattcttatagaacatccgcactttatcgaacgcttcaaagttaagatgccatttcatgcaataaattattcagataaattaacaactatcatccataaatacgatcatattatcaagaaaaacaaaaacaggaaaacagcgaagttcatcatggagatgcgaaagttcatccaagaagcagttgaatcgcttattcagcaaaatgcctatcttcccgcattcgaattgatcaatgaagtgattgctactctcgaaacattctattgggagcctgaggatgaacgaacccttcttctgatagaggactgttattatttatggaaagaattattagcagaagcacctcatgcagaaaaaaggcaaatgttctcttggttcgtctgccaagtcgatcatactgacgcctcttattcaaaacgctactctataaaaatcctgaaagaagactttcgggaaaaagaattttctaaccaaaagaaaaaaatagataaaaaactaaagaaacggtaa

SEQ ID NO: 2064 - DNA (genomic), 1028 bp, Enterococcus faecium; double-stranded, circular
  misc_feature (B) LOCATION 1...1028
  hypothetical: NO
  anti-sense: NO
taatcaattggtttatagaaaacggcgagaaaaaattccgagctgcccaagtttgggaatggttgtatcaaaaacgtgtaagtaatttcacagaaatgacgaatctatcgaaacaattgatcgaaaaattatcggagcattttatcatcaatcctctaaaacagatggtcgtccaagaagcttcggatggtacagtaaaatatttgtttgaactccctgataaaaacatgattgagactgtactgatgagacaagaatatggcttgtcagtttgtgtgacgacacaagtaggatgtaatatcggctgtacgttttgtgcaagcgggctgctcaaaaagaaccgtgatctgactgctggagaaattgttgcacagatcatgatggtccaacattattttgatgagcgcaatcttggcgaacgcgtttcacatgtcgttgtaatggggatcggtgagccatttgataattacgacaatgtaatggactttttgcatatcatcaatgatgccaaaggattggcaattggtgctcggcacattacagtttccactagtggattagcacacaaaatcaaggaattcgctaataacggcttgcaagtcaatctggctatttccttgcacgcgccgaataatgaggtgcgaacatcgatcatgcggatcaaccgaagtttcccaattgagaaattgatggaagctgtggatgagtatttagagaaaacaaaccgtcgaatcacgtttgaatatatcatgttgaatcaagtaaatgatagaccagagcatgcgcaacaattagcagatctattaaaagataagaaaaaattagcatatgtcaacttgattccatataatccagtcagtgaacatgatcaatattctcgcagtccaaaagctgatgtattgagattttatgatgtattgaagaaaaacggcgtaaactgtgtgatacgtaaagaacatggtacagatattgatgcagcttgcggacaattgcgaagcaagcaaatgaaaaaaacagttgccaaataa

SEQ ID NO: 2065 - DNA (genomic), 537 bp, Enterococcus faecium; double-stranded, circular
  misc_feature (B) LOCATION 1...537
  hypothetical: NO
  anti-sense: NO
aagaaaaattggtttgggggaacattgatgagaagaaaagcagtaatcgatcggctttatttatttttttggttttttcctatcgttttgctaccttttacatgggtaaatgctgttgtgcaaggtgccgagatattagggctgatccaaggaagtggatttgtggtttctagaaattttccagctttgactattttttacttagtgataagtgtaggtctattactgccaaaatctctgatcaatcattataattggcagctgctttatttttcttgtttactcatattcacatctatgttttccttgttgcctcgcatgatcatcggtcctaatggtttgagcgagagcggactgaaggattcagcatatccctccatgtatttcttgaccattaaaccgtgtttctatttagtcattgtctcatttattcttgcgacattcttttacttctggaaagagatccggataaaaagtgaacgatctgtatctataaaaaataacgttgatggtggatcatcggtaacaagcatatga

SEQ ID NO: 2066 - DNA (genomic), 573 bp, Enterococcus faecium; double-stranded, circular
  misc_feature (B) LOCATION 1...573
  hypothetical: NO
  anti-sense: NO
aaaaagaattggcagaaaaaattggcgtatgaaccaaaacaagacgaagtattaagctatttgatgtatccgcaagtctttttggactatcaaaaagcatataatcaatttggcgatgttacattactggacacaccaacatttttccaaggtatacgtttgggtgaaacaatcaatgtacaaatcgaacgcggaaaaacgcttatcattcgtttagatgaaatcggagaacccgatatcgaagggaatcgcgtactgttcttcaatttgaatggacaaagacgtgaaatcactatcaaagataattcgatcatcagtacggtccaaacccgattgaaagctgaaccgacaaaccgagaacaaattggagcaacgatgtctggttctgttttggatgtattagtgaaaaaaggcgataacgttaaaaaaggtgatacgttgatgattactgaagcgatgaaaatggaaacggccatcgaagcacgttttgacggaaaagtcgcacatgtatatgtgtcttcaggaaacactatttcgtctggtgaccttttgattgaagtgactgagaaataa

SEQ ID NO: 2067 - DNA (genomic), 186 bp, Enterococcus faecium; double-stranded, circular
  misc_feature (B) LOCATION 1...186
  hypothetical: NO
  anti-sense: NO
atacttgattggctatgttgcgaatctacattaccagtagaagtattagtaatggaagtagtagaagtacttttagttgaaccaacctcagttgttgaaatggctgctgaagattctttaacagaattctttgttttatatccacaggcagaaaaaagtattacagttcccaacaagcctgcgtaa

SEQ ID NO: 2068 - DNA (genomic), 276 bp, Enterococcus faecium; double-stranded, circular
  misc_feature (B) LOCATION 1...276
  hypothetical: NO
  anti-sense: NO
ttgaatgattgtgcttctgccggagaaaatcagatccgaggatgctcattgtcaagggcaatcggagccataacaccgcagcattcacaacaccttataatttttgtcaaaaaaagtgttgccattccatctggcattaagaaaggatatgaagcctttgtcttttcatgtattaactttgacttttcaattgcttccttgttttcaccgttatcatcaacaggatctgtaacaactccaacgatatttacacccttgcttttcatttcattctga

SEQ ID NO: 2069 - DNA (genomic), 321 bp, Enterococcus faecium; double-stranded, circular
  misc_feature (B) LOCATION 1...321
  hypothetical: NO
  anti-sense: NO
ttgaatgattgtgcttctgccggagaaaatcagatccgaggatgctcattgtcaagggcaatcggagccataacaccgcagcattcacaacaccttataatttttgtcaaaaaaagtgttgccattccaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 2070 - DNA (genomic), 2319 bp, Enterococcus faecium; double-stranded, circular
  misc_feature (B) LOCATION 1...2319
  hypothetical: NO
  anti-sense: NO
gaaggtgattgcatgggcaacaaaagaatctatgaattagcaaaagaactcaaaaaatttagtaaagacgtcgtggaaaaagcacaacaacttggcatcgatgtgaaaaaccatatgggtgcgattactagcaatgatgagaagaaattgcaacaagcgttcaaaaacccaagcacgaaacaacaagctgcacaacaagcaagcagaaaaccagccaatcaacagccgaacgatcaacgtaaaaaagaaacaacgaacaatcaacaaaaaaataaaaataaccgcagttatcaagatcgcggtcaagggagcggtcaagtgaatcaaggaaaaaaaccaacaacaaaccaaaataatacgggaaataccagcagccaaaatcgtcaaggaacgagccaaggcggcaatcaaaaccgtactaacaataacaacaaaccaaacaataacaatcgcggcaaatttaataataataaccgtaatcgttataataaaaaaggtaaaaaaggcaaacagcaacaatcaactaaaccagctgtaccaccacgcaaattccgtgaattgccagatgtattagagtatactgaaggtatgaacgtagcagatattgcgaaaaaaattcatcgtgagccagcagaaatcattaaaaaattatttatgcttggtgtcatggtcaatcaaaaccaagcactggataaagatacgattgaactgttagcgacggactatggcatggaaccacaagaaaaagtccaagttgacattgctgatatcgataaattcttcgaggcagaagaagtcgatccagataaattagtctcacgtccgccagtcgtaacgattatgggacacgtagaccatgggaaaacaactttattggatacattacgccattcacgtgtaacaagcggcgaagccggcggaatcacacagcatatcggtgcctaccagatcgatattgatggtaaaccaatcactttcttggatacaccaggacatgcggcctttacaagtatgcgtgcacgtggagcaagtatcacagatatcacgatcttagttgttgctgcagatgatggcgtcatgccacaaacagttgaagcaatcaaccatgccaaagctgcaggcgttccaatcatcgtcgctgtaaataaaattgataaaccaggtgcaaaccctcaacatgttatgcaagaattaagtgagtatgagttaattcctgaagcatggggtggagaaacgatctttgttgagatctcagcgaaattcggccaaaacatcgaagaattgctggaaatgatcctgttagtcgcagaagtagaagatttaaaagcagatccaacacaacgcgcaatcggaacagtgatcgaagcacgtcttgataaaggtaaaggtcctgtgtcaaccttacttgtccaagaaggaacacttcatgttggtgacccaatcgttgtcggtaatacttacggacgtgtccgtgtaatgacaaacgatcttggccgtcgcgataaagaagcaggacctgcaacgccagtagaaatcactggcttgaatgatgtacctcaagcaggtgaccgtttcgtagtcttcgaagacgaaaagacagcacgtgcagcgggtgaagaacgcgcgaaacgtgcattattagaaaaccgtgctgccacaagccgtgtgactttggataacttatttgaaagcctgaaagaaggcgaattgaaagaagttaacgtaatcatcaaagcagatgtacaaggttcagcagaagcactggctgcatcattgaagaagattgatgtggaaggtgtccgtgtaaaaatcgtccattcagctgtcggagcaatcaatgaaagtgatgtaaccttagcagcagccagcaacgctattatcatcggtttcaacgttcgtcctacaccgcaggcaaaagtgcaagctgatactgaagaagtcgatattcgtcttcaccgtatcatctataaagccatcgaagaaatcgaaactgcgatgaaagggatgctagaccctgaatttgaagaaaaaatcaccggtcaaatgatcgttcgtgaaaccttcaaagtttctaaagttggtacgattgcaggtgcctatgtaacagaaggatatattcgtagagatagcggtgtccgtgtaatccgtgacggaatcgtaatctatgaaggccaacttgcaagtctgaaacgattcaaagatgacgtgaaagaagtcaaaatgggttatgaatgtggtgcaatgattgaaaaattcaatgacatcaaagtagatgacgtaattgaaggatttatcatggaagaagtcaaaaatgactaa

SEQ ID NO: 2071 - DNA (genomic), 606 bp, Enterococcus faecium; double-stranded, circular
  misc_feature (B) LOCATION 1...606
  hypothetical: NO
  anti-sense: NO
aagttcgattgctatttttctttttttcctataccattttatgagagaaggaaaggtgattttttggagcaaatgaaagaaaaattacgccggcaaggaattgaaaagctgaaaaatctggccaaaagcggcaagaaaaagggcaaagaacagcgaatctatgaacagctattcgcaagcgagtactggaagtcggcacaagtgatagggacgactttgtcaaatgaaattgagctggatacacagccgattatccaacgggcgaaaaaagaacaaaagaaaatagttgttcctaaaactttaccaaaacgacagatggcgttttatgaaatggatgaacacaccatttttgaacgttcgagttttggcgttcttgagccacaatcagagaagctttatttgccggaaatgatcgacctcctcattgtaccagggattatctacaatagagccggttatcgtattggttttggcggtggttattacgaccggtatttaaaaaatttccatcgaaaaacatgcagcctcgtttttcgagaacaattgaatgaacaatggcaaccggagagttttgatcagaagatccaacaattatttattgactaa

SEQ ID NO: 2072 - DNA (genomic), 225 bp, Enterococcus faecium; double-stranded, circular
  misc_feature (B) LOCATION 1...225
  hypothetical: NO
  anti-sense: NO
aaaagcgattggcaggcgagtaatatgggcatcaaagaatttcttccgtttttaattcctttaatcattgtacagtttggattacttatttatgtacttcatcatatctttacacattctgcatataaacatggaaatcgaatgatatgggtgattattgttattgttggtatgcagttcatcggtcctgtcctttatttgatttttggcaaggaggatgcgtag

SEQ ID NO: 2073 - DNA (genomic), 201 bp, Enterococcus faecium; double-stranded, circular
  misc_feature (B) LOCATION 1...201
  hypothetical: NO
  anti-sense: NO
agaagcgattgtttatttgatttaaaaaatagcaaggaggctgggattccattttatcccagcttccttgctatcatttttttatttctatttttaaaggttatacaaagattgtcttcattgtctctaacagctgatcaaaagaagaaatctcgatatcgcaaattggagtctgttcaattttgcgttctcgatggttga

SEQ ID NO: 2074 - DNA (genomic), 198 bp, Enterococcus faecium; double-stranded, circular
  misc_feature (B) LOCATION 1...198
  hypothetical: NO
  anti-sense: NO
aaaatttgttggggggcgggactgggttgggtattcccatccaagagggtgggaacaggtttacaagggtggaggattgagaaaaatttctatttgtgggcggaagaaagccaaaaaatacttttgttagggaaaatggggataatagagggagaccaacatccaacggaagaagaattagtgagaacaatgacgtaa

SEQ ID NO: 2075 - DNA (genomic), 465 bp, Enterococcus faecium; double-stranded, circular
  misc_feature (B) LOCATION 1...465
  hypothetical: NO
  anti-sense: NO
aaaaactgttgtccaatgctttatgatttacttcaaaccaaacatatttatattgtgtgcggaaaaacagatttgcgaaaaggaaatgatggtcttgccagtcttattcaacaagagtatcaactcgagctttacgaagaatgcggttttttatttggcgggaacgtcaagaaacgttcaaaactctctaatgggaacgtgaatggtttcctcccctgttataagcggataaaaaacgggtctccacacggggtttggtctcaacatcacaaaaaaagaannnnnnnnnnnnnnnnnnnnnaaaaaaaannnnnnnnnnnnnaannnnaaaaaaaaaaaaggagagagagngnangggnngggaaaaaaaaaaaaannnnaaaaggggaggagggggggggggaanaaangaaattgaaaaggaaaaaaagggtgggagggggcttaatagaaaaaaaaacagcc

SEQ ID NO: 2076 - DNA (genomic), 369 bp, Enterococcus faecium; double-stranded, circular
  misc_feature (B) LOCATION 1...369
  hypothetical: NO
  anti-sense: NO
aagaactgttgtccaatgctttatgatttacttcaaaccaaacatatttatattgtgtgcggaaaaacagatttgcgaaaaggaattgatggtcttgccagtcttattcaacaagagtatcaactcgagctttacgaagatgccgtttttttattttgcgggaaccgtcaagaccgtttcaaacttctctattgggacggtgatggttttcttctctgttataagcggatagaaaacggcaagttaaaatggcctcggacgaaagacgaagttcgaaccttaacgaaccaacaggttcgatggttgttagaaggattaagtatcgatcaacctcgagctattttgccaggaaaaaaaggagttttttaa

SEQ ID NO: 2077 - DNA (genomic), 1464 bp, Enterococcus faecium; double-stranded, circular
  misc_feature (B) LOCATION 1...1464
  hypothetical: NO
  anti-sense: NO
ttctggtgttgcctaatgcgttatttgtatcagcaactcttagcattttgcggaatggtcgcgttgatcttattgatcgtcggagtttcttttacgcaactgacaaaacagacgattgaagaaaacaattatcagcaactgtttggatacgctgaatcagttgaaaagacaacgcaaacctatgccgatacacttccgcagtttagtcaagatcaggcatttcaaaatgcattgctgctgacggagcaagtactgacagaacaaaatgtgaattttatattcatcgacaaaaatgaacgtgtcatttatccgaccaatacagcattgctgaactttaccttaacaacggatcaatggaaaaatctgaggagtgggcgtcaagagaaattcacatcgaataaaaacattttagggcaagcacaggcgacctcttacgcacttgtaccattcaatttgaatcatgaattctatggagcacttgtagtcagtcaacctgcgcggaatatcgataacagtgttcgtccaattacactgaacctgttcaaaggtttcattttttccagtattgtggcggtcattgccagttatgcttttgcagcattccaagtcaagcggatcaatcgtttaaggaatgcgacgaaagaagtgacgaatggcaattttgatgtacagcttcccgtacatgataaagatgaatttgatgagttagcagatgatttcaataaaatgacgaattcactgaaagaatctcaagcagaaatcgaagaacaagaaaatcgtcgaagacaattcatggcagatgcttcccatgagatgagaacacctcttacgacaatcaacggtcttctggaagggttggaatacaatgcaatccctgagaatcagcgagaaaacgcgattaaattgatgaagaatgaaacagagcgtctgatccgtttagtaaatgaaaatttggattatgaaaaaatccgtacgaatcaaatcagtatggtcattaaaaaattcaatggtacagaaacattgaggaatattgttgcccagttagaagctaaagcagaggcagcaggggatacgttgacactgaaagccgatgatgatatcgatgtttacgcggattatgaccgttttgtccaaatcatggtcaatattattcaaaacgcgatacaatttaccgaaaacggccaaatcatggtcaccctggaaaaaggctatcttgaaacgatcatcacgatcgaagatacgggaattggaatgtctgaacaacaaatgaaaagtatatgggatcgctattataaagtagatccttcaagaaaaaatacaaaatatggtgaatcaggattaggtttaccaatcgtgcagcagcttgttcgcctgcataaaggaaaattagaagtagaaagcgaactaggaaaaggaacgaaattcactgttcgtttgcctgacgtagaaatcaaagaagagtaa

SEQ ID NO: 2078 - DNA (genomic), 450 bp, Enterococcus faecium; double-stranded, circular
  misc_feature (B) LOCATION 1...450
  hypothetical: NO
  anti-sense: NO
gaaaggtgttgcatgatgtcgaaaactaaaaaagtaactagtgccggcagtaatggttcgggtaatccgttcggaataaaaagcggtagtggtggatttaatataggacaacaaatgttaaaaggtaaagctggcattaagtctactggtgataaacggaaatctgttagggtaccagttgaattatacgatgaagttgttaaagatttatcatacggggctaaatattcattaatgacagaaattttagctttatttttaaaagaatttgaaacacatggaaatagtatagttactgattttggcaagttgaaaacgagaccagtaaaaatttctgaagaagcctttaaagttttgaaagttataaaatttgaaacagatcaatctaatactaatattattgcttcagctttgacatggtatcttgataaaagaaaaggaaaagcataa

SEQ ID NO: 2079 - DNA (genomic), 1728 bp, Enterococcus faecium; double-stranded, circular
  misc_feature (B) LOCATION 1...1728
  hypothetical: NO
  anti-sense: NO
tcaaatcgttgggaacgctcccaaaaaagaaaggggaatccgatgtatacaaaacttttacaagcgatttatcgcgactcagatttgtctgagaaaaccgcctctatgattgaacaaaaagtcagtgtttatcagcagaagaaaggccaggcaggcaaactgcattgggacgaagaagatattttcttgattacttatggggatcaattttttgaagagcagcaaccaactttgcgtacatttaagaaattttatcaaaagtatttggcagatacatttagagttgtacatttcttgccatttttcccatatacatctgatgatggtttctccgttgtaaattatcaggcaatcaacgaccgtttgggcacatgggaagatatagaagaaatgagaagcgaaacacggttaatgttcgactttgtctgcaatcatatgtctgccgaaagtacttggtttcaggaatatttaaacttgaatgatacgtacaaagatttttttattgatttgccactggatacagatacaagcagcgtgactagaccaaggaccagcccgttacttacaacgttcattgacaaaaacgggaaagaaaaacacgtatggacgacttttagcgaagatcaagtagacttgaattttaaaaatccagaagttttattgaaaatgatcgatattcttttgttttacttagaaaaaggcgcttcatttattcgcttggacgctgtgggatttttatggaaagaactaggaacttcttgtatacacctgccagaaacgcataaaatcatccaattattccgtgcaatcgctgatgaagcagctccaggaacggtattgatcactgagacaaatgtgccacacaaagataatatcagttattttgggaatggcgagaatgaagcacagatggtctatcagttttcgctaccacctttgacccttcaagcgattcgttcgggtaatacaagtaagttgaaagaatggttaaaaaccatcgatttcgcatcgaaaaaaacaactttttttaattttttagcctcccatgacggtatcggattgaatccggtacgaggtattctgccggaaaaaacgatccttgaattagtggaacagctgaagaaagagggtgcccgagtaaactacaagaaaaacccagatggaacgaccagtccatatgagataaacgctacgtatctagatgcgttaagttctccaacagatacgacggaatggagaagcaaacgctttttagctgctcattcatttttggtaacgttaccaggcgtgccggcaatttatattcaaagtgtgctgggaagtcgaaatgattacaaaggcgtagaaaaaacaggagagaatcgaaaaatcaatcggcaaaaatttttgttagcagatattgagaaagagttgcagacagatccattaagaacagcagtatatggtgaattgacccagatgctatctattcgaaaaaaagaaaaagccttccatccgaatagtttgatttacttactggactcagcagattcttttatcagttttattcgcgaagcgaaggaagagaaagtcttagttatccataatttttccaatcaatcagcaggttatcttttaccaaaaggagattacctagacctgttttctggacaaattatccattgcagtcaagaacgaaagttgatattccagccgtatgaatatatgtggctgaaaataataaaataa

SEQ ID NO: 2080 - DNA (genomic), 1743 bp, Enterococcus faecium; double-stranded, circular
  misc_feature (B) LOCATION 1...1743
  hypothetical: NO
  anti-sense: NO
ataaacagttggaaagttatgaataagtttcggattctattttcaaaaggaaccttactaaatcgtctgttgcggaaatacgcggttatcatgatcggtgtaacgatgactgctaccgttatttttagtatccatacttgggaacaaaatcaaaaacaggcagaaaacatgacaagtgatgccgttcaaagcacaagcagaatgctgaatgataaaacaaccttgagtaggatcatcaaaaaccagcttgtagggaattccgaaaagatcgaaaatgtgacgacctacttaacaaaacccatagatcagtatctgatgtatgtatacgaacagcaaaacagtaccgatgaattagtttctttcccaaatcaaatcaaagatctctacgcaaattatgaagaactaagtgcgatatatatcgtgttgaatcaactaccggagtattatgaatcttctagagaaaacaaaggtggggaaataaaaaaggggacaccaaaattactagacgccttttatatcaagttgcctatcacacaaggaggagctgagtcaggaagtatttttattggttttcaaaagaaagaactagatatgattttagaaaatctaacgtcattcaatggactctctttatacatgatttctggaacgacaaatcgactatacacattccatgataataaaatagctaaagaaacgtttgaaagacaagaaatgatcatcacagagagtctgaagaaaaattcacaattgccgattgacgatctggaaaaaaacaattttgttcaacaccaagaactgtctgatgattatcgtatattagctgtactagataaaaaaagtgtaaaaatcgaaacgggaaaaaatcttgccccgctgatcattggtatcattattttagacaatatactgcttatctttctttataaaacattcaaacgatattcacagcaagtatctatcgtcatgcaggccatggatcaaacagcagcagggaatttagagacgcggatcgacataacaaacacggaatatgaactgaaggaactttcaatcggtatcaacgaaatgttggatagcatcaatcagtttgtagaagacatctacaaattagaaatcaaacagcaagacgcacatatgcgggcgcttcaagcacagatcaatccacactttttatataatacattagaatatatccgaatgtatgcaatcagcgaaggaagtgaagaattagcagatgttgtgtatgcgttttccgctttgcttcgaaacaatacgaatcaagagaaaacgatcactttaaaagaagaactggacttttgcgaaaaatatgtctatttgtatcaaatgcgttatcctaatcgagtagcctatcattttatgatcgatcctgatttggaaaagatcgaagtacctaaatttgtgatccagccattagttgaaaattattttaaacacggtattgattttactcgattcgataatgcgctaagtgtcaaagtcttgcaggaaggcaaacgggtaaggatcatcatcaaagataatggaaaagggatgactgaaaaacggctaaaacagattgaagaaaaactgtctcatcctaaagtggaacttcacggttctatcggtctgcaaaacgtgaatgaacgtttacgtgccagcttcggcagcagttattatatgtcgcttgagaataatgagacaggtggactgaccgtttctattacattcaaggagggatga

SEQ ID NO: 2081 - DNA (genomic), 324 bp, Enterococcus faecium; double-stranded, circular
  misc_feature (B) LOCATION 1...324
  hypothetical: NO
  anti-sense: NO
aaaagaagttggcaaggaggaatagacttgcctaagaaagtgaaaaaaaggcatctattagactatagcatcttgattccctatttaattttatgtgtattgggattgatcatggtatatagttctacgtcgtatctattattagaaaacggacaaaatccgtccgcatcagtcattaaccagagtattttttgggtgcttagcttgattgctatcgcactactttataaaatgaaaacagatgttttgaaaaaccagcgtttgatcatggcagccatcgcagttttgacgattttgctgctgattgttgtgttttcttggtaa

SEQ ID NO: 2082 - DNA (genomic), 204 bp, Enterococcus faecium; double-stranded, circular
  misc_feature (B) LOCATION 1...204
  hypothetical: NO
  anti-sense: NO
ccgaggagttggcaggagaacaccatttatttagaaataaggggtgcacgacgtttgtcgcacctccttatttatctattgtttcacttaaaatttttcagtaacgattttctgatttgcttaggtttaacgttagctatgtttatatcaagcttattatgtgggttaaattttttttgcactcataaaggacttaagaaataa

SEQ ID NO: 2083 - DNA (genomic), 645 bp, Enterococcus faecium; double-stranded, circular
  misc_feature (B) LOCATION 1...645
  hypothetical: NO
  anti-sense: NO
ttatttggttgcgcctattttagtagaaaaaagaaggagaatgaaatgggaaaagtgatttttaattcggatgattttggctatagccatggtgtgaattatgggattatggatgcttatcagcgaggaattttgacatcaactacattgatggcaaatatgccgggtttcgagcatgctgtgaaactaagaaaggaaatgcctaggctaggtgtaggagtccatttaacattgacgtgtggcaaaccactcctcaaaactgtcgatactcttatcgaaagcggagagttcagatccttatcttattatcagcatccatttaacattgacaaagatcaactgtatcaggaatggaatgctcagattcaaaaaatttatcatgcggggatcataccaactcatttagacagtcatcatcatactcatactttggatgaaaatcaggaggtagttgttacattagcaaaaaaatatgatttgccggttcggagcaactttgaacgaaaagatgaagttcgtcatgtcgattattttgacccttgttttgatgttcctagggagaaaactgatgaannaaaaacgacaaatcaatacgagtgtggaagaatatttggcaagtttactcatgatattgagagaagataa

SEQ ID NO: 2084 - DNA (genomic), 957 bp, Enterococcus faecium; double-stranded, circular
  misc_feature (B) LOCATION 1...957
  hypothetical: NO
  anti-sense: NO
aaagtaggttgccaaatgaataacgtaaaaatcaatgaactacgtcaatggatggcacaacaccaagtcgaattggcttatatcagcgaccctggccacatcgcttacttttccggatacgaaagtgatcctcatgagcgtgtactagctctttttatccctcttgaacaagatcctttccttttcactcctgctttggaagttgaagatgctcaaaacagtagttgggcgtatgatgtccgtggctatttagacagcgaaaacccttgggagatcatcggaaaagaacttcgtgctcgctatggtcagcctggcaatgtagggattgaaaagaacgccttgactgtcgagcgcttcgatgctatctctgatatcttgacgggaacggattcttacactgatctaacttccatcatccaacgtctacaactgatcaaaactctagaggaaaaagacaaactgatcgaagctggtaaatgggccgatgttgcatttgagattggctttaaagcagtgaaagaaggcgtgactgaacaagcgatcattgcagaaattgaataccaattgaaaaaacaaggtgtatcacaaatgtctttcgacacattagtccttgcaggagcaaatgctgcaagccctcatggtacaccaggaaatacgaagatttcaccgaatgaacttgtgttattcgatcttggcgttgtttggaatggctattgcagtgatgctactcgtacaattgcttatcaaaaaccaaccgacttccaagaaaaaatctacaacatcactcttgaagcacagcttgccgcacaagaagccgtccgtccaggtgtgacagcaggtgaacttgatcaaatcgcacgaaacgtgatcaacagctatggctacggcgaatatctcaatcaccgtataggtcacgggatcggaacaaccgtccacgaattcccttcccttgtgtaa

SEQ ID NO: 2085 - DNA (genomic), 696 bp, Enterococcus faecium; double-stranded, circular
  misc_feature (B) LOCATION 1...696
  hypothetical: NO
  anti-sense: NO
aatggaggttgtaaggtgcgttatatcgaaatatctgatttgaccttttactatgatgatgaacctgtactagaagatgtctcttatcatgtagatgcgggtgaatttgtcattttaactggagaaaatggagcagccaagtcaaccttggtgaaagcatcgttaggattactgaaaccttcaaaaggaatgataaagattgctgagaaaaatcaagaaggaaaaaaattaagtatcggttatattcctcaacaagttgcatctttcaatgcaggttttcctagtacggtgatcgaattagtccgttcaggaagatatccaagaggccgctggttcaagcgtctctctgaaaaagatcatcaacatgtacagcgtgctttagaagctgtagggatgtgggatatgcgaaatcggcgaataggtgaattgtctggcggacaaaagcagcgaatcagtttagcgcgtatttttgctactgaccctgacttatttgttcttgatgaaccaacaacaggtatggatgaagaatccagaaatgaattttatcgtcttctccgacatagtgcgcatgtccatgggaaatcagttctaatgatcacccatgatcatgaagatatcaaacagtatgcggacagacagatccgactggtgagaaaggaggattctcaatggcgttgctttcatatgaattcatga

SEQ ID NO: 2086 - DNA (genomic), 375 bp, Enterococcus faecium; double-stranded, circular
  misc_feature (B) LOCATION 1...375
  hypothetical: NO
  anti-sense: NO
aaagacttctgcagaagcaaacagaattatagattcgattatcactatgtacgaattgtagaggaggaaaacgaaatgaaaaaaccaacgctttcggagttgatagaagctactgagaaggcagcaaacccagacgattggtatcgtcaaagtttgatcttggagaagttccacggcatgtcaaaaactactttagttgaatactgcaaggaaatggaaacaattcctgaattttcagaaggaattgttcgtccaggacattcaaccacatttattcattaccatacttttatttggtttttaaaatggaaagacgcaaataaatatcgtgtaaaaatattgtctccttcagatgttttgaaggaagcaagttga

SEQ ID NO: 2087 - DNA (genomic), 396 bp, Enterococcus faecium; double-stranded, circular
  misc_feature (B) LOCATION 1...396
  hypothetical: NO
  anti-sense: NO
acaaatatctggagggagaaaatggttcaatcaatcaatacaaaagtagacttggtaattgatgctacttcgtttacgggtctgacagattacgggcaaatcatgataggtgataatggttttgagttttaccatgcgcgagatagacgcaaatatatccaaattccatgggaagaagtggattatgtactagcatcagtcatgctaaagggaaaatggattcctcgatatgccattcaaacgaaaaaaaatggtacatacacattttcttccaaagaacctaaaaaagtgcttcgtgcgatcagagaatatgtagatgaagatagaatggtacaatcattgagtttctttgatgtagtgaaacgtggtattcgtagtatgtttaaacgcaagtaa

SEQ ID NO: 2088 - DNA (genomic), 1221 bp, Enterococcus faecium; double-stranded, circular
  misc_feature (B) LOCATION 1...1221
  hypothetical: NO
  anti-sense: NO
accaattcctggaaaaatatttcggaacatcaacgcgaagtcatcacacgacggacggtctttgaaaaagaaaaagcagaagcaagagcacacatcttagaaggtttgcgtattgctttggatcatatcgatgaaatcattgcgattatccgcgggtctaaatcagatgacgaggcaaaagcaacaatgatcgaacggttcgatttatccgatcgccagtctcaagctattttagatatgcgtttacgccgattgaccggtttggaacgggaaaaaatcgaaaatgaataccaagaactcttaaaactgattgaagatttaactgacattctggcaagaccagaacgtgttacagaaatcatcaagaatgaattagcagacttgaatcaacgatttggtgataaacgacgcacagaattactagtcggtgaggtcttaagtctggaagatgaagatttaatcgaagaagaagaaatcgttattacattgacaaacaatggttacatcaaacgtttggcaaataatgaattcagagctcaacgaaggggtggacgtggtgtccaaggaatgggtatccacaatgacgacttcgtcaaaaatctggtttcttgttctacccatgatacattgttattctttacgaataacggaaaagtgtatcgggcaaaaggatacgaaattccagaatacgggcgtacagccaaaggaatcccaatcatcaatttactaggtatcgattcgagtgaaagcatccaggcaatcattgcggtgacgggagaagcagaagaaggccactatctcttctttacgacgcgtcaaggtacagtaaaacgtacttctgtcactgcttttgctaacatccgaagtaatggtctgatcgcaattggtttgaaagaagacgatgagctcgtcaatgtgctactgacagatggtcaatctaatatcattattggaacacataacggctactctgtcactttcaaagaagaagcagtccgcgatatgggacgtacagcttccggggtcagagggatacgcctgcgtgaggaagattatgtcgttggggcagccttaatgaaggaaaatcaagaagtattagtgatcacagaaaaaggttacggaaaacggacaaaagtatcggaatatccagtgaaaggccgcggaggtaaagggatcaaaacggcgaacatcactgaaaacaatggtccactagttggatag

SEQ ID NO: 2089 - DNA (genomic), 1578 bp, Enterococcus faecium; double-stranded, circular
  misc_feature (B) LOCATION 1...1578
  hypothetical: NO
  anti-sense: NO
tgtggatcctgtacgtcagtcaatagcagaatcttggccaaattcactagatgtttcttgtgcgcaagaggaatggggcttttcgccgaaatacgacttagatgtgatgacaaaggatatgttggaaaaactgaaagaaaaattggtagagacggtataaaacaagaaccacatccaaaaagttttttatacttttgggattggctatggtatgaaaggggacaagggatggaagaatatcaagccacgccagtaaaagaagtaaaaatagaaaatgaattaaaacgtacgatgggattttttactgctttatcgactgttatgggcacagtgatcggtgcaggggtattttttaaagccgcaagcgtagcagaagttacaggatccgccagtttgcatatgttttcttggtttctcggtggtatgatttctgtctgtgcaggactaacaggagctgaactggcagctgctattccagaaacaggagggatgattaaatatatcgaacggatttacggaaatacagcagcttttttattgggctgggcgcaagtcgtgatttattttccagcaaatgtagcagccttgtcgatcattttcggtacacagttcgtcaatctatttggtctttcccagtcaatgattgttcccgtagctgttacagctgctgtatcgatcctgttgatcaattttttaggttctaaagctggaggggcttttcagtcgattacgcttgtctgcaagcttattcctttgtttgtgatcgtcattttcggtttgttccgacaagaaggagtagacttccaactgtttccgatccaagcaggagaaaatctttcatttttctcagccttgggagcgggcttgctagcaacgatgttcgcatacgacggttggatacacgtaggaaatatttcgggagaattgaaaaagccggcgaaagatttgccaaaagcaatttctttaggaatcatcggaatcatgatcgtttatttattagtaaatgcggtgttcttaagaaccgcatctatcgacggagtcgcaggaaacagcaatgcggcaagtgacgttgcaaaaatgatttttggcggcttcggtggaagactggtcacagttggtatcttgatttctgtttatggaaccatcaatggctatacccttactggaatgcgtctcccttatgttatggcaaaagaaaacaacctgccttttagcaagctctttgctaaacttcatgataaaactaaagttcctgtagccgcaggtatcttagagctagtcatcgctattggcatgatgatgatcggtggttttgatacactaacggatatgctgatctttgtcatttggattttttatacgatggtctttgttggtgtcattcttcttcgtaaaaaagaacctgatttgtttcgaccatacaaagttccaatgtatccgtttattccactagtagcaatcattggagggacttttatcgtatcaagcacgcttatcactcagacctttttagcttcgatggggatagtattgacacttgctggtatcccgatttatctctatttaaaacgtagatag

SEQ ID NO: 2090 - DNA (genomic), 1122 bp, Enterococcus faecium; double-stranded, circular
  misc_feature (B) LOCATION 1...1122
  hypothetical: NO
  anti-sense: NO
tgcgaaccctgtggggaagacaggcagaatagaagtggtatgacgatcagttctgctgctactacagcacaatggaagggtcaccgaatcaacatcatcgacacaccaggacacgtagacttcacagttgaagttgaacgttcattgcgtgtacttgatggtgctgtaactgttcttgatgcacaatcaggtgttgaacctcaaactgaaacagtttggcgtcaagcaacaacttatggtgtacctcgtatcgtatttgcaaacaaaatggacaagatcggtgctgacttcttatattcagtatcaactttacatgaccgtttgcaagcaaacgctcacccaatccaattaccaattggtgcggaagacgacttcacaggaattatcgaccttgtaacaatgaaggctgaaatgtatacaaacgatcttggaacagagatcgaagaaacagaaattcctgaagaataccgcgaattagctgaagaatggcgcgaaaaattggttgaagctgtagctgaaactgatgaagaacttactttgaaatacttagaaggtgaagaaatcactgaagctgagttaaaagaaggtatccgccgcgcaacagttaacgtagaattctacccagtactatgtggttcagcatttaagaacaaaggggttcaattactattggacgctgttcttgattacttgccatcaccgttagatatcccagctatcaaagggattgaccctaaaactgatgaagaagtagaacgtcctgcagacgacagcgctcctttctcagctttagcatttaaagttatgactgacccattcgtaggtcgtttaactttcttccgtgtgtactctggtgttttacaatcaggttcatacgtacaaaacgcaacaaaaggcaaacgtgaacgtgttggtcgtatcctacagatgcatgccaactctcgttcagaaatctctgaagtttacgctggagatatcgctgctgctgttggtttgaaagacacaactactggggacacactatgtgatgaaaagagtctagttattcttgaatccatggaattcccagaaccagttatccaagtcgctattgaacgtaattcaaaagctgacccaagataa

SEQ ID NO: 2091 - DNA (genomic), 1875 bp, Enterococcus faecium; double-stranded, circular
  misc_feature (B) LOCATION 1...1875
  hypothetical: NO
  anti-sense: NO
aatttgccctgtcataaagaaccaataaaaaaggagttagttacattgaattatagaaacgatatccgtaacgtcgcaattattgcccacgttgaccacggaaaaacaacattagttgatgaactattaaaacaatcagatacattagacgcacatacgcaattgcaagaacgtgcgatggactcaaatgcgctagaaaaagaacgtggtatcacgattttagccaaaaacacagctgtagactataaaggtattcgcgtaaacatcatggatactccaggacacgcggacttcggtggcgaagtagaacggatcatgaaaatggttgacggcgttgtgttggtcgtacatgcgtatgaaggaacaatgcctcaaacacgttttgtattgaaaaaagcactggaacaacatatcacaccaatcgttgtcgtaaacaagattgacaaaccttctgctcgtcctgagcatgtcgtagatgaagttcttgaactattcatcgaattaggagcagatgatgatcagttagactttcctgtgatttatgcatctgcactaaatggtacgtcaagcttgtcagatgatccagcagatcaagaaccaaccatggcacctatttttgatacaattattgaaaaaatccctgctcctgtcgataacagcgacgaaccattacaattccaagtttcattacttgactacaacgattatgtaggtcgtatcggaatcggacgtgtatttagaggaacaatcaaagtaggagaccaagtagcattaattaaattagacggaacagttaagaaattccgtgtaacgaaattatttggtttctttggactaaaacgtctagagattcaagaagcaaaagctggagacttgattgctgtctcaggtatggaagatatctttgtcggtgaaacagttactcctgtggatcatcaagatgcgttacctatccttcacattgacgaaccaacattgcaaatgactttcttagttaataattcaccatttgccggtcgagaaggtaaattcgtaaccgctcgtaagattgaagaacgtttgatggcagaacttcaaacagatgtatccttacgagttgaaccaacaaactctccagatgcatggacagtttctggtcgtggagaattgcatttgtctatcttgattgaaaacatgcgccgtgagggatacgaattgcaagtatctcgtccagaagttattgaaaaagaaatcgacggtgtaaaatgcgaaccgtttgaacgcgtgcaaatcgatacaccagaagaatatatgggtagtgttatcgagtccttgagcttacgtaaaggtgaaatgcaagatatggtccatacaggaaacggacaaatccgtttgacattcttaacacctgcccgcggtttgattggttattcaactgaattcctttcaatgacacgtggttacggaatcatgaaccatacttttgaccaatatctgccaatgcttcctggtcaaattggcggacgtcaccaaggggcgcttgtttcgatcgatacaggaaaagcaacgacttattctatcatgagtatcgaagaacgcggtacagtcttcgtagaaccaggtacagaagtatatgaaggaatgattatcggggaaaacagccgtgataatgatttgactgtcaacatcacgaaagcaaaacaaatgacaaacgtacggtctgctactaaagaccaaacatctgtcatcaaaaaaccaaaacaattgacgttggaagaatctttggaattcttgaatgatgatgaatattgcgaagtaacaccagaaagcattcgcttgagaaaacaaattttagagaaaaatgctcgtgaaaaagcatctaaaaagaaaaaataa

SEQ ID NO: 2092 - DNA (genomic), 606 bp, Enterococcus faecium; double-stranded, circular
  misc_feature (B) LOCATION 1...606
  hypothetical: NO
  anti-sense: NO
gacagcacctgggtgaagccgattgatttgccagaaaaatatgagaatttaatgcgagtggcacaacaagcactagcaaaccagcaatatcagcaggcaaaagaattatttcaacgagcttacgagttgaaagaaagctttgaggctaatagcctgcttgttttttgtctttacgagttggacgagaaaaaagaagcattgaagcaagcactcttgcatgaaaaacagtatcttcaaaatgaggagtttgctgaattttattttgacttgttaatcagtacacaagattttttatatgctagaaaattgatagcaagtacagatttttatgaagctttcgagcagcgggtcattgaaaaaatccaatttgcagaagaattatccggacaaatggagaggcagaagatcaaggcactccacaataaatcggaggaacttccttcgttggaacctgcacgtcagcttgcgtctattgatgagatcgaacagcttccttatcatgagtttatccaaacagcgagtaaacttattgtatcgccagaggtccatattttagcaagggcaaaattactggagacacttaggcaattgaacgaatgccatcct

SEQ ID NO: 2093 - DNA (genomic), 777 bp, Enterococcus faecium; double-stranded, circular
  misc_feature (B) LOCATION 1...777
  hypothetical: NO
  anti-sense: NO
tccaatcgactgatatgtttagtaaataaagaaagaggaatgtcaatgatgaaaaaagaaatcgtattaacagcagcaatgatgttattcagcatggtagcaagtacgacttttgtttctgcaactgaagtatacccaaaggaatataacacagaaggaacgattacatttgaagcaggagatgagggtgtaactcctcctgttgatccagagaatcctgatcccaataaacctgtcgatccatcagatcctccaagccctggaacaggaggggcattatcgattgattatggatcaaaattcaaatttgggactcaaaaaatttctactgcggataaaacgtattatgcagctgctgatgtgatgaacgatgggtctagaaaaccgacatatgtccaagtgacagataggagaagtaccttatctgggtggaaattaagtgtctctcaaccagaacagtttaaaactgccagtggggatgaactagttggagcacagctgaaatttacgaaagggcaggctgtttctttggttgatccaacatatacgccgcaaacggtgaattctgaattaacgttgacaccgggaggaaacaatacgttagcaattaatgctaaatcaggaacaggtgtggggacttgggtctatcgatttggtgcaaatgaaaatgaaaatcaagatgcggtacagctttcggtacccggtaaatctgtcaagttagcgcaacaatattccactaaattagtttggacattagaagatacacctaacaactag

SEQ ID NO: 2094 - DNA (genomic), 690 bp, Enterococcus faecium; double-stranded, circular
  misc_feature (B) LOCATION 1...690
  hypothetical: NO
  anti-sense: NO
aacaatcactggatgaatggagcttctaatatgaaaaattcgagatggcagtggatggaatatgctggattgttcagcctatttctgacactgatcagtctggcagttggtgtgacgatcaactttcgaccactatacgtatttgatatcggacatttgcaaattttggattatacttctttagatcaagagacgttactgaaaaattttgatcacctaatgaattatctcaataatcccttcaaaaccatcctcagcttgccagatttcccagtttctgctagcggagcccatcacttttatgaagtgaaaattttgtttttagtggattatgctgtgtttttcatcactttgatcccgagtattttgtttatcaaatatttgcaaaagaatgatcggctttggcggttgattcgtccgtttcaaatcggcatgttactgccagttgttttcggttttttcatgatgataggatttgatcgcttttttatcctttttcatgaaacgtttttcaacaacgatgactggttattcgatcccgttactgatccaatcatcaatgtacttccagaagaatttttcatgcatagctttatcttattttttgtattattagaattattttttgctgtttttcttttcttaggaaaaaatagcttgaaacaaacaaaaaagaaagaactcgtctaa

SEQ ID NO: 2095 - DNA (genomic), 918 bp, Enterococcus faecium; double-stranded, circular
  misc_feature (B) LOCATION 1...918
  hypothetical: NO
  anti-sense: NO
caggcccactgggaaatcatgggattgaatatcaaaactccatttcgtgtgtttcctaatggattccctgatgatctgatcaaacaaatcgaagaattttctggccgtaaagtcgtatgtaacaaaccttatagcggaacagctgttattgacgattacggtgaacaccaaatgaaaacaggcgatttaattgtatatacttctgccgatcctgtccttcagatcgcggcacatgaagaaatcattcctttagaagaattatatcggatttgccaattcgttcgtgatataacaaaagatgatccgtatatgattggccgaatcattgcacgtccgtacgtgggtgaaccaggagacttcacacgaacaagcaatcgccatgattatgcgttgaatccattcggacacacagtccttgattctttgaaagaagcaggaaaggacgtgattgctgttggaaagatcaacgatattttcaacggacaaggaatcactgaatctgtccgcacgaaaagcaatatggatggcgttgaccagctgctgaaagttatgaaaaacgatttttcaggaatcagctttaccaatttagtagattttgatgcattatacggtcatcgtcgggatgtagtcggctatgcgcatgcgattgaagaatttgacttacgaattccagaattgcttgaagcgatggaagaagacgacttgctaatgattacagccgatcacggaaacgatccgacgtttactggtaccgatcatacgcgagaatatgtaccgttattggtttacagtaaaaaaatgaaagaacaaggggcattgcctcaaggatattattcagatatttcagcaacgattgctgagaactttagtgtttcttcgactgaaaatggcgaaagcttcttgaaattattaaaataa

SEQ ID NO: 2096 - DNA (genomic), 318 bp, Enterococcus faecium; double-stranded, circular
  misc_feature (B) LOCATION 1...318
  hypothetical: NO
  anti-sense: NO
agctataactgcatctcattgttgagatgtagtttttacatattagatcactcgttgagtggtctttttattttgcgtaaaggagactgcataatgaggaactactggtatgtatcattatcaaataaatatccgcaaccaaacgcagatgatccaattagagttgtccaatcagtccagattaaaaagaagtactccattgttgaaatgaccagagaagctacgccaaatgaaattgataaatgcaaacttatttattgcggtcatggatattttagtgagcagaacatacagacaaatataaaaaaatatcattaa

SEQ ID NO: 2097 - DNA (genomic), 432 bp, Enterococcus faecium; double-stranded, circular
  misc_feature (B) LOCATION 1...432
  hypothetical: NO
  anti-sense: NO
ttattgaactgggcttgctctcgggggaatcgaggcgagaagcatggcgaaaaagtcgatggttcacatgataaaatcaaattgctagatggttatcagccaaatacacatatgtctgcttggaatacaggaaacaacaagattctatatacacaagagtctattacggatgacatgattgccaaacgtgatcaatcgattgctgatgcagaaacttcaccgattttaggattcagcttcaacactgacagtgtcaaaacagaattaagtaatatttctaatgtcatgaatcaatatttagatggattgaatacagggactgttgatccagatgaaacattaccgaaattgaaagacgctttggacaaggctggctatgataaggtattgaaagaaatgcaaaaacaatatgatgagttccgacaagaataa

SEQ ID NO: 2098 - DNA (genomic), 579 bp, Enterococcus faecium; double-stranded, circular
  misc_feature (B) LOCATION 1...579
  hypothetical: NO
  anti-sense: NO
aaggaagactgtatcgtgaaagaaaatcaagaagaactagataaagaaatgacagatgctcagccagaaccggaaatcgatgtcgaagctgcagaagattcgggtatttcagaagctgaagcggaagaattcgaaacagcgaaattaaaagctgagttagaagaaatggaagataaatacttgcgggctcgtgctgaaatcgcaaatatggcaaatcgaggaaaaaatgagcgtgagcaattacaaaaataccgttcacaagatttagccaaaaaattacttccatcaattgacaacctggaacgtgcattagccacagaagtgtcagatgatcaaggggcaggtttgaaaaaaggcgtggaaatggtcttggaaagtttgcgtaacgcactggaagaagaaggaattgaaaaaatccctgctaaaggagaagcctttgatcctaatcttcatcaagcagtacaaactgttccagcgactgaagatacaccagccgatacgattgtagaagtactacaagaaggctacaaattacatgatcgcgtgttaagaccaaccatggtcattgttgcacaataa

SEQ ID NO: 2099 - DNA (genomic), 978 bp, Enterococcus faecium; double-stranded, circular
  misc_feature (B) LOCATION 1...978
  hypothetical: NO
  anti-sense: NO
ttgctggactgtactttgctagacgcaagcacagtcagatttagtctttttgcaagaattggaaaaaggagcagcggattacgcaaatgctcctttttcttttattatcaaacagtcatcacaaggagaacacaaatgaaaccaaagaaaaggaaacttctagatctgctgatgcttttcttgcttctctcaggaatagggatactagcttatccatttgttagcgacgcgctgaataattatctggatcagcagatcatctctcattatcagcaacaagcggtcaaagaaaatgaagaagtcatggctaaaatccaagaaaacatgacaaagaaaaaccagcaattagcaaaagaaggtggaaatccaggtgcagatccctttactaagaaaaaagaacctgcgaaaaaggatagaacctattttgagaaacatacgatcggtattttgacgatccctgagatcaatgtccatttgccaatttttgatgaaacgaatactgtgctgctagaaaaaggtgcctcattattggaaggaacgtcttatcctacggggggagaaaatacacatgccgttatttccagccatcgaggactgcctcaagcaaagttgttcacagacttaccgaaactgactttaggtgattctttctatatcgaaatcaatggacggacactcgcttatcaagtcgatcagatcaagacggtagaaccgactgatacaaaagatctgagaatcgaaaaagggcaggatttcgtgacactcctaacttgtacaccttatatggtcaacagtcatcgcttacttgtcagagggcaccgggttccttatcatgcaaaagaagttcaaaaagaagtacagaaagtatccgagaacaaacgatttttcctgtatggattgttagctgcatgtatactgattttcctccttcttatatatctttttcgtcaatcgttcaaaataagaaacagaagttag

SEQ ID NO: 2100 - DNA (genomic), 1110 bp, Enterococcus faecium; double-stranded, circular
  misc_feature (B) LOCATION 1...1110
  hypothetical: NO
  anti-sense: NO
agtttttgctgcgatcatttgtgtcattctattgagtttattgctgaatggcgcttgttcattattgaaaaaagggtattatcgtatgctttatattttttaagaaaaggggatcaaatgaaaaaattatggcttttattaccgctactgttgcttttatccgcttgtggcactgcaaaagaaacaagtagcaaacaagaaataaaggatttgaaaaaagtgacacttgttttggattatgtaccgaatactaatcatactggcatctacctagcaaaagaaaaaggctattataaagaggctggtttaaatgtccaaatcatcgaaccaggagataattcgacaagtattggtctagtaggtgcggacaaagcacaatttggtgtaagttatcaagaagatgtcacttatgctcacgcagatggacagaatataccagtcaaagcaattgctacagtgatcaaacataatacttctggattcgccaccctatcagacagtaacatccattcaccaaaagattttgaaggaaaaacatatgcaggttggcaaagtccaagtgaagaagctgtcttaaaagctgtgatggaaaaagacggcggggacttttcaaaactgacaatggtaggaagcaatggagaagggccagaaagcttaggaaaatcctcagatatccaatggtactttgaaggttgggatatgatcaaagcaaaagaagcgggtattgaactaaactatatcccattgaaagaattagatgaacggttagattactatactccggtaattattacgaatgatcaactgatcaaaagtgatccagaattggtacagtcttttatggatgccacgaaaaaaggctatcaggaagctattaaggatccaaatgacagtgctaaactgttgcaaaaatatgcaaaagaaaatgatcggacgtttttagaagaatcacaagcattcttgtcaaaaaattatacggatgatcctgagaattggggattgatggaagaaaaagtttggcgcaattatacagcttttatgcaggaaaacggattgatcaagcaagatgtaccttcgcaagaactattcactaatcagtttataaaatag

SEQ ID NO: 2101 - DNA (genomic), 606 bp, Enterococcus faecium; double-stranded, circular
  misc_feature (B) LOCATION 1...606
  hypothetical: NO
  anti-sense: NO
ttcgtttgctgtacggatgattttatcgtctacatccgtgaaattcgatacgaaatcgactttatagcctcgatattcaaaatagcgtcgaattgtatcgaaagcaatggtgctacgagcatttccgatatggatataattatacacagtcggtccgcagacatacataccgacatgtcccttttgtatagggatgaattcttctttttttctggtcaatgtattgtagatttttatcattctgatctcctcactttttctcctttgattcgaacgacttttgctggtactcctaccgctgtagcgtcgtctggaacatctttcaacacaacggcacctgcaccgattttggcgttttttccgatcgttaccggtcctaatatctgcgcattcgcagagagcatggctccttgtttaacagttgggtgtcttttacccgtttcttttcctgtgccgcctaatgttacgccatggaataaaatcacatcgtcctcgatttctgcggtttcgccaatgacgattcccattccatggtcgatgaacacgccagttccaatcgttgctcctggatggatctcaacaccagttaggaaacgccagaattga

SEQ ID NO: 2102 - DNA (genomic), 654 bp, Enterococcus faecium; double-stranded, circular
  misc_feature (B) LOCATION 1...654
  hypothetical: NO
  anti-sense: NO
ctggcttgctggtataaaatacaaaaaagcaaagttacttttaaaagctttggaaatattttccaaagctttttcacttgttcaatcatcaaaggagaaatgacaatgaattattgctatgtatttatcggtccttctggttctggaaaaacttcactcgcagaagctatttttcagccggaacaaaagatcattacttacacgaatcgatcaccaagacctggggaaaaagatcaagaggattattattttgtttctgacaatacattcaatcagatgatcaagggaaatgagtttgcagagtgggaccaatatgctcaacataaatatggttccagtaaagcagaaattaaaaagaaactgacagtaggaaattgttacgccgttttgacagcaaatggtttttggcatttatatgagtatttcgggacggtagtccgtcctatctttattacgatctctaaagaaacattgcaatcgcgcctgaaaaaacgtggagattcatctgaacagatttcagccagactggcggtttatgtagaagatttagcacagttgaaacgtttgaaagctatcccctcacttttagtcgtgtcaaacgatggagcgttccaagaagctgcagataaaataaaaaaaggattattgatataa

SEQ ID NO: 2103 - DNA (genomic), 747 bp, Enterococcus faecium; double-stranded, circular
  misc_feature (B) LOCATION 1...747
  hypothetical: NO
  anti-sense: NO
aacaattgctgtttcacaatgaaaggaatatttatgataccagaagaatttcgccaatccttggcagaaaaagggatagagcttaccgatcatcaaatgaatcaattcgctatttattatcggacattagtcgaatggaacgaaaagatgaaccttacagctattacggatgaaaaagacgtatatctgaagcatttttacgattcacttacattagcatttgaagtagactttacgcaacctttatctttatgcgatgttggttcgggggcagggtttcctagcatacctttaaaaattgcctttccagaactgcagataacgatcgttgattctctgaataaacgaataaccttcttatctgagttaacccgattattaggaatcgatgcttccttatatcatgaccgggcagaaacatttgggcaaaatcctcactttcgtgcatcatttgaccttgtcactgctcgtgcggttgctcgtttgaatgtgttagcggaattgtgtttgcccttggctaaacaagaaggctatttttatgcattgaaagcagcaaaaagtgaagaggaattgacagaagcaaaacaagcgattgctttattaggtggtaaattcctcaaagaagaggcggttaccttgccgaatgtctctgatcaacggcatatcatcgttattcaaaaaaagaaaccaaccccaaagaaatacccaagaaagcccggactgcctaataagcagccaatcaaatag

SEQ ID NO: 2104 - DNA (genomic), 771 bp, Enterococcus faecium; double-stranded, circular
  misc_feature (B) LOCATION 1...771
  hypothetical: NO
  anti-sense: NO
tacagacgactatttttttcattttggagggaatccatgcttcacgaagacgaacgaatcgaccaattatacgcagaagatatcaagattatccaaagttccaaagtgttttctttttctttagatgctgtgctgcttgctcacttttcccgtgtacctaaaaaagggaagattgttgacctttgtgcaggaaatggcgcagttggactttttttaagtaaacgaacccaggcggctatcgacgctatcgaacttcaacctcgtctagcagacatggcaagacgtagtatcgcgcttaaccatttaaatgaacaaatgactgtccacaccatcgatctgaaagacagcttatctgtcgttcgacataattcttgtgacttagtcgtctgtaatccaccttatttcaaagggctgccaacaaataaaacgaaccctaataaacacctggcaatcgcccgtcatgagattcatacgacgttagaagaagtgatcgatatttcaagtaagctactaaaaacaaatggacgctttactatggtccatcgtcctgatcggttcttagaaatcattcaggtcatggaagactatcgaattgcacctaaaaggatccaatttgtttacccaaaacctggaaaagaggcaaatattttgttagttgaaggaatcaaagaaggcaaattagacggattcaaagtcgctccaccattgatcacttacaatatggatggagaatacactgcagagattcgtgagatgctctatggcaaatga

SEQ ID NO: 2105 - DNA (genomic), 258 bp, Enterococcus faecium; double-stranded, circular
  misc_feature (B) LOCATION 1...258
  hypothetical: NO
  anti-sense: NO
acaggacgctgtttcgtttctaagaagattttcccaatatatttcccgatgattccaagacataacaattggattccaccaatgaacaggaagatcgagaccatggaaggccatcctgatgtaggatcaccaaacaacaatgcccgcaaaataatgaacaaaattgcaataccagaaccgacacaagacaaagcgccgataaatgaagcaatcgttaacggtgcatccgagaagttcacgataccatcaatcgagtag

SEQ ID NO: 2106 - DNA (genomic), 309 bp, Enterococcus faecium; double-stranded, circular
  misc_feature (B) LOCATION 1...309
  hypothetical: NO
  anti-sense: NO
aaggtaagctggaattaccttgcgggaaagaggtgtagaatcatgggttttacagatgaaaccgtacgttttggttttgacgatagtcgcaaaaaagaagtgagcgaaacattagcgattgtntatcgggctttggaagaaaaaggctacaatccaatcaatcagattgtcggctacttgctttctggagacccggcctacattcctcgttatcgtgatgctcgaaatttgattcgccgtcacgaacgcgatgagatcatggaagtaattgtcaaggactacctctcaaatcatggagtgaatttatga

SEQ ID NO: 2107 - DNA (genomic), 252 bp, Enterococcus faecium; double-stranded, circular
  misc_feature (B) LOCATION 1...252
  hypothetical: NO
  anti-sense: NO
cgctcaagctgtggctgtacgggagtatcattatctgacagcacaggtcatggcgataaaagaggacaaatcttttacaagaacacagataggttgtcgctcacttttgcaggagaaaggtcatggcgtatctgtttcaacggctcgctgtctgtcaaaggtattgaattgctttattcagttgtcaaagagcgattgaaagaagaaaatcatctttcctatatatcgcgttggaaaagagtaaaagcgtaa

SEQ ID NO: 2108 - DNA (genomic), 672 bp, Enterococcus faecium; double-stranded, circular
  misc_feature (B) LOCATION 1...672
  hypothetical: NO
  anti-sense: NO
tcgaggagctggattggttttatgaatgatgaatataagaatgatgaagataagatgctttttgaagagatagagaatcgatgtaggctcaattttgagcttcggggaaagatgtctttaatacaacaaaaaaagtatttagcgaataaatcagagtttactctgggacatgttgaaaaattaatctcggattggattagtagtagaagcgaatttacaaaaataaaacagccgattaaatttgacatgaaaaaacttttgttaaataagagtgagataggtaatagagatcaatatattagagctaaagggcaagaaataattgattcattaggtgaaatgaggtcatacaattatttgtatgtaacacatagagctgatggaatggtcattactgtggggaaatcttcttctaatgatatttttttagatggagatcttttttatcaactcaatacaaatcacttgtctggcactgaaaatataattttaaggacggaatatggcaatgaaatatttgcaaaatatgatgagattttaaaaaattatttggactgggcttggataattccggttgagtcaggagatgctaagaaactggagagattattgggcgatgaactaattaataaaaaagtaccaattttaaattattattcccatagacaataa

SEQ ID NO: 2109 - DNA (genomic), 579 bp, Enterococcus faecium; double-stranded, circular
  misc_feature (B) LOCATION 1...579
  hypothetical: NO
  anti-sense: NO
agacatggctgtctagacttggaagtagatgaacgtgcgcgacttggcttatttttagctatgcaatatccaagtgagataccaggtatcacgaatgcggaattcatgcgtgcagcgatcaatgcgaaacgtgatgaaaacgacaaaatttctgttatggcatttttgaaaaagttagatgaaaaaatggctttactaaatatgccagaagaaatggctgaacgttatctgaacgaaggtttttctggcggagaaaagaaacggaatgagatcctgcaattgttgatgttagaacctacatttgcaattttagacgaaatcgattcaggtctggatatcgatgctttgaaagtcgttgctaaaggagtaaatgaaatgcgcggagacaatttcggtgcattgatcatcacccactatcaacgattattgaactatatcacacctgatgtcgttcacatcatgatggaaggccgagtagtcatgacagggaatgctgacctagctaaacgtctggaagcagaaggctacgctggtatcagtaaagaattaggaatcgactataaagaagaagaagcgtga

SEQ ID NO: 2110 - DNA (genomic), 663 bp, Enterococcus faecium; double-stranded, circular
  misc_feature (B) LOCATION 1...663
  hypothetical: NO
  anti-sense: NO
ttcttaggctgtatgcgtatcaacaatgcgggagatccagtaaaagtgattgagacagcttatgaaaacggcattgatttttttgaccatgcagatatttatggaaacggtgaatgtgaagaaatctttgcagatgctctagcaaaaacatcaatcaaacgagaagatctttttattcaaacaaaatgtggaatcgttccaggtgtgatgtttgatttttctaaaaaacatatcattgaatctgtagaaaaaagtttgacccgtctgaaaatggattatgtggatgctttacttcttcatcgtccagatacattggtagaaccagaggaagtagctgaagcgtttgatgaattggaacggtcaggaaaagttcgttattttggcgtcagcaatcaaaaaccaatgcaaatcgaattgctgaaaaaatatgttcgtcaaccattagtagctaatcagctgcaatttggcttgaaacatactggaatgatcgatcaagggattcatgtcaatatgacagatgaagcaagtatcgatcatgacggtagtgtacttgattattcccgattgcatgatatgacgatccaagcatggtcaccataccagtatggattttttgaaggtgtatttatcgggaacgaaaaattccggctctttgtcaaatga

SEQ ID NO: 2111 - DNA (genomic), 1047 bp, Enterococcus faecium; double-stranded, circular
  misc_feature (B) LOCATION 1...1047
  hypothetical: NO
  anti-sense: NO
gtgctcagacttacaaatcgtaaagaggtgtcttttttgaaaaatattattttaacgggagatcgaccaactgggaagctgcatttagggcattacgtcggttctctaaaaacccgagtggctatgcaggcagatgaagacaaccaactgtttgtcatgattgctgacatgcaagcactgacagataatgctaaaaatcctgagaaggtttcatcaaatgtcttgcaagttgctttagactatttagccgtgggattagatcctgcaaaatctactttatttatccaatcacaaattccggaattagctgaattaaccatgtattatttgaacttagtcagcgtaggacgcgttcggcgcaatccgactgtcaaaacagaaatcgaacaaaaaaaattcggtgaaagcgtgcctacaggattctttatctatcctgtttctcaagcagcagatatcactgcattcaaagcgaatcttgtacctgttggtgaggatcaaaaaccaatgctagagcagacacaggaaatcgtacaaagcttcaatcatacatatggtgaagtcttggtggaaccaaaaggcgtattcccaccaaaaggaatgggtagattacctggaatcgatggaaatggcaaaatgagtaaatcgttaggaaacggtatttatatctccgatcctgccgatgtcttacagaaaaaagtcatgagtatgtatactgatccaaaccacatccatgtacaagatcctggacaagtagaagggaatatggtcttcacctacttggatgtattcggaacagataaagaagcaattgaagaaatgaaagctcattaccgccgcggcggacttggtgatgtaaagatcaaacgatacctcattgatgtattggaagctgaatttgcaccgatccgtgcgcgccgagaagaattggaaaaagatccttcagctgttatggaaatcttacgtaaaggtagtgaagaagctgctaaagtagctgcacaaacactttctgaagtaaaatcagcaatgggaatcaattacttccattaa

SEQ ID NO: 2112 - DNA (genomic), 264 bp, Enterococcus faecium; double-stranded, circular
  misc_feature (B) LOCATION 1...264
  hypothetical: NO
  anti-sense: NO
accccaagactgaacaaaagacttcctgaaatcagtgaaaagaaatgtgaggagatcatttccacttttggaacaatctctaaaacaacaggaaaaagcagacttcccgctacagtcttaaaaaatactgattttcctaataggacagcggctagaagcagcatcataagattgatgctccaaacagtaactgagcgttggatagaaaaggccgtttcaactaaatgtccgatggcgcccactccggcggaagctatatcgtga

SEQ ID NO: 2113 - DNA (genomic), 708 bp, Enterococcus faecium; double-stranded, circular
  misc_feature (B) LOCATION 1...708
  hypothetical: NO
  anti-sense: NO
atttctttatgcctagagaggattatgaaaaattttatcaactatgggttaattcagaaaaaagtaaaaaatatcccatacagaaggcttctaaaaattataatgatcataattcttttaccaatatccgcgatggcagatataacatttattaaaacttatcaaagagatttagatatagtccatggaattactattgatattttcccgttagatgttgcccctgtttcgaaatttagccgtaaaattcaaaaactatgggctttagtatatgctttattttgttctcaagtcgtccctgaaaaacatggtggaataatggctacaggtagtaagatactcttatctattttccgctcacctcgtacgagatataagatatggtcttttgctgaaaaacaaatgacaaaatataataatgaaccaacgggctatgtgactgaactttgtgtcggacctaaatacatgggaaatgtttatcctgcaaaagactttgaatctgctgtgtgggtgccattcgaagatacagagatgccagtaccagttggttatgataattatttaagtcaagtttttggtgactatatgcagcttccgcctgaaaaagatcaggtttctcatcatgaagcagtttatattgatccagaacatccatacacaatgtacaaaggaaaatattatttaactaaaggagcagaaaaaaaatga

SEQ ID NO: 2114 - DNA (genomic), 603 bp, Enterococcus faecium; double-stranded, circular
  misc_feature (B) LOCATION 1...603
  hypothetical: NO
  anti-sense: NO
acgaatttatggaggaattattttatgtctgaggagttattgcgcgctgcacgtaatggtgacgaagaagcatttgctgccctgtatcaaaaatattttccacttttactacgtttgaaaaacacctattatttaagaaattatgtttctgaggattgggaacaagaagcaaggatcgctttatatcaggcattgagaacttacgaaaaaagcaaaggtgttagctttggaagttattataaaagcattataagcaatcaaatctattctctgttgaggaagcagaacgcgctgaagcgtcgtgatcaaaaagatgaagtctcaatcgaccaaaaaatagagacagaaggaccagactttttagcagagatcacattgcaagaacctttagcgattcagcatcttttattaaaagaagcaatcgaaaattgcgaaatccagttttcaaaaatagaagctaaaatttttcattattatatgcaaggcgttgattttgtagacatggctgaatgtttagcaatggatcacaagcaagtaatgagcgcttacgggagagtaaaactcaaaataaaaaaacacttgaaattttataatgaggaataa

SEQ ID NO: 2115 - DNA (genomic), 615 bp, Enterococcus faecium; double-stranded, circular
  misc_feature (B) LOCATION 1...615
  hypothetical: NO
  anti-sense: NO
atgagtttatgttattttgactattatcaccaattggaagagaaattaaggatagaagagccgctgatgcttcaagctggcacttggatcgcgaaacaaattaatcaaggtggtagattgcagatatatgctagccgcacactaagtggtgtagcatttgaattttgggatcaaaccccggatcttgtaccaagtatattgattgaaaatccagccggaggtgtctatgaaacgctagaaggtgcaggacaggcaattattgatcagctttctgtcaaatcagaagacatttttcttcttctttcgaatgaaggaagaaacccggcaatcatcgaactagctcagtggatcaaagaaaatggtcatccattaatcattgttactggatttgatttgtcacgaagtatcaaatcgcaacatagcagtggtttgcgattatttgaatttgctgatttggttttggacaaccacgccaatttacatgatgcagtcttgactttgccaaatctagatccagcgatctgcggaacagcctctcttgcaacgatctttttgctgcagcaagttttgtattttacagcaaaacagctagtccaggacacaagtggaaaatag

SEQ ID NO: 2116 - DNA (genomic), 711 bp, Enterococcus faecium; double-stranded, circular
  misc_feature (B) LOCATION 1...711
  hypothetical: NO
  anti-sense: NO
gggaagttatgtttctttattagaaatagctgtttagaaggaggagagattatgagtcatgatcatttatgtgtttcatttgttcctttgttcaatcacttagtacagcaagatcaagaaaaagtacacgcacttgtcaaacatcactatgtggaaaaaggagaacagattcttgcgccgaatggagaacctcaattagtgatcgtggcctccggcagtatgaaagtgtatcaattatctgctagcggaaaggaacagcttttacgagtaatagagccgggcggatatgagggagagagccagttgctaggcgttccaaatgagtctttatttggcgaagcactagaaaaaacggaaatttgcatattgagacaaaaagatttctcggaactcttactgcattatcccgcccttagtctgaaacttttagcaatcaacgttgagaaattaacaaaagtacagcagcagacaacttttttgatgatggaaaaagtagaagaacgagtcgctgtctatctgcttgacttagctaaagcgacagggaaggatcactttttcctgccaatgaaaatgaaagaacttgctgcatttatcggtacgacccccgaaactttatctagaaaatttaaattattagaggagaatggttatgttaaaagaaagaatcgagaagtctggatcattgataaagagcagttagaagacttgtaa

SEQ ID NO: 2117 - DNA (genomic), 1245 bp, Enterococcus faecium; double-stranded, circular
  misc_feature (B) LOCATION 1...1245
  hypothetical: NO
  anti-sense: NO
cacgatatatgtttggtatgttctgcaagacagatgaatatggaggtggagacaatgtcttccaaagaactaacaatgtatttagagaaagaattggatcaactgaaagaaaaggggttatacaatacgatcgacatactagaaagtgaaaatggtgcttgtatcatcgtagacggaaaaaagatgatcaatctagcatccaacaattatcttggatttgccaatcgcgaagaattgaaaaaagcatgtattgaagcaaccgaaacttatggtgtaggagcaggagcagtccgaacgatcaatggttcgctgaaaatccatcagcaattagaagaaaaaatcgcagaattcaaagggacagaagcagcaatcgcctttcaatctggattcaactgcaatatgggcgctatctctgcagtaatgacaaaagaagatgctatcttatcggatgaattaaaccatgcatctattattgacggttgccgcttatccggagcaaaaatcatccgaattaaacatcaagatatgaaagaccttgagaaaaaagcaaaggaagcgatagaaagtaagaaatataaaaaaatcatgtatatcacagatggtgttttctccatggatggagacattgcacgattgccggaaattattccgattgttgaaaaatatggactgatcacctacgtcgatgatgcgcacggctcaggcgtaactggaaaaggtgcaggaaccgtcaagcattttggattaagcgacaaaatcgatatgcaaatgggcacgttatcgaaagctataggtgttgttgggggttatgtagctggatcgaaaacactaatcgactggttgaaagctagaagtcggccattcctattttctacttcgctaactccaggtgcagctgcagctgcattggcttcgattactttgatgcaagaacatccggaacttgtcgaaaaagtttgggaaaatgctaattattttaaagaagaattgaaaaaagtaggctataacatcggtatgtctgaaacacctattactccagtcattttgggagacgaaaaagtgactcagactttctctaagaagctgatcgaacatgggatttatgctaaaccaatcgtttatccaactgtgcctcttgggacaggcaggatcagaaatatgccgactgcggaacatacgagggaaatgcttgatgaagcagtagcagtttatcaaaaaataggaaaagaaatggaaattatttaa

SEQ ID NO: 2118 - DNA (genomic), 678 bp, Enterococcus faecium; double-stranded, circular
  misc_feature (B) LOCATION 1...678
  hypothetical: NO
  anti-sense: NO
caaataatatggataatgataaaatgtggagaaaataacgaaggtggtaagtatatgcaaatcgattggaacaatctaggtttttcttatatcaaaactccttggcgttttattgccaaatggaaagacggacaatgggaagaaggagaattgacagaagataattacctgacgattcatgaaggctctccagcgcttcattatggtcagcaatgttttgaaggtctaaaagcttatcgtcgaaaagacggcaaggtcaatctctttcgacctgaacaaaatagtcgacggatgaatcaaagtgctagacgattgctgatgccaatggtccctgaaaagatgttcgttgatgctgtcaagcaagtggtaaaagcaaatgaagattttgtgccgccctatggaacaggcgctacattatacttgcgccctttactgattggggtcggtgaaaacattggtgtccatccagctccagaatatttatttgtcgtcttctgtacgccagtaggagcgtatttcaaaggtggactaaaaccaacgaattttattgtatctgattacgatcgtgctgctcctaaggggactggtgcagcaaaagtcggcgggaaattacgcatcgagtttacttccaggaacagaagcaaaagaactggattactcagattgtgtttatcttga

SEQ ID NO: 2119 - DNA (genomic), 1152 bp, Enterococcus faecium; double-stranded, circular
  misc_feature (B) LOCATION 1...1152
  hypothetical: NO
  anti-sense: NO
actggaatatgtaagaaaagaattgaaagagtggcaaaatcaatgaatattttagtaactgggtcaaatggttttattggaaaaaatttagttgctgaattaaaaaatgaaggattcacagatattcttagttttgatagagacacgcctgtacatctattagatgaatattgtaaaaaagcagactttgtttttcatttagctggagtgaacagaccaaaagatgatgaagaattcatgaaaggaaattttggatttacttcagaattgctagaaaaactaaaagcacatggcaatacatgtccagtgatgctttcttcctcgatccaagcagaacttgataattcttatggcaaaagcaaaaaagccggagaagagttgttaaagaaataccaaaaagaaacaggagcacctgtatatatttatcgtttctcaaacttatacggtaagtggtcacaaccaaattataatacagtggtagccacattttgttacaaaatcgcaagggaggaagaagtgacggtaaatgatccatctgctgtcattgaactttgttatatcgatgatgttgtgaaggaattacttcattgtctgaacggacaaccttatatggaaaaggggtattgtgctgtacgtgagacggatgaagtaacggtcggcgaattaaaagaactgattacatctttcaaaaatagtcgaacgaacttgagtgttcctaaccttgcgagaagagtagaaaaaaatctgtacagtacgtacttaagcttcttaccagaagacgattttgcttattttctaaaaatgaatgtagatgatcgcggatcgtttactgaatttttaagaacaaaagaccgaggtcaagtatctgtcaatatttccaaaccgggaatcacgaaaggcaaccattggcatcataccaaaaatgaaaaattcctagtagtaagcggagaaggtgtgatccgttttaggaaagtagattcaaatgaaataatcgagtattttgtttcaggagaaaaattggaagtagtcgatattccagtaggttatacgcacaatatcgaaaatctgggatcatcggatatggtgacggtgatgtgggtaaatgagccatttgatccagaacatcctgatacttattatgtggaggtttaa

SEQ ID NO: 2120 - DNA (genomic), 978 bp, Enterococcus faecium; double-stranded, circular
  misc_feature (B) LOCATION 1...978
  hypothetical: NO
  anti-sense: NO
ttttggatatgcggcagcagtttcctttgttattgtttcctttattgtgatattgtcgataatccaaacgaaagtaggaggagaaagtcgatgaaaaatatggtagaaaaagaaacaatcgaacgccccaacgtcaaaaaacaagcattagaacttcgttcgacaattgggtcagtattaaagtatacagcattaagcatcctatcatttatttccattttcccttttgtctggatggttttgggaatgacgaatacacccgtggatatcacatcgggaaaaataaagattggcagtaacttgatcatcaattttcaaaatttgttttccaatgagctgaattttactcgttccctttggaattcagcgatgatcgctttgctgaccactgtgtttgcattgctgatttcgtcaatggcaggatatggatttgagatttatcaaagtaaacgaaaagacctaattttcaatattctactgctatcgatgatggttccttttgcggcattgatgatccctttatatcgaatgttttcacaattgaacggaacggttttgggaatcaacagtttcttggttgtcatcctgccatctgttagcactgcttttttgatcttcttctttcgacaaaatgttaaatcttttccaaaagatctagtagaagccgctcgattagacggtctaaaagaactaagtattttttttagagtgtatatgccgacggctaaaaatacctatgccgcggctgcaatcatcacattcatgagtagctggaacaattatttatggcccttagtagctttgcaatctcctgataaacggacggttccgcttgttttatctgctatgggtgcttcctatacaccagactatggaatgatcatggctggattagtcatcgctactttaccaactgccatcgtattttttgttttgcaaaagcaattcgttcaaggaatgatcggctctgtaaaataa

SEQ ID NO: 2121 - DNA (genomic), 228 bp, Enterococcus faecium; double-stranded, circular
  misc_feature (B) LOCATION 1...228
  hypothetical: NO
  anti-sense: NO
gtagatgtatggaaggttagtcgcttcttcttgtgctttaaagaagtcagcagcttcagctttactgtaaaccacttcaccatcagcaaaaccttcgacatatttaacgttaactggtacttctactttaagaacatcaatgttaaagcgtggatcagagaaaactttcatcgcttcaatgactttgcgaggtttcacttttgcatattcaacagaacctgcatctga

SEQ ID NO: 2122 - DNA (genomic), 1341 bp, Enterococcus faecium; double-stranded, circular
  misc_feature (B) LOCATION 1...1341
  hypothetical: NO
  anti-sense: NO
gtaagtgtatgctcattggaattttttggagggaacaacatggaagagatcatcgtaagaggtggcaatcaattaaatggaacagtaagaattgaaggagctaaaaatgctgttttgcctattttagctgctagtttgttagcagaaggaggtattacgacattagacaacgttccgattctttctgatgtcttcactatgaatcaagtgattcgtcacttaaacgtagatgtagattttgatgaacaaaagaatcaagtaacaatcgatgcttcaagacaattagaaatcgaagcgccttatgagtatgttagtcaaatgcgtgcttcaatcgttgtgatgggtccgctacttgccagaaatggacatgcaaaagtagctatgcctggtggatgtgcgattggtaaacgaccaatcgatttgcatttaaaaggatttcaagctttaggagcaaaaattattcaaaaaaacggctatatcgaagcaattgcggatgaattgatcggtaacacgatttatttagatttccctagtgtaggtgctactcaaaatatcatgatggctgccgtaaaagcaaaaggaacaaccatcattgaaaacgtagctcgcgaaccagaaatcgttgatttagcaaacattttgaataaaatgggcgctcaagtctatggagctggtactgaaacaatgcgtattgaaggcgtggatcatttacatgcagtcaaccactcaatcgtacaagatcgtatcgaagcaggtacctttatggttgctgctgcaatgacacaaggcaatgtgctgattgcagatgctatctctgaacataaccgcccattgatttctaaattgatcgaaatgggtgcagaaatcattgaagaaaaaggcggagtccgtgtcatcggaccaaaacatatcttacctacagatgtaaaaacgatgcctcatcctggtttccctacagatatgcaagctcaaatgacagctatccaattagttgcagaaggtacaagtgtagtgactgaaacagtgtttgaaaatcgtttccaacatttagaagagatgcgccgtatgaacgctcatgtcaaaatcgacggaaatgtagcaatcatggatggaaaccatgaattgcaaggtgcagaagtatatgcaacagacttgcgggcagcagcagcattagttttagctggcttgaaagcaaatggaatcacacgtgtgcgtaacttgaattatctagaccgtggatattataatttccatatcaaactacagcaattaggtgcagacgttgaacgtgtagacatggatcaaacttctgctgaaaaaacagcacaaacgattgcttaa

SEQ ID NO: 2123 - DNA (genomic), 483 bp, Enterococcus faecium; double-stranded, circular
  misc_feature (B) LOCATION 1...483
  hypothetical: NO
  anti-sense: NO
tcgatagtatgcgttacaacgttatctatgccgattacgataatttttatatctatttttatcttgaaagtgtgggtgaatatggtgattgataattctaaagaaaaagaacgtttaaataagcaaatttctgctatcaaaacttccttagaagagcattttggcctcaaactctttcaagactccgtaggcgaggatgagctacctgatgattttaattacttcattctcgaaacaggagaaatagaaatgatcactgagccaaaatatagcgtgggtcaaaatctatatctaactttctattcagaaaatagagaagatttaacaggagactcactagatattatttcattgattcaaaatcgttcgattcgttttcagagaatggatcccaatcatttaaaactagagaaccaagatcgctatatcgatcaattggtatttacgtttagacgattattgaagagtgattgtcatggctaa

SEQ ID NO: 2124 - DNA (genomic), 681 bp, Enterococcus faecium; double-stranded, circular
  misc_feature (B) LOCATION 1...681
  hypothetical: NO
  anti-sense: NO
tatgaagtatgtggaagatggacggggaagaatatggaagcaaaaatcactttagaaccttttgaacgtatcttaagcggttaccgcaaagtagaagagttagctgtgaacgtaactgattgttcaaaattagcgcaaaaatacgcaagattcggcgttgaaggctatcgattaggaaactatgtcggtacagggtatctgaaccgttatttagagtgtatggtggaccgcgcaccaatgctgatttatagacaaaattatctgattccgctgctttttcgtcgttctgattcagcctttcggttatttgaagaagagtatcggatggaggctttctttctactattagagtggagcttgaaacatcgtcctgaaaaaattcttatcgaaagaaatgagaagatagacacgaaaaaaaataaagtgatcgatagtgcatacctagcatttcgtgtatcagagattttggattgtggcggctatccaatcagcaatttccaatcaattgaccaattcattgaatggaatcgaatttaccgattgatcgacaatggcgggattggccgtcatagcaaggtatttgacccagaatatccagaaaacatggaagaactgaaaatgattatttcgcttgtcaaattaaaatatcctgaaacagatttggatttatatatagaataa

SEQ ID NO: 2125 - DNA (genomic), 372 bp, Enterococcus faecium; double-stranded, circular
  misc_feature (B) LOCATION 1...372
  hypothetical: NO
  anti-sense: NO
aaaggagtatgtactttgtttgaagaatttattgatatcaatgaaaggcaagtatatcaatttttgaactattgttatgaaagagacgagaaattatatgtggtgaaggatatcgctttagatctaaactacaccctggctaagatgaattcggtgattcaacaagcagaatcgttttgcgaaaggtatccagaatataaattatcttttctttcagaaaacaagatgataaaagtcgagttttcttctcagtttttactgagtaaagtttattctatacttttagagggaacgattggttatattttactggattcactttacaaaggtacttatcaatccttagaaaatcttagtcaaaaaattatataa

SEQ ID NO: 2126 - DNA (genomic), 1413 bp, Enterococcus faecium; double-stranded, circular
  misc_feature (B) LOCATION 1...1413
  hypothetical: NO
  anti-sense: NO
cggaattcatgctgcttcattaggagcactatggctagcagttatatttggtttttcaggtattacagtaacgaatggaactctttctatttctccaagacttccttcagcatgggaaaaaatttcttttccttttatttggaaaaatcacaggttgctatttgttttgacaaaaaaacaaatagtaataaaaaaagagacgaaagaaacattacctatttttgtcaatggagaccaataccagctggaaaaagaactgatcttggaacggaggggaaaataatgcgtattctgattgcgccagattctttcaaagaaagtctgacagccttagaggcagcacaagccattcaatcaggttttcaagaagtttttgttcaggctgaatatgatctgctacctataggcgatggaggagaaggaacggtttcatcattagcagacagtttaaggttgaagcggcaaacagcagtcgttactaatgcatttggcaaaaacaaagaaatccagtacgcttcagacggtcaaactgcgatttttgaaatggcagaaatcgtcggattgaaagatgtcccactaaaccaacaacagccacttaggttatccacgcgaggagtaggagaactgatacgacaattgttgcaacaaggtgttcgacacatcatcatcggcgttggcggaagtagtaccaacgatggcggcatcggcatggcagaaggtctaggttatgctttttacgatcaagataatcaaaaagtagaagcactgggagaaaatctaggtaaaattgctacagttgataaaacgaacgtgcctattgagctgattaaagccaaaatcactgtcattactgatgttactaatcttttatgcggaaaagaaggcgcttcttttgttttcggaccacaaaaaggcttgaaagaaaatgaattagcagtggctgaccaagccatgcatgatttttatatgagatttgcccctcaagtaatcgaggcatcgggcagtagtgctggtggtggaatgggtgcaggactgttagcatttgcttcagggaaaatagtctctggcatcgactacgtattggatttactggagttcgataaacgggtacagcaagcagacctcgtaatcgtaggcgaaggacgtctagatggacaaagtctaaaaggaaaagcgccagttgggattgctagaagagtaccagagggcgttcctgtgatagctatttgcggaagtgttggtaaaggaagcgaaaaagcagcagatgttggcatttcggccgtttttccgatccttcctgcagctgtgcctttacaagaagctttacagcaagccactgataatcttcatcgcacagctaaaaacatcgcatctttacttcaagtcgttcattttcaaggaggtaatcgatga

SEQ ID NO: 2127 - DNA (genomic), 213 bp, Enterococcus faecium; double-stranded, circular
  misc_feature (B) LOCATION 1...213
  hypothetical: NO
  anti-sense: NO
caaaagtcatgtcacagtcccttgttccgaataaacggtgttctcatgccaactcctcggtcacaagtcacaatagtcatcaaacatgagaagctgttttttgaaattgctccttgtgacgcggagttaaacggcaggctcacaacctcttccttaaacggtgttcaaaagcttgcatctgcgataataagcccggccaaacgaaaaatatga

SEQ ID NO: 2128 - DNA (genomic), 282 bp, Enterococcus faecium; double-stranded, circular
  misc_feature (B) LOCATION 1...282
  hypothetical: NO
  anti-sense: NO
aagaaaccatgcacgccgggctgcctttatcgaagaaaattggaggaacgaagggtgaatcgaagcttttttcattatttaatgacactgcgaggcggtggcacacatgatgctttatctgttttcgctacagaagccggtaaagacatccaatttcctaagcacagctctagctacgaagaaatttctaattatctggaactgaatgtcgactatttgccgtccatggatatctttgacgaagcatgggaaaaatatttagaaaataatcatgacatataa

SEQ ID NO: 2129 - DNA (genomic), 627 bp, Enterococcus faecium; double-stranded, circular
  misc_feature (B) LOCATION 1...627
  hypothetical: NO
  anti-sense: NO
ttacatgcatggacacgaaagtatcccttttctcttatactccttaaaagaagtaaaaatatatcaaatactagagataggtttatttcgataattacagcctgtgaaataggggtaaaggaattttatcaacaagagaaacctgatttaactctaatatttgagaatttacaatctccccctgtagacaaattattagggagcatgtttaaagggtactttaatattgagtttccgaaagaaataagaaaggaaattaaaaatttcatagaaaaacgtaataaattggttcattctcctcaaggaagtaaaccaactatagaagaatgttttgaatgttatatggcagtgctaaaaacatttaattttttttataaaattaatgatagctttatgtatagagatttttatgaagaatctatagaattgactccaacggaaccaaataaatctcaaatcactttgtcaaaggagctagagagaaaagtagagtctcaagaactagctataggaattagtataaccaatgtgtcgacatacaaagaattatacgaagctaaatcacaagataataaggattttgtagaaaatatagataaggaaccaacaaatacagtaggggattaa

SEQ ID NO: 2130 - DNA (genomic), 897 bp, Enterococcus faecium; double-stranded, circular
  misc_feature (B) LOCATION 1...897
  hypothetical: NO
  anti-sense: NO
tttctaggactgatagtaaatcattctatcagtccttttgagcataaaaaaacaaaacatacagaagctccgttagaattgaatcaccacaacacaatcaaaggagcgttctgtatgcctgatcttcatcttatcaaactattactaggaatcaaagatggaaacattcaaatcactcatgtcgagaagaaaaaaatacattcaatcaacagtatcgttgtttctgccacgctcattaaaacgattcagccctgtcctcagtgtaaacaggtgaatcaacatgggctgatcgttaagaacggaaagaaaaaatcgctggtccttctcaataagtgtgcgaatcaacggacttatcttgctttggcaaagcaacggtacctctgtcgtggctgtcacacctattttacggcgaatacctacattgttgaaaaaaactgttttatcgccaaacaagtacattataaaatattggaggaattgactgaaaaacaagcaatgacgacgatttctaaacattgcggcgtttcttggtcaaccgtttcgcgaacactcgcttctctgctccccatgacaaacgtgaaaataaattggttgcctcgctgttcattggtagatgaatttcgttcattgaaaaatcaagtcggtccctattctttttcttgtatggatggcgatactgggaaattactggatattcttccttcacgtaagaagaaagatctcatttcttattttatgcaatttgaacgacgtgcacgtttaaacgtaaaaatactcgtaacagatatgaacgcctcttatgctttgctgataaaagagtgctttcctcatgccaaactcgttgtggatcgctttcacatcgtcaagcacctcattcgcagttttaaggatatttga

SEQ ID NO: 2131 - DNA (genomic), 264 bp, Enterococcus faecium; double-stranded, circular
  misc_feature (B) LOCATION 1...264
  hypothetical: NO
  anti-sense: NO
cccacaggacttccacctctgcatagttcttatgtagccgtacccattgcgtgcgacgcttttaacgctcaagctgtggctgtacgggagtatcattatctgacagcacaggtcatggcgataaaagaggacaaatcttttacaagaacacagataggttgtcgctcacttttgcaggagaaaggtcatggcgtatctgtttcaacggctcgctgtctgtcaaaggtattgaattgctttattcagttgtcaaagagcgattga

SEQ ID NO: 2132 - DNA (genomic), 1701 bp, Enterococcus faecium; double-stranded, circular
  misc_feature (B) LOCATION 1...1701
  hypothetical: NO
  anti-sense: NO
cgcaagcaatggaggaactttcagatgaaaaatagttttgtagaattaaacgccagagaacgagtgaacgctctacttgacaatggacgtgaattgattgatccattcgatcaaatcatcgcgccaagtttaccagcacaaggaatcgtccctgaaagtgatgacgggatcgttgtcagccgtggcacgatcaatggcaaacaagcagtagtaatcgctatggaaggaaaattccaaggtggcggtatcggtgaagtttccggtgcaaaaatcgttgctgcacttgaacatgtgttagaagaaaataaaaaaggaaatgagatctttccagtcattgtactagatacaggtggtgttcgtttgcaagaagcaaactacggactgttatctatttcagaaatcggaaatgtaatcattgctctaaaacaatatgtaccagtcatcggtttgattccaggacgtgtaggatcatttggcggtatgtcgattacttcagcattaatgagttatttaatcgcaacaaaaaaagcgagagtcggtttgaatggaccagaagttattgaacaagaagcaggcgttcgagaatttgattctagtgacaaagacttgatttggaatacattaggatctcgtcaacgggtagaatcaaaaatcattgatgaattagtgactgatagtgtagaagcaatcaaagctgctgtcatcgcagcaatggacgaacgaaaagacacgcatcgcagtgaaagctcagcattttatttatcattacttgattctttagatctttcaaaaccaatggccattgacgattacaatgaagcaattgctaaccatcaagcaaaatcaattgacttaccagaagtagcagaaggaaatgaaccagctgcagcaagtgttggttacgattggtttgcggcactaactggcatgaaaaatccaacttcttctattagtactgtgtattatggtaaatcaagtaaattcatagaagaagccatcgtgacatcaatcgtacctgatcctaaaaacccgatgtaccgtgtacgaaacggtgaagttggtttagttgaaggtttccgcatgggacaaattttggatcacgtttacgaagaagataaagacaaaaaagtgaaacggccaatcatcgttgtgatcgatgtaccaagccaagcatacggctataacgaagaattgatcggtatccatgtggctttggctaatagtgctgctgcttatgcaaaactccgtcaagctggacatccagttattggattgattgcaggaaatgctatttcaggtgcatttttagcacatggattacaatcaagccgcttgattgctttaaacaataaagaaattaccgtccaagcgatgtctaaagaaagtgctgcacgtgtgacaaaacgttcggttgctgaaatcgaagcagctgctgaaaaagttccagctatcgcttacgatatcaataattatacaaaactaggagcgatctatcatttcctagaagatatcaccgaccaagctgcttcagaacaaaatgtcagcaaagtcatcgaagcaatcaatgaagccattcaagatgtccgcaatacaaatgacacgatgctgacaaatcgatacacaaacgaaacagccaaaacattcggacgtgtcgaaacaaataaagtccgtgccaaaatggacgaagaatgggatgcataa

SEQ ID NO: 2133 - DNA (genomic), 1476 bp, Enterococcus faecium; double-stranded, circular
  misc_feature (B) LOCATION 1...1476
  hypothetical: NO
  anti-sense: NO
gaaaagcaatggaaaacgatggtaccgcagctttccatcattaccacaaggaagaggagtgagaacatgggcgtaccagaattagaagaatataaattcgggtttcacgatgatgtcgaaccggttttcagtacaggagaaggcttgacagaagaagtgatccgtgagatgtcaagaatcaaaggcgaaccagaatggatgcttgaattccgtctgaaatctctagaaacatttaacaaaatgccaatgcaaacatggggccccgacctttcagacatcgatttcgatgccatcaaatattaccaaaaaccaagtgacaaacccgctcgtgactgggaagacgtaccagaaaaaatcaaagatacatttgaaaagattggtataccagaagctgaacgagcttatctagccggtgcttccgcacaatatgaatcagaagtcgtgtaccataatatgaaagatgaattcgaaaagttaggaatcgtctttactgacactgactctgctttgaaagaataccctgaattattcaaagagtacttttcaaaacttgtaccgccaaccgacaacaaattagcagcgctgaattcagccgtatggtcaggtgggacctttatttacgtgccaaaaggcgtcaaagtcgatgttccattacaaacgtacttccggatcaatgcggaaaacacggggcaattcgaacgtacgctgatcattgttgacgaaggagcaagcatccactatgtcgaaggttgtacggcacctacttattcaagtaacagcctgcatgccgccatcgtagaaatctttacaagaaaagatgcgtattgccgttacacaacgatccaaaactggtcagacaatgtgtacaacttagtaaccaaacgagcaaaagcatacgaaggcgcaaccgttgaatggatcgacggaaacctaggtgcaaaaacaacgatgaaatacccaagtgtttacttagatggaaaaggtgcacgaggcaccatgctctccatcgcctttgcaggagcaaaccaaatccaagatacgggtgcaaaaatgatccacaatgcaccaaatacatctagctctatcgtctctaaatcaatttcaaaagacggcggagaagtaaactatcgaggacaagtaacctttgccaaaaacagtgcgggttcgatctctcatatcgaatgtgacacgatcatcatggacgaatggtcgaaatccgatacgatcccattcaatgagatccacaacagccaagtctctttagaacacgaagccaaagtctcaaaaatctcagaagaacaactctactatctgatgagccgaggcctgaccgaatctgaagcaactgaaatgatcgtcatgggctttgttgaaccattcaccaaagaacttccaatggaatatgcagtcgaactcaatcgattgatcagttatgagatggaaggcagtgttgggtacccctgttataggagctag

SEQ ID NO: 2134 - DNA (genomic), 687 bp, Enterococcus faecium; double-stranded, circular
  misc_feature (B) LOCATION 1...687
  hypothetical: NO
  anti-sense: NO
atggagggactttcagtgattaaagaaatcaaaaaggtgcaaatagctttacttgcttttggtgtattcgttgtctgctataatttttatgaatttatcacacaaaaatattcgacttctcaaggaatcacatttatcgtggaatctttattagggattgcattgattttcatgccacaagtcattttgaaagttttcaaacttaaaataccagcagcaatcgttttgttttactggtttttcttgttcatctctgtctttttaggcacagggatgcatttgatcagtatcatctctttttgggacaaaatcttacatgcggtgagtccaatggtcctgacagctcttggctatggattgattggttacttgatgaaagatgctgagatatcaaaaaccagtccttggttgttcctcttattcggctttgcgtttgctggactttgcggcgtgttttgggagttctgggaattcttatgcgaccagttcttaggcatgaatcttcaacgttttgctgcttctgatggcacactgtttgtcggacgagcagcattgatggatacgatgggcgacttgctgacaaatacgataggtgctgccttaatgggattgtttgcatggtctcaaagtaaaaaagatgagcgttactttgaaagttataaattagaaaaagtgaaaaatacctaa

SEQ ID NO: 2135 - DNA (genomic), 885 bp, Enterococcus faecium; double-stranded, circular
  misc_feature (B) LOCATION 1...885
  hypothetical: NO
  anti-sense: NO
aaagacaaatgcgttcaatatgggggattaacaatgaaaaaatttcattcgagtgctcgattccaaaaacgactttctcacttttttacttacttttttcttttaatactgtcagtcattatcatctatccgcttttgatcacagcaagtactgccttcaagtcaggaaatattgcagcttttagtttagatctttcaagtgactggactttaggaaactttactcggctattcagtgaaacactttacgggacttggtataaaaatacattgatcatttctgtcctaacaatgatcgtacaagtgactgtagtaactttggcgggctatacttatagtcgctatcgttttatcggccgcaaatcaagtttgatgttctttttagtgattcagatggtaccgactatggcagcattgactgccttttatgtcatggctttcttattagaagcgctcgataagtactggttcttgacaatgatctatataggcggtggaattccaatgaatacttggctgatgaaaggatactttgacactgtaccaatagatttagatgaatctgctaaacttgatggggcagggcatttcaggatttttttccagattgtattaccgcttgtcaaaccgatgctcgccgttcaagcattatgggcttttatgggaccttttggggatttcatgttagctaagttcctgcttcgaacacctgaaaatcagactgttgctgtcggcttacaaacatttatttctgatgtgacaaaccaaagagtctctctttttgctgctggggcaattttgattgcactaccgatttgtctattattcttctttttacaaaagaactttgttaccggcctgacatctggcggaacaaaaggatag

SEQ ID NO: 2136 - DNA (genomic), 939 bp, Enterococcus faecium; double-stranded, circular
  misc_feature (B) LOCATION 1...939
  hypothetical: NO
  anti-sense: NO
acagaaaaatgtaagttttttcttaaatatgttttaaaaatggtacaattagtctgcgattgcactgaaaggagtacacttgtgaaaatcacgatcactttacctatgaaccatcctgaaacaacaattcgcgacttgcttgaaaaggaatggttagttcctagaaaggttcgacactttttgcgtatacgtaaaaacgtttggatcaatcaacaacctgctttgttccatcatgaagtaaagggcaatgaccagatcacattgttattcgaagaaacagattataattatcaagaagttcaattaggagatgcgaagcacatccgtgttttatatgaagatgagcatttgattatagtggataagcctgcaggaatgaagactcatccaaatgaaccgacagaaaacagtaccttactcaatcatttagctgcttatctcgacactaaacagcaacgaccttacgttgtccaccgcttggacaaagaaacaagcggtgccgttttatttgcaaaaaatccatttgtcttgccgatacttggaagaatgttggaacaaaaaatgatctatcggagatatcaagccatcgtatggggagaaattgccaaagatatgaccatcaccaataaaattggacgagatcgccatgatcggagaaaaagggtcgtagatgataaaaatggtcagagcgccttgacacatgtcactgtcaacaaagtactttgtgaacaaacacaagtctattgtgttctggaaaccggacgtacacaccagatcagagttcatttagctcataagggacatccgatcgttggagaccctctctaccaaaatagaacagctgaacgactgatgctccatgcattagaactgcacatgatccatccatttactcaagaaaaaatagtcggtaaagctttacctggattatgggaatag

SEQ ID NO: 2137 - DNA (genomic), 789 bp, Enterococcus faecium; double-stranded, circular
  misc_feature (B) LOCATION 1...789
  hypothetical: NO
  anti-sense: NO
gataggaaatgggggaaatcaatgaagagtaatgaaaaaacacctttaacaacttcgcttattttactattatcaatcacttgtggcgttgttgttgccaatatgtattacatccagccgattggaacaaaagtagcagctagtttatctgttagcacaagtgcagtcgggatattgacgatgttgacccaattaggctatgcgttagggttactgtttttagttcctttaggggacgtggtggatcgtccaaaattgatcattcgaatggtagcgttatctgccgtctctctgttggccgctttttttgcgccttcgtttacgttatttgcatgcgcttcttttttaataggattactttcgatcgtgccgcaaatcatcattccttacggtgcggtactagcgggaccaaaagcaagagggaaggtcatgggtacattgcttagcggtttactcgtggggattttgctttctcggacggtatctggtattgttgccagtcttttttcttggcggatgatctatttatttgctttatgtgcagtcggaattcttacacttctgctttactggaaaatgccgcgttctgtccagcaaagtagtacagctgtttcataccttgattcacttaaaagtttgccgcatttagttgcttctcaacgtctattaagagaagcggcagtcagtggatttttcatgtttggaacattttcgatcttttggtctacgttgattttttatatcagcagtcccgcctacaattggggaacattcgaagcaggatattag

SEQ ID NO: 2138 - DNA (genomic), 306 bp, Enterococcus faecium; double-stranded, circular
  misc_feature (B) LOCATION 1...306
  hypothetical: NO
  anti-sense: NO
tttttcgaatggcactaccataatcaaatagttgttcaacatgtgcaaagttccgtttccagacatctacagcaccagaataatgagaccaccgattttgaaaactgtcaaaagcagcatgtgcagcgtttagagaagaagcaccgtagaactttttcatatctcggcagacttccttatagtccttacttggaatatagcgcaatgcatttcgaacaagatgaacaatacagcgctgaacaattaccgatggaaagatcgcttttgcgccttcttcgaggccagaaacaccgtccatcgaaatga

SEQ ID NO: 2139 - DNA (genomic), 1515 bp, Enterococcus faecium; double-stranded, circular
  misc_feature (B) LOCATION 1...1515
  hypothetical: NO
  anti-sense: NO
aaggaacgatggtccatgcttgaaaccctgcaaccaacaatgaaattaaatcgacgagacagtgtggtcgtcgcattaacccctattccaaaacaaacacaactgacgattgatcagcaaacgatcaccactcttgaagatatcccgcaaggtcataagattgcattgggtgatttgaaagctggagacaacgtgatcaaatatggctatccaatcggtcatgtgacgacagacgtaactgccggtcaatggctgcacactcataatgtaaaaaccaatctttctggtgaattggattatcgatatgaaaaagatgtccatccaagtcattacctttttgagaaccgaacatttcaaggttacttgcgaaaaaatggaaaagtagggattcgtaatgatttgtttttagtacctaccgttgggtgtgtgaatggcattgctgaactgatcgtcaaacagttcaaggaaaaacatccagatctgggacagtttgaccatattacgattttaaagcatccttatggctgttcgcagcttggaaaagatcatcaaaatactcgagaaattttagcggacgcagtaaatcatcccaatgccggaggagttttagtatttggattaggttgtgagaacaatacagttcctgaattcaaaaaaattttaggtgaatatgatgaagaacgagtgaaatttctagtggctcaagatgtttacgatgagatcgaacaaggtgtggctctattagaagagcttttaacagcggcggaaaatgaccagcgcatatcagtcccgctctctaagttgaatgtcggtttgaaatgcggcggttctgatggtctatcgggaataactgctaatcctttacttggtgcattttctgactacttgattgctcaaggaggcagcacgatcttaacagaagtgccagaaatgtttggcgcagaacaagtattgatggcacgagcggaaaatgaagaagtttttgactcaatcgttgacttgatcaatgacttcaaacagtatttcttgtcttacggggaaccagtttacgaaaacccatctcctggtaataaagcaggtgggatcactacattagaagataagtctttaggctgcacgcaaaaatcaggaagctctcctgtcgttgatgtgctacaatatggcgaaaaaatcagaaaaccagggcttagtttattgcaagctcccgggaatgatcttgtagctgcctctgctcttgcttcatccgattgccagttggtcttgtttaccacaggaagagggactccgtttggctcatatgtcccaacggtcaaggtatctacgaatacaactctttttgaacgcaaaggtcattggatggattttaatgcaggcgtcttattagaacaaccaatggaagtaatcttagaatcgtttgttcaaaaaatcatcgctgtagctagtggagaagaaacgaaaaatgaacaaaatgacgttcgagaaattgccatttttaaaaacggagtaacactttga

SEQ ID NO: 2140 - DNA (genomic), 588 bp, Enterococcus faecium; double-stranded, circular
  misc_feature (B) LOCATION 1...588
  hypothetical: NO
  anti-sense: NO
aaaggacgatgttcaatggctganaaaatgaaacaaggttcgaaatctgtagtaaaaagtttgatcaatcatcacgttgattatgtattcggtataccaggcgcaaaaatcgatggtgtatttaatgaattagaggatcaatgtcctgaattaatcctaactcgtcacgaacaaaatgctgcatttatggcacaagcaatcggacgtatcacaggagaacccggggttgttatcgcaacaagtggtccaggtgctagtaacttagctacaggtttggtaacagcgacagcagaaggagacccagttttagcaattgccggacaagtaaaacgaagcgatctattgaagttgacccatcaaagcatggataatgcagcgctgttccagccaatcacaaaatacagtgcagaaatccaagatccggaaacaatttcagaagtgattgccaatgcttatcgtatggctaagagctcaaaaaaaggagcgagttttatcagtattcctcaagacgtagtggatgcgccagttcaaggtaatatcatcaagccattgagtgatcctaaattaggtgctgcttctgccagatga

SEQ ID NO: 2141 - DNA (genomic), 768 bp, Enterococcus faecium; double-stranded, circular
  misc_feature (B) LOCATION 1...768
  hypothetical: NO
  anti-sense: NO
aaggagcgatgcagagtggttcggataaagggattgaatataggaagcggtagaccaaagatttgtgcgcctcttatcggagccgtccgagaggaagtattacgtgaagcagttcttgcacgtgaagcaggggccgacttagtagaatggcgagtcgatcattatcgtaaggttttttcttttgatgaagttgcagaaacattggttcttatccatgagatgcttgatggactgccgttattatttacgtttcgtaccttagctgaaggcggagaacaagacatttcgatccgtcagtatcgcgacctctatgaacatgtgatacacacaggattagtagatatggtcgatatcgagttgttcaaagtagaaagtctaggaaaaggactgatagaggaaatcaagtctttaaacattcctttaattatcagtagtcatgattttaaagaaacaccagctgaccctgtcttgctttaccgactgaatgtcatggaacattttggcgctgatatcggaaagttggcagtgactcccaataatgaacgagatgttttgcggttgatggagttgactagacgggcaaatgcttttgtctccatgcctatcattacgatgtctatgggcgatctgggaaaaatttctcgtctggctggcggaacgacaggatccgtcatgacgtttggttccttaagcaatgcttctgctccaggacaattaccggttaaagcattgaagcaaattatccaattattaaatgaaccgttgtag

SEQ ID NO: 2142 - DNA (genomic), 1296 bp, Enterococcus faecium; double-stranded, circular
  misc_feature (B) LOCATION 1...1296
  hypothetical: NO
  anti-sense: NO
tcaatgagatggcaaaaactattatcaaaaaatgcacagaatttattttcactaatcaacctaatgaaagatctaatctggcgaaaaacggatctagctgaagaactgaaaatcgatgtcaaaacagttgatcggcatctaaaacgtttggcagaaagcgactgtccaatccagctgattcttcataagaaaaccgttcagttagtttatgatcaaggatatagcgaaccctacctcctttttgtttttctgattcaatcaccacctttttgtctactgaaaaatctgctgttgaatgaaccttatgagcaggagtatgatcgttcgacacaagagcggttgagaaaatggtttggtgagtatcacctttcgttttcttataaaaaagcgcagatctttggttcagaaagaaaaatacggtacctgctattttgtttcttgaaagatttcccccatttttttgcagacgatggagagcaatccttttcagagacattcatccaattattgaagcaacgaaaggatccggcagaaatcgagattttaggagacagtcgaacccttttctttgagttgtttccagaattactttttagagaagagcagattttgccaataaaagaaaaaaattatctagcgattttgcgcttgagctgtaaccagattactgaaaaacggtgggaacggatagaagagacacaagactatcggaaattgacgatcgtaactgaaaagcttgattcgctgttttggctgaatagtgagtttgaaagtggaaataaatcaaagctgacaaaagtactttaccaagaatggcttcgttatgtgattggtatccatgatcgattggtggaagaagaagttcgctattatcaggaaacattagaaaagtttcccaattccaaagataaactgtatcaatttcgtctagcaatccaacaagcacttgcacaccccgcagttgagtggggaatgcttttacttaagacactccaagaacgggggtatttagatgtccatcctcctgaagtaaaaatcgtctttttttttcgttatgaacatcaggaagcaagaagacttgtcggggtactgaacaaaaccctaagacatcgaaaacggatttcgatccatgtttgcactcgaaataagccacctcgttatgcagatctagtgattacggatcatttttttccattagaccataatgaagatcaaaaaacgtatctgtaccatccttcatttggtattgaaagactacttacggatatcaattactggttagggaaaaaccgataa

SEQ ID NO: 2143 - DNA (genomic), 807 bp, Enterococcus faecium; double-stranded, circular
  misc_feature (B) LOCATION 1...807
  hypothetical: NO
  anti-sense: NO
ttatttggatggcaaaggcgattggaccgtaaaaatccagatcaagagattgaagcggaaatgcttaaaattcgggagaagcacaaggattatggctgtttacggatgaccaatgaactaagaaaccgcggtttctctatcaataaaaagaaagttcagcgcttgatcaagaagctaggaataaaagtaacggcatacacgcgtaaatcacgtcgctacaattcttatcgaggaaaagttggagcagtagccaaaaatcggatccatcgtcgtttctacaccagtatctgccatcagaaaatcacgacggatacaactgaatttaaataccatgaagtggatgccaaaggcattatccgtcaaaagaaattgtatctagatccttttatggatatgttcaatagtgagattttatcctatcgtatctctgaaaagcccaatgcattagcggtaatggaaggtttggaggaagctatccagaccactaacgattgtccctatcgtcgtacgtttcactcagatcaaggttgggcgtatcaaatgaaagcttatagaaacaaattgaaggagtacaaaatctttcaaagcatgtctcggaaagggaactgcttagataattcacttatggagaatttttttggcttattaaaacaagagatttttcacgggaaagtttataactgtttcgaggaattaaaatcagccatcgatagctatatctattactacaataatgaacggataaaacagaaattaaactggcaaagtctcgtccaatttcgtaaaacaaccgtaacggttgtgtaa

SEQ ID NO: 2144 - DNA (genomic), 1412 bp, Enterococcus faecium; double-stranded, circular
  misc_feature (B) LOCATION 1...1412
  hypothetical: NO
  anti-sense: NO
aacctttgtggtgtaagaactggtcatcatgcgcacatgcggggacacaagtacctgggcaagatccgttatggttggcttgggccactgatttagtgaatcttaaaggtgcaggggatatgtcgcaatatgagtttgtgttgcataactggacgccggctcgtttcaaagtaggacaaatgattggttcttcaggtatcttgatgggaatggcttttgcgatgtatcgtaatgtcgatcctgataagaaagcaagatataaatcaatgtatttttcagcagcgttggctgtctttctaacaggtgtaacagaaccattggagttcatgtttatgtttgctgctgtgccattatatgtcatatattcagtgatccaaggggctgcatttgcgatggcagatatcttgccattgcgggtccattcatttgggaatatcgaattgctgactcggacaccgttagctatcaaagcgggtctaggtggagatcttatcaacttcgtgttgtgtgtgatcgcttttggtgttgttacgtatttcttagcaaatttcttgatcaaaaaattcaactttgctacaccgggacgtaacggaaattacgacaatgacagtgaagaaaccgttgtatctaacagcggaacaggaacagcagatcagcaagtggtccagatcattcatttgctgggaggaaaagaaaatatcaaagatgtcgatgcttgtatgactcggttacgcgtaagtgtaaatgatcgagaaaaagtagggactgaagaagcctggaaacgagcaggggcgatgggattgatcgtcaaagacaatggagtccaagcagtttatggaccaaaagcagatgtcttgaaatcagatatcgaagatctgctgcaatcaggagcagagattccagagccagaaatggtttctacaggaaatggacaagcaggtagtaagcaatacttaggtatagaacaagaactagtttccgcagcttctggagaagtgattcctttatctgaagtaaaagatccggtattctcacaaaaaatgatgggtgacggctttgctgttattccaacatcaagagaagttgttgcgccgatcgctggaaaagtgacaagtattttccctagcaaacatgcaattgggctggaaacgaaagatggtatcgaagttttgatccatatgggaatcgatacagtccaaatgaatcagccagcttttgagattgctgtcaaagaaggccaagaagtaggaacaggaacgaaattagctgagatggatcttgatgtgatccaaaacgaagaaaaagatccaacgatcatgatcgtatttacaaacgataaagtagaagaagtagtgatcaagcaattaggtacagtgacagctggtaaagtgatcggctccattaaaatgtaa

SEQ ID NO: 2145 - DNA (genomic), 1494 bp, Enterococcus faecium; double-stranded, circular
  misc_feature (B) LOCATION 1...1494
  hypothetical: NO
  anti-sense: NO
acgaacttgtgggaaaataacagaggcaaaaaggaggataatatgaatgatgcaacagaattagcaaaagagcttaaagaaaaagaatttagttttcaagaactagttacggatatacagaaaaaaataaagaagcaaaatcatgaattgaatgcgtttgtcgcgcttgaaccattcgagagtaattcccacgagctattgattccccagtcagaaaaagggccattggctggtatcccatttcctttaaaaatgctcggtcaagaaaaaaagggatggctagctacttcaggatctcgtttatttgaaacacaccgagcttctcatacatctaattatgtgcggcaagcagaagcgataggtctagttccttttggacaaaccaatgcgccagagtttggtttcaaaaatattacagacccagtcatctatggcccagcaagaaacccttggaaccttgaatgtacaccgggcggatcaagtggaggagctgctgctgcagtttcatcaggaatcgttcctttagctggtgctagtgatggcggtggttctattagaatacccgcttcgttttgcggattgattgggctgaaaccttcgcgagggacgatgccagttggtccatatgcttggagaggatggcaaggagctgctattgatttcggcttgacagtttctatgagagacacggaggctttattttatgggatgagaagtatccattccggtgcgccatatcaagtatcgccagttgagtggcaaacacatccaagaaaaaaacggttgaagatagctttttgtgttgattcaccgatccactcacagattagtgaagaggcagtacttgctgtaaaaaaagctgtagatttccttggaaaagaagggcatgatttgacagagattccttacccactagatggtcgtaaactgatcacgtcttattatcagatgaatggcgcagaaacagcagcaatgatccgctcgattgaaacaggcatccagcgagctgtcagaaaagaagaacttgaacccatttcttggactttgttccaatatggtcagaagctctctgccgctacttacatcgattctctgcatgtatgggatgaagcagcaattgtcatggaaaacctacatcaagaatacgatctattcctttcaccaacgactgcatttaccgcccctaaaatcagcgaagatttgcaaagtgatgcgataagagcacagatggaacacatcagtgattgttctgaagtagaaggtttagacgttgtttcttccatgtttgaggagagcttgaagatcacaccttatacacagttggctaatctgactggacaaccagcaatcagcttgcctactcatttgacaaaagaaaacatgcctctaggaatccaatttatggctgccagaggaagagaagatttgctatttcaaatcggctatctatttgaagcaaatcatcagttccatttaccaaatccatggaaatag

SEQ ID NO: 2146 - DNA (genomic), 537 bp, Enterococcus faecium; double-stranded, circular
  misc_feature (B) LOCATION 1...537
  hypothetical: NO
  anti-sense: NO
cagaacttgtgtcaggaggagaagctcatggctagcattttgctgattggtttcatgggcgctggaaaaacaacaatcggtaaagggttagctcaatgtttacaaaaagagtatgtagatttagatacaaagattgaggaacatatccaattgtcgattgccgaatattttcactattacggtgaaaaaagctttcgaaaagtggagtcagatattttaagaaagctgtcaaatgaagacaaaattatcgcgactggtggagggattgtccaaagtgcagaaaatcggcgttttttaaaaacacagccgattgttctttacttagaggcagaagcggactgtctagttgatcgtatccaacaagatgaaacgtctattcgacctttagctcttggaaaaacaagagaagaaataaaagcattattggcacaacgactttcttggtatgaagaaagtgcgacacatcgaatcaacacgaccaatcaaacaccagaaaagatcatcgataccattatagaaaggatcaaaagcatatga

SEQ ID NO: 2147 - DNA (genomic), 1341 bp, Enterococcus faecium; double-stranded, circular
  misc_feature (B) LOCATION 1...1341
  hypothetical: NO
  anti-sense: NO
gcgaggttgtggctatacagtgagtttctgggaaatcccacagtatcgaagcattttccaaaatttatatcgaaaggaggtccttcttccatgaaattatttgtcggtattgacgttagctctgaaaaactagatgtttgttttttaacagacgacaatcaattgtctatcttatctgaaatctctgttgccaatgacatcgaaggtgcttcattcatacgagaaacaattcttgaattcaataacagctaccactttgatcaaattgtgattggcatggagtcaacgtccatgtacagcttccatccttccatgttttttcatgaagatgagaaactaaagaagctcaacacacttgtaacgattgaaaatccttttcgggtgaaacaatttagtcgcatgtttgatgagaataaaactgatcgaaacgatgcattaagaatcgctgatttcttgcgtattcaacgattcacaacttcccctatcaaagaagagaaatacatggccttacagcgtttaacacgtactcgctatcaacttattaagcaattgattcgtacaaagcaacattttcttgaaaatctaacgtacaaatgtaatacgcttgctcgagaaatgcgagacgaatcgacgagtctttttagtgcaaccctcatttcactcatgacggaagatttcacattggatgaacttgctgagcttcctttagaagctttctgtgatttacttcaagaaaaaggaaaaggccgtttcaagcaaccagaaaaaatcgctaaagcaattcaacgtgcaattaccatgagttaccgcctaggtgctcttgcacaagaatcaattaatgttgttttaagtgttctcgtacgagaaatacgagcacttgaaaaaaatatcaaagaattagataaagccatcgaacaagtaattgttgtcattccagaatatcaatgcttaaccagtattccaggcgttggtaaagtctatgctgccggtttaatcgctgaaattggtcaaatcgaaagatttgaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaggttccaaagcatcaacacaaacgtgcactcgtcctaaccgcaagaaaatttacgcgtctggtggatacgctactacgtaaacaccaactctatacgccaccaaggagtgtgatagagaaataa

SEQ ID NO: 2148 - DNA (genomic), 297 bp, Enterococcus faecium; double-stranded, circular
  misc_feature (B) LOCATION 1...297
  hypothetical: NO
  anti-sense: NO
gcgaggttgtggctatacagtgagtttctgggaaatcccacagtatcgaagcattttccaaaatttatatcgaaaggaggtccttcttccatgaaattatttgtcggtattgacgttagctctgaaaaactagatgtttgttttttaacagacgacaatcaattgtctatcttatctgaaatctctgttgccaatgacatcgaaggtgcttcattcatacgagaaacaattcttgaattcaataacagctcccactctgatcaaattgttaaggcccaggactcttcacaacgggat

SEQ ID NO: 2149 - DNA (genomic), 198 bp, Enterococcus faecium; double-stranded, circular
  misc_feature (B) LOCATION 1...198
  hypothetical: NO
  anti-sense: NO
ttgtccgtgtggcttaaccataattatgatttcacgattcctcctgccagtgccttgcacaagctggagcgtaaccctaatagttattttgttaatgtacttatatacttttatacttttccattagaaacaatcactaaatcgttgataccaaggtcagactctagaatttcatcagtgagtccctgtattggttaa

SEQ ID NO: 2150 - DNA (genomic), 522 bp, Enterococcus faecium; double-stranded, circular
  misc_feature (B) LOCATION 1...522
  hypothetical: NO
  anti-sense: NO
agagtatcgtggataaaatcaaagcagtacctgatgtctacagtgtacgccggacgaatggataggaggacagatatgagagcagttgttcaacgggtaagtaaagctgctgtgtcagtcgatcagcaagaaattggaaaaattggctacggcctacttgttttattaggcattcatgaaaccgatacgcaaaaagatgtggactatctggtaaaaaaaattgcacaaatgcgtatttttgaagatgaacaaggaaaaatgaatattagtgtagaagatgtgggaggacaaattttaagtatctctcaattcacactgtttgcggatacgaaaaaaggaaatcgaccaagctttgtggaagccgcacgaccagaaacagctattcctttatacgaatcattcaatgaaggaatcagaagtcgcggcatcacagtcgctaccggacaattcggagcagatatgtcggtttctctcgtcaatgatggacctgtaacgatcattattgattctaaaaacaaataa

SEQ ID NO: 2151 - DNA (genomic), 324 bp, Enterococcus faecium; double-stranded, circular
  misc_feature (B) LOCATION 1...324
  hypothetical: NO
  anti-sense: NO
acaaagtcgtggagaaaacgaagtccagactgtctaagtttggtttttagaaggtgggaaacaatgtattggctgattttattttttgtttttatctttttattaacggctagtcaccttatattgaatatgctagctacatatcatattcaaatcaatcgatggatttgggcactggcatcatttttgatcgtgattcttccaaagatcattgtaccgcatatgaatgttttgttttcatgggggacatatgtactttgtggaatttttgctatcaattttatgatcgagcagcatagatggtttgtcacatcgaagctttaa

SEQ ID NO: 2152 - DNA (genomic), 2031 bp, Enterococcus faecium; double-stranded, circular
  misc_feature (B) LOCATION 1...2031
  hypothetical: NO
  anti-sense: NO
tggaggtcgtgtaaaatgacaaatgaaaaacataaagatagatggctttggtatcctggagactttgagatccgccatggactgctacaaaatttccaacgggaagaacgaggttttgactggccagcgtactggtacatggatgattgccatcggaacgtcaagtttaagagatattactttcttgatcaaccttccatgtttaaagtgacgatccaaggagttgggtatgtagaaattaatggacaaaaacatccatgtggaaaatggctgacttgtccagctggtaaagcaaaaattcgtatctttgtaggacatacatcagggctaccagcgatgtttatcgagggagacgaagtaaaatcagatattggctggacagcaagtaattttattgaagaatatccagctggctggagtccgctttatgtcgatatcgcaaaagatccaaatcaaatctattatcaaaaagaatgcgtccatccagtcactgaaacggagattggcggaggaatcttattcgattttgggcgagcagtgaatggctgtgtagaactaatatctctggatgaccatatcgaatctatcactctatgttatggagagtccgatgtagaagctatggatatcgattattgctactataagcaaataggaatgacaagaaaaatgaaagctcgtaaacgcgcttttcgctatttgtttataccagaggtttctactggaatggttcaacttcaagtttttcatgaatttttatctctttcgaaacaagctgctttttcaagcgattcttctttactgaatcagatctggtcagtatcagaagaagccttcaagttatgtagtgatttgttttttatcgacggtatcaaacgagatcgctggatttggtctggagatgcgtatcaatcattcatgatcaatcaatatcttttttttgacgaggaaatcaataaacgaacgatattagcattaagaggacaaaatgaaatcaagcagcatatgaatactatcgttgactattcgatcttgtggttgattggtatcgaaaaccactatatgatgacgaaagactatgaatttttacgcatcgtctaccctaagatgcaatcattaatgagatacttgatggagcaaacgaatgaattagggtttatttatgggagagcaaaagattggatatttattgattggtctgaaatggataaagaaggaacgcttgctgcagaacaagtcttattactgaaagcctatcattccatgatcacttgcggagatatcttagctgaaacatatggagagaacgaaaattatcatactcatctctatcaagaaaaatatcaactattgaaacaaaacctatttgactacttttgggatgaagaacttggcgcttttatcgattgctatgaatctgggagaagaaatgtgacgcgtcatgcgaatattttcgctgttttattcgattttgctaacaaagaccaacagcaatcgatcttaaagaatgtcttattgaatgacactatcacacagattactactccatatttcaaattctatgaacaagatgctttatgcaaactcggacagacgaatatcgtctaccaaacgattcttgattattggggagggatgttatctcatgatgcggtaactttctgggaagaatacgaccctactcaaacaggaaatgaaaagtacagtatgtatggagatccttatggaaaaagcttatgccatgcatggggagcaagcccaatctatcttttaggacgctattttatcggtttgtatccaacaaagccaggttatgaagaatttatgatacaacctaatctagattcatttgaaacactgaattgtacgctacctatcaaagatggaaagatttcgcttgaaaaaacaaaagataagatcgtgattacttctgatagaacaggcggaacagtgaaaatgaatggtaaaagttatcctcttctagcaaaacagccacttgtcttaacaagctattcaaaaataaatgcataa

SEQ ID NO: 2153 - DNA (genomic), 546 bp, Enterococcus faecium; double-stranded, circular
  misc_feature (B) LOCATION 1...546
  hypothetical: NO
  anti-sense: NO
aaaagcccgtgctgcaacacgggctctttcctcatatatgagcttctacaaaaaaaatcatatcacagaaatgaggaagaaaaaatggaaaaagagattttaataaaatctccaggaaaaaccttgattaaagtaactgatgattctatttcaattattagaaaaggatttataaatttagttaatcaaggtattaaaggagaaaaaactatcccctttaaaaatatatcagccgtacaattaaaaaaaccaggtatgagtaatggttatatacaatttaccttgctaggcggaaacgaaagtcgcggaggtatattagcggccacgaaagatgaaaacaccgttatgtttacaaaaaaatattggaatgaaatggaaaatttaaaaaaatatatagagaagcaacaatctatattagataataattccaaagaaacacaaatttcaagtgcagatgaaattaaaaagtataaagagttgttagatgaagggattattaatcaagaagaattcgattttaagaaaaaagaattgcttggtttataa

SEQ ID NO: 2154 - DNA (genomic), 291 bp, Enterococcus faecium; double-stranded, circular
  misc_feature (B) LOCATION 1...291
  hypothetical: NO
  anti-sense: NO
ccctccacgtggggcggcgttcaatttatttatgatgaggtgaaggtaaagcagattacacatctgtcgataaaggttgatttttgctatctgctctggcaccagtttcagttcatgcacgtagtgatcgattatcattttatttgttgtatggatcagaagatggatatccttatgaataattctcaagttatcgaatttgtcgtctccaccaagactttttggcaaatagtgatgacagtgaacggcttttgctggcaaaaattgttttgtaatctcacacttgcctga

SEQ ID NO: 2155 - DNA (genomic), 591 bp, Enterococcus faecium; double-stranded, circular
  misc_feature (B) LOCATION 1...591
  hypothetical: NO
  anti-sense: NO
aagggtgcgtgttttgctctatatcagatgatagaaggggggaaatattatttagatatggctcctgctaatgacttgaaaaatcaatggatcaaaccagcagacaatgatcctttgaatgacaaaaatgtaagcaaattcatttcggataaagagggccttgttacgacaggacaacgtttcttgccttctggcacctattattttgaagaattaaaaggtgtggaaggttacgagatggatgaagcaagtaagagaatcgaggtcatcatccctgaattttgggtggatgcaaaaggccaaccacaatatgtagtagttaacggacaggagatggctgaattagaatccgggaaagttccagtctctgcctatgaatccgcaacaccacgtgtttataacgagaccgtaaaagaaacaacggacaaaccgaaagagccgagtggtccaagcaatccaggtcaatcaggaaaatggtccgtattcccgcaaacgaatgaagcaagaacgttgatttctttactacgaattcttttattgttaggtgctgttttattaataaaaaaagaacggggagaaaaaaatgaataa

SEQ ID NO: 2156 - DNA (genomic), 354 bp, Enterococcus faecium; double-stranded, circular
  misc_feature (B) LOCATION 1...354
  hypothetical: NO
  anti-sense: NO
tccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacaactacatactcaaacgccctattcatactcgctttcgctacggctcggtctcttcaacttaacctcgcatgcaatcgtaactcgccggttcattctacaaaaggcacgccatcacccattaacgggctttgacttgttgtag

SEQ ID NO: 2157 - DNA (genomic), 354 bp, Enterococcus faecium; double-stranded, circular
  misc_feature (B) LOCATION 1...354
  hypothetical: NO
  anti-sense: NO
tccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtag

SEQ ID NO: 2158 - DNA (genomic), 2082 bp, Enterococcus faecium; double-stranded, circular
  misc_feature (B) LOCATION 1...2082
  hypothetical: NO
  anti-sense: NO
ggaggacagtgtatgatcgagttgggcaaaaaattaaatggccgttatcaaatcactggaaatatcggtagcggtggtatggcaaatgtatttttggcgcacgatttaatcttggatcgtgatgtagcagttaaagtcttacgatttgactttcaaaatgaccagactgcgattcgacgatttcagagagaagctttagcagcaacagaactcgttcatccaaacattgttagtgtttacgatgttggtgaagaagacaacatgcagtatctggtgatggaatacgtcaaaggaatggacttgaaacgatatatccaaacacattatcctgttccttatgaaacagcagtaaatattatgcagcagatcctttctgctatttctttagctcataaccatcaaatcatccaccgagatttgaaaccccaaaacgtactgatcgataatgaaggtgttgtaaaaatcacggatttcgggattgctatcgctttatctgaaacatcgatcacgcagacgaatacgatgctaggatctgttcattatctgtcccctgagcaggccagaggaagtatggcaacgaagcagtcagatatttatgctttagggatcatcctttatgagatgttgacgggtagcgtaccgtttgatggtgaatctgctgtaacaattgctttaaaacattttcaagatgatcttccatctataaaagcacttgatccaaatgtgccacaagcactggaaaacgtgattttacgggcaacggctaaagaacctgcagaccgttataagtcagccgaggaaatgtctgatgatctttctacagtattatcaccagctcgtgcaaacgaagaaaaatggcagcctcatgtgatggataatgaaacaaaagttatcacaccccttacggaagatgcaccaatgcctgattcattcaaatctatgcctctgccaaaagacaagccagaaaacgaaaccttaccagaggaggaagaagttctgcctgatcctaaaaagaaaggacagaaaaaatggtggctgatcctattagctattcttgctgttttaggaatcggaacagctgtattctttgcttctggcgggcgaggagaagttgttgttcctgatgtttctgatctttctgaagcttctgctagagaaacactcgcaaaagcgaaattagaagtagcaacaaaaacagaagaaattgcagatgacaaaatcgaagaaggtaatgtagtgaagacagacccggcagcgggaacgacagtcaagcaaaaacgcgaagtcactctgtatattagtagcggcacgaaaaaaatcaaattagatgattacagtggtaaaagttatgaagatgccgaagcaagtttgaaagaattagggttttctgctgacttgattcaaaaagaagaggaattcagttcagaggtagaaagcggaatgatcatttcgcaatctccatcagaagatacagaagtcgatcctaaaacagacacgattactttcacagtcagcaaaggaccagaaacagtgactttgagtagtcatgtaggagaaaactacgaaactgttcgtaattggcttgttacacaaggattcaatatcaataatattagtgctacttatgactatagcgacactgtaccatcaggttcgatcatcagtcaggatccagcctcgggtgaagttgtagcagaagaaacttacatcaattttgtcgtaagccaaggaacagagcctaaattgaatgatatctccggctatacaaaaagcgaagcacaaagttatttagctagtgtcggtgcagaatatatcgggcatgagacttccgaatattcaaacacggtggataaagataaagtgattcgtacagtaccaggggcaggaacgacaattaccaaaggaatggttgtgaacgtaatttactctaaaggaccagatccagcgtcttctagttctgaaaaagactcttcagacagttctagcagctcaagtagctccagtagcacaagcaactcttcaaaagaagaatcttccagctccacaagttcatcagctagcacctcagaaagttcaaaataa

SEQ ID NO: 2159 - DNA (genomic), 918 bp, Enterococcus faecium; double-stranded, circular
  misc_feature (B) LOCATION 1...918
  hypothetical: NO
  anti-sense: NO
tttaggcagtgcgttggcagtcgctttaagtgtcctgctggtaacggcaatgttgattattcaaaagaaaggcaaggtggtgcagacgtgaaaaagttaataaaaccgattttgttctgctttgtcctgtattacttgctgccgattattggaacgattttgtatgccagctccactaaatggtcaaaatcgcttttacctagtgattttaccttgcaatggttccaacagctgctgacggacagggaatttattgctgcggtgggtcgctcacttttattagcaggtgtggtcttggtgacgattctgttgttgatgattcccaccattatttggattcatttgtatttccctcgtttgaatcgttggctggaaaagctgctcctgctgccgtatgctttaccaggagtgattttggtaacggctttgcttcgaacgtatgctgaaactggtatcccaatgtttgtagtgttggtaggtgcattgtttattacggcgttgccgattgtctatcttagtcttaacaaccagatgcgcttaattaatctgaaggaattagtggatgcagcagaaaccttgggcgccccgatgtctacgattattatccaggtgctgtttccaaacatccgtatcggtgtgaccctagtttctctgatgattttttcttcggtttttggggagtacatgctgacgaacctgttgattggcggtcgatttcagacggtacgcatctatatgctgcggcggatgaacgaaaacggccatttggctagcgctgtgatggttttgtatttgctgtttatggtgggaattgctttaactacctttatgctgacttatcgacaaaagcaacagctgtcccttaagcagacgagggaagagaagcagtcgaaaaagaagcccttaaaggagttgtga

SEQ ID NO: 2160 - DNA (genomic), 186 bp, Enterococcus faecium; double-stranded, circular
  misc_feature (B) LOCATION 1...186
  hypothetical: NO
  anti-sense: NO
attttcaagtgctcttacttgcttaaaacaatcgaaatctctttttttcgaatggaaagaggaaaaagcggttgtgactttagtttgccacaaccgctaaaaggatcatgtatttataactgtaccgtctcttttccaagtaaccggaaagcagagaaagcgcgtcacataccacgaagtacataa

SEQ ID NO: 2161 - DNA (genomic), 468 bp, Enterococcus faecium; double-stranded, circular
  misc_feature (B) LOCATION 1...468
  hypothetical: NO
  anti-sense: NO
tcgaaaaagtgtttgtcaatatggagaaagaagcgatcagtattgaaaaaacaagtaattccagcatttacgctgattgaatgtctaattggactgatgatattgagcagtctattgctcacattcaatcttttgattcagcaaaccatccaagtaagtgaatttttgcagcgtaaagatcaaaaagagtggctaatatttttagcacaattagaagaagaactcaagagcagtcacaatgtctctgtgaaaaatcagcaactgcactacacgatcgaggataaacagtatatcatcgaaagatatcaggcaatgatacgtaaaagaagaacttccggcggacatcaacctatgttaacaagtatcactgagcttcaattattggaaaaagaacacacaatttctttttatgtacactttgaaaatggagaagatggatatgccatatggacaaaaaacgatcagtag

SEQ ID NO: 2162 - DNA (genomic), 594 bp, Enterococcus faecium; double-stranded, circular
  misc_feature (B) LOCATION 1...594
  hypothetical: NO
  anti-sense: NO
gttagggagtgtttttttatgaaacttactgttttttgcggttcccgttttggtaataaagaaagttacaaatttattgcgcaaacgttaggaaaatacatggcacaagaagaaatcgaactggtttacggtggttcatactccgggattatgggagtgattagtaaaacagtactggaaaataacggaaaagtcacaggtatctatccgaatgggctttttgaaactgaattgcctggaaaagatgttactacatttattcctacagaaacgatcgatgaaagaaaggtattattatttgaaaagggagatgctgtcctcgttttccctggaggtctaggtacattggaggaattctcacaacttctttcttggatagcaatcggtctgacgcccgacaagccaatcggaatattgaatattggcggttattacagcggcttgcaacaattattagaaacttttgcaaaagaggattttatggataaaaaatggttggatcaagtaatcttttccaacaatccattggaactggtcaatgaattacgagcagtatctattaaaaatcagttattattgaaggaggcaaaataa

SEQ ID NO: 2163 - DNA (genomic), 1038 bp, Enterococcus faecium; double-stranded, circular
  misc_feature (B) LOCATION 1...1038
  hypothetical: NO
  anti-sense: NO
agcggctggtggatcaatcgaggtgatctaatgtttagactattaaaagatgcttttaaagtaaaagacattagatcgaaaatcctatttactgtatttgtgttgtttgtatttcgcctaggtgcacatattactgtaccaggcgtaaatgctgcttcattgcaaaacctttcttctttgccatttttcaacatgttgaacttggtaagtggtagtgcgatgcaaaacttttccattttctcaatgggggtttcaccatacattactgcttctatcgtcattcagcttcttcaaatggacatcgtgcctcgatttgttgaatggtcgaaacaaggggaagttggtcgtaaaaaactgaatcaagcgactcgatatctgacattagtattggcatttatccaatctgtcggtatcactgctggattcaatcaatacgctcaattaggtttcgtgaataatcctaacgtagcaacttacgtaacgatcggtttgattctaacagccggtacgatgtttgttacttggctaggagaacagatcacagaaaaaggtatcggaaatggcgtatcaatgatcatttttgcaggtatcatttctagattgcctgaaagtatcagagaaatttatgaagattactttataaatattgatccttcagacatatggaaatctgctatttttgtggccattttactagtagcggtcttgttgatcgtgacattcgtaacatttttccaacaagctgaacgcaagatcccgatccaatatacgaaacgcgtagctggcgcgcctacaagcagctatctgccgttgaaagtaaatgcagctggagttattccagttatctttgctagttcgtttattgctacgccaaatgctgttttacaagcattgagcggtagattcggttctgaaaactggtacaaagtgatgatggagatctttaactataataacaggcacctggtgctaacgatttatacgattcctgatcgttgccttcactttcttctacgcctttgttcaagtaaaccctga

SEQ ID NO: 2164 - DNA (genomic), 957 bp, Enterococcus faecium; double-stranded, circular
  misc_feature (B) LOCATION 1...957
  hypothetical: NO
  anti-sense: NO
atggaatggtggggtattaaaatgaagaaaaaacgttttgtaactggatttgccgtattagcattttcagctctagtgttaggcgcttgcggcgcagatgacaacggaagctcaaactcttcttctgaatcatctacagcacaatcttcgactgcaaaaagcacaaccgcatcatctgcaaaagttgtagctggcggagatttgcaagacggcacatataaattagaagaaaaaaattattcaaatggttaccgtgcagtctttgaaatggttgtaaaagacggcaaaatcactgaatcaaaatatgataacgtcaatgaaaacggcgaatcaaaaacaaaagatgcagaatacaacaaaaacatggaagcaaaatctggcacaaacccagaaaaatacattcctgagttgaatgaccaattcttaaaagcacaaagcgcaagcggtgtggaagtcgtaactggagctactcactcatctgaaagcttccaaaactacgcacaacaattgatccaagctgctcaagctggtaacacagatacaatcgaaatcgacaatggtgctgatttgaaagacggcacttacaagcttgaagaaaagaactactctaacggctaccgtgtgcaattcgaaatgacagttgctggcggcaaagtaactgaatcaaactttgattatatcgacaaagacggtaaatcaaaacaagatgatacagaatataatgaaaatatgaaagcaaaaagcggtacagaaccaaaaacttacatccctactctgaacgacgaattcgtcaaagcaatgggcgaagaagatggctcacctgctaatgtacaagttgttacaggtgctacacacagctcacattcattcatcatgtacgcacaacaattagtgaatgcagctgaaaaaggcgacactcaaacaatcgaagtagataatatcgtaacagaaaaataa

SEQ ID NO: 2165 - DNA (genomic), 1017 bp, Enterococcus faecium; double-stranded, circular
  misc_feature (B) LOCATION 1...1017
  hypothetical: NO
  anti-sense: NO
aactcgtggtgggcacattctaacaatgagaaagagcgtccttatgtcaggaggaaagaaatgaacttaaaaacaaaagtattcaccttatctagcatgtggctgctggctggagtattgagcgcttgctccccctcttcagatgaagaaacagctacaactaccaattcgacgacttcatccaccagcacgcatacagtcacagatacgcttggacataaagtcgacattccaaacgcacctaaacggatcatcggcagttacttagaaaactatctgatttccctaggagaaaaacctatcgcccaatggacagtgggcagtggttctatccaagattatctgcaagatgatttgaaagatgttccaactatttcttatgatcttccttacgagaaagtattaagcttcgaacctgacttgctgttgatttcttcttccgctactgtcgaaggtggaaaatacgagcaatatagtaaaatcgcgccaacttatgtcgtaaaaaatggaacagacgtcacatgggaagaacaactaaaagatgtcggcaaggctttggcaaaagaaaaagaagcggaaaaagtcatttccgattatcaaaaatccgtcgagagcactcgcgaagaattagcagataaaattgagaacaagacagctgcagtgttatgggtgaccaataactccgccttcatggtcagcaaaaatcggtcaagcggtataatcgtatatgacgatctaaaatttggtgtgcctgatttagtagaagaagtgtccaaagaagccacttctgactggtctgctgtttcttcggaaaaactagctgaattagatgctgattacatcattcttgtaaacagtgataaagatgctgctatgttcaatgaaccaagctggaaaaatctcaaagcagtgaaggacaatcacgtactgcaattcggccctgaatctagctggctatataatggacctattgccagtcaggaaatggtcaatgatatcaaagaaaagctaaactga

SEQ ID NO: 2166 - DNA (genomic), 417 bp, Enterococcus faecium; double-stranded, circular
  misc_feature (B) LOCATION 1...417
  hypothetical: NO
  anti-sense: NO
tgtccgtggtggcggacattagctaacatttatttttttgtccaaagctatttacacaatgattttttggtagaattgatcttgcttcctattctagttattattgtgatcgtcgtgtcagatggtattaacaataattccggtatcatttccgcaatagctacgttgttgctgattgcgttgagcatccctcaaggcgaatccgctttgtatgctatccaacgtgtactagatacttttatagggacattcattgcaatcggtatcaatttctttcttcgtcctcctgaaacagaaaagaaagaagaactatcagaagatttggtcgaactccaaaagaaagaacgattgctaagaacaaatttacaagagatagaagctaagatccaaaaacaaaagaaaaatagcgaggactaa

SEQ ID NO: 2167 - DNA (genomic), 999 bp, Enterococcus faecium; double-stranded, circular
  misc_feature (B) LOCATION 1...999
  hypothetical: NO
  anti-sense: NO
tatatgaggtgtaattttagtcttcacactaaatctcagggaggaaaagtcatgactgatcgtatctcgttagaaaaggaagcagtagcattcagtgatgcaaatgcgcctcatccgcgtatctatgaactagcaccggaagaaggaagagttttactagaagaagtacaagaatcacctgtgaacaaatattccgtcgatattgaagacttgatggtggatactggcgaatggggaaaactcaatattcgtctcgtacgaccagaagggaatatggataaattaccagttattttttatattcatggagcaggctgggtttttggcagtgctcaaacccatgataaattgatcagagaacttgcggttcgtacgaattccgtcgttgtctttccagaatatagtcgatcaccagaagcaaaatatccaacagcaattgaacaaaattatgctgtgttgcaacagctgaataaattagccaagtcaaaaaatctggatctcgagaatctaatcgttgcaggagattcagtaggtggtaacatggctacagtcatgacgatcttaacaaaagaacgaaagggcctcccaatatccaagcaattgctgtattatccagtcacaaacgctgattttgatacagattcctatcatgaattcggagaaaactattttttgacaagagaaggaatgatgtggttttgggaccaatatacgacgaatgaagaagagcgtgctgaaatcacagcttcgcctttgagagcaaatataaatgaactaaatgatcttccttcagcaatgattttaacgggagaagcggatgtattaagagatgaaggtgaggcttatgcgcgcaaacttcgtgatgcaggggttcctgttacacaagtacgcttccaaggaatcatccatgattttgtcatggtaaatgctatggatcagacaaaggcaacgcgtgcagcaatggcattatctacttcttggatcaagaaaaaagaataa

SEQ ID NO: 2168 - DNA (genomic), 1302 bp, Enterococcus faecium; double-stranded, circular
  misc_feature (B) LOCATION 1...1302
  hypothetical: NO
  anti-sense: NO
aataagaggtggaaaaaaatgaaaaaaattattgttactacctgtctgctagctactggatttcttcttactgcttgtggtgaaagtcaaagctctaacgaatcacaacagacaacgattcaattcatgcactcttctgtcgaacaggaacgattaagtgtgatcaatgaactggttgctgattttgaaaaagaaaatccagacatcaaaatcaagcaagtgccggtagaagaatcagcgttcaatacaaaaatcgttacgttagctcgttccggtaaattaccagaagtaatggaagtcagtcaggattttgctaaagtgatggataaagatgaactgattgatcagacggcagtccaaaacgttatcgaggaagctggagaagataattattatgacggagccaaaaaccttgttcgttcagaagatggaaaaagctatattgctgcaccaattagcggctgggttcaaggtatttggtatgacaaagaaaaattatcagaagctggtttttcagaaccagaaaattgggatgatattttaaaaattgctcaacatttcacagataaagagaataaacaatatggaattgctatgcctactgctgaaggaacaatgagtgagcaagcgttctctcaatttgctttgtcaaatggagcaaatgttttggatgatgaaggcgaggtaacgatcgatacggaaaagatgagagaagcattgtcgttttatcaaaacttatcccaatacacgatgccaggctctaatgatgtgacagaaatcaaagatgctttcatgaatggaacagcaccaatggcaatctattcaacttacattttgccttctgtttatgaagcggggaactcagaaaatatcggttttgctatcccaacacaaaaagatcaagctgtctatggcacagtatctggattgacgatttcttctggtctagacgagaaacaaaaagaggctgctgaagcattcacagctttcttatctcaaccgaaaaacatggaaaagtgggtcttgatgtctcctggtggtgctcaaccagtgaataaacaagtagtcgaactggatggttacaaagaaaatgaagtcatcaagtcttttggcgagctgccatctgagattgctagtgcttttgatgaagtacaagtctttggactagtcggggaaaagaatttcacgaaaatgggagatatcacaagctcaggtgtgatcggaaaagcagtgaaccaagtaactgtcggaaacgaagatgtcgatcaagctttagctgacgcacaaaaaaatacgaaataa

SEQ ID NO: 2169 - DNA (genomic), 237 bp, Enterococcus faecium; double-stranded, circular
  misc_feature (B) LOCATION 1...237
  hypothetical: NO
  anti-sense: NO
acttggaggtgctgtatgactacggcagaaatgattaaagaactgtgtgagcaaatgaatataagtgtttccgaacttgctagacgtattggacagactccacagaatttcaataagaaattacaacgagaaacggtaaccttagatgagttgaaagcgattgctgatgtgctaggtgtcaagtttgtgcaggcttttatattgcctgatggcaatgaaataaagataggtaattag

SEQ ID NO: 2170 - DNA (genomic), 957 bp, Enterococcus faecium; double-stranded, circular
  misc_feature (B) LOCATION 1...957
  hypothetical: NO
  anti-sense: NO
gaggtttttcgtgtctatttttgtttggccgcaatcaactggtctagcaaacgtgaaaaccaaatcttcaaaaagggtgcgcgcatgaaaatcaaaaagatctttaatcaaaatgcagtattggtagatgacggtggacaggaaaaagtagctattggaaaagggattggatttgacagaaaaagaaatgatttgatttttgatcgtgatgtcgaacggatatttgtcatggaaccagaaggtcaaatcaagttgcaaaatttacttaatcagattgatgaacgctttttatttgcagcagaaacgatcattgatcatgcggaaactgttttgatggaaaagttgaatgaacatgtattgatcgctttgaccgaccacattgctttttctgcggagaacattaataacggtatcgtcatccgcaacaaacttttaagagaaatcgaagtgctttacagtgatgaattcagtattgctcaatgggcagtagagtatctgacaaaagagcttgggattccatatacttatgacgaagcaggatatatcgcaatccatattcacagcggacgaagcggtcggaacaataaccatcgcagtatccgtgaagtgacgattgtatctgacatcatccatttagtggaatcagaattggaaacagatatccattcagaaccattttcactgaattattcaagactggtgaatcatttacgactgcttctacaacgaacccatgcgcaacaatatgctgttttagacacggaaatcgtagaaatggtcaaacgaaaatacccagaaagctataagatttctaaaaaaatccgtgtgttgctgaccaaagaataccagctcgcgatcacgaaagaagaactgggttacttggccatccatatcgagcgtttaagaagcgcaatcgtacaaacaaatgttaacaatcatgaggaggaaaaaaattga

SEQ ID NO: 2171 - DNA (genomic), 186 bp, Enterococcus faecium; double-stranded, circular
  misc_feature (B) LOCATION 1...186
  hypothetical: NO
  anti-sense: NO
ggaattttgcttggaaaagtggtcaaaagggaaaagactggcattttatttattgattttcaggaaaatcccaatattttattttcattcatctttataagggacattacatatgtaaaaagaaaaaacatttttagatcagcctcgtgggctgtcgactttattcttcgctttatgtttagctag

SEQ ID NO: 2172 - DNA (genomic), 387 bp, Enterococcus faecium; double-stranded, circular
  misc_feature (B) LOCATION 1...387
  hypothetical: NO
  anti-sense: NO
gtatactttcgcacacatgcaaaaaataatataaagcatagaataaaggatctaagctattggcttagatcctttatttcgctaaacaaccccaccgtttttttatatggtactttgaaaaggaaagttgtaagtattaacccatcagctattactaaaaataataaaaagtcatctccagttcattcccattggctttacgtaaagcttcaagttataccgctagagttaagaacgatatatctttcgttggataggactggtataagccaatcgaaatcgtttaattcgaatctattgaagtatgaaaatcaactacaccgtcgacctagtaagtttttctttagtaatcaatttttccctattttctcttcgactgtttattga

SEQ ID NO: 2173 - DNA (genomic), 198 bp, Enterococcus faecium; double-stranded, circular
  misc_feature (B) LOCATION 1...198
  hypothetical: NO
  anti-sense: NO
aatttatttcgtcgtttaataggtcgatggtcttgttctattaaattgttaagatacttcacagttcggtgctctgtcttagtatataaacccacactctgtaactttctaaaggcggagccaagagaaggtgctttatcggtcacaattgctttcggctcaccaaactgtttatggagtcgttttaagaaagcatag

SEQ ID NO: 2174 - DNA (genomic), 198 bp, Enterococcus faecium; double-stranded, circular
  misc_feature (B) LOCATION 1...198
  hypothetical: NO
  anti-sense: NO
ccttttattttcagttttccaaagaaagtattttggttcgatacttggcatcaatttgatcaattcagtcatcaactggctactcaacagtttaatctttctgcccatgtttttaatcagcggagtgagtacttatatgcagctgcttttcagttcaaatgcggtacctacgggtgtcatgccagaagattttcttga

SEQ ID NO: 2175 - DNA (genomic), 324 bp, Enterococcus faecium; double-stranded, circular
  misc_feature (B) LOCATION 1...324
  hypothetical: NO
  anti-sense: NO
aaagctttgctaacttcgatgcaagtgaaaggtggtaagtgcatgatcatcaatgataatggcagagagtatgatacagaaaagattgaagagtattcatcttatactcagggattaattaaacgtttgatatacgttcgctatgtaggtattagggatctgttatcagataactgttgtagtaaatacaaagtgaatcaagtaagagaagcgttgaataaagataataacgtcgaaagaataaaaaatgtttttggatatagtattgaagagattaattattacattgacttcgctgaagctttcattccgatggtgagataa

SEQ ID NO: 2176 - DNA (genomic), 1011 bp, Enterococcus faecium; double-stranded, circular
  misc_feature (B) LOCATION 1...1011
  hypothetical: NO
  anti-sense: NO
atctatttgctaggaggaatttacatggaagagaaaaatttaacggtcatcggaagctatagtacgagggaagaagcattatcagtaattgaacggttgcgtaacgaagggtatgaacgagatgatatcgttatttatactactgatgaagcagcatctagactaggatttgacggattgtctggtatagatgttgaaacagatgaaaatcggatggatggtgaagaagaccgttctttatgggaaaaaataaaagatactttttcttttgatacctatgattctgagacggctacaccagaaaatgatcctttatatcaatatagaggagatatttctgatggaaaatttgtcatcacagtaaaaggctatcgtcagccagaaacaacagaagatacaatggatacacaagatactgttagcccagcaagcacaatggggactggattagaaactggcactggaacagatccaatggacgtaggtggcacgacaggctttcaaaatacaacggatccattgaatatgacaccaggaactgatccgatggacgtacctggcgagactgatacaatgggtacaagcaagactgaagacatcgatcgcaaaccaaatctagatgatgatacaattcaactaaaagaagaaaaattagatgtaaatacacatgatgtgacaactggagaagtcgacatccacaaacatgtggtcaacgatactgaaacggtagaagtaccggtcaaacgtgaagaaatcgtcatcgaacgcaaaccagtaacagatcaatcttcacagggaacagacgaaaaattggaagatgacacgattactatcccaatcaaagaagagcaagtagatgtaagcaaacatacagttattcgtgaagaagttgggattcataaagaagaacatgaagatgttgaaaaagtgacagaagatgttagccgagaagaattggatattgacacaagcggtgatgtacacattgaagaccgcaataaaaaatcgtaa

SEQ ID NO: 2177 - DNA (genomic), 345 bp, Enterococcus faecium; double-stranded, circular
  misc_feature (B) LOCATION 1...345
  hypothetical: NO
  anti-sense: NO
agcaatttgctcttggcaaattgctttttctatttgttgcttattttggaggatttgttcatgattaggattttaatgattatcgccactttagtattattattcgttagctattatttatttaataaacaggatatcttttttgtattgatcaacaaaaatgataaaaatcaaggattcctacaattttacggagctgcatatgctgttttaggcgtaatgggtattttaacagcttttttcaatcaacgctttattgccttggtctttttactgatcgtaattattgtttctgccaccttcagtatccgatttgcaaaaaaaattgctgaaccaaagcagtaa

SEQ ID NO: 2178 - DNA (genomic), 1950 bp, Enterococcus faecium; double-stranded, circular
  misc_feature (B) LOCATION 1...1950
  hypothetical: NO
  anti-sense: NO
aaaaatttgctggacaaggagatggaatatatgactgcaagtcatccattctatgaacgtgaatcacttgtgattttaggcgatcatgttactttagacgctggtactggattagtccatactgctccaggacatggggaagatgactatatcgctggtagcaaatataaactatctgtagtgtcacctgtagactcaaaaggattgtttacagaagaagcacctggatttgaaggtatcttttatgacaaagcaaatcctatgatcactgatctattaaaagaaaaaggagctttgctgaagctagatttctttactcatagttatcctcacgattggcggacgaaaaagcctgtgatctatcgggcaactccacaatggtttgcatctatcgataaattccgtcagaatattttggatgaagtagaaaaagtagagtgggttatcccatggggtaaaacacgtttgtataatatgatccgtgaccgcggcgattgggtaatttcccgtcagcgtgcatggggagtaccacttccgattttctatgctgaaaatggagaagcaatcatcacaccagaaacaatcgaacatgtggcaaaattatttgctgaacatggatcaattatctggtttgaaaaagaagcgaaagaacttcttcctgaaggatttacccacccaggttctcctaatggcgaatttacaaaagaaaaagatatcatggatgtctggtttgattctggttcttctcatgaagctgttttacgtcagcgaccagaattatcattcccagcagatatgtatttagaaggatcagaccaatatcgtggctggttcaactcaagtatcacgactagtgtggctatcaatggtgtagcaccatacaaatcagttatttctcaaggatttgctttagatggtgaaggccgtaagatgagtaaatctttaggaaacatcattgcaccagaaaaagtgatcaaacaatttggtgcagatatccttcgcttatgggtatctagtgtagattatgaagcagatgttcgtgtttctatggatatcttaagtcaagtggcagaagtatatcgtaaaatcagaaatacgatgcgtttcttattagcgaatacagaagatttcgatcctaaaaaagatactgtttcgtacaatgatttacgttctgtagacaaatatatgaccgttcgattgaaccaagtaatcaaagaaatccgagaagaagggtacgacaaatataacttcatgcatatttaccgtacagttatgaacttcttgacggttgatctatcgtcattctacctggattttgctaaagatgtagtttatattgaagcagaagatgattatcaacgtcgttgcatgcaaactgttttctatcaaacagctgtagctttgacaaaattattgactcctatcattccgcatacagcagaagaaatctggtcattcctgaaagaagaagaggagtacgttcagttaagcgagtttcctggttatgaagagtttgcaaaccaagaagaattgatggatacctggactgctttcatggacttccgtgataatgtcttaaaagcattggaagaagcaagaaacagcaaattgattggtaaatctttggaagcaaaactaactgtttatccaaaacaacaagttcgtgaaatgttaaaagctttggatgcagatattgcacaattattgatcgtttcaccagactactttgaagttatggcagcagatgaacaagtgccagataacgctatggtatttgatgatgttgctattacagtggaaaaagcagacggggaaacttgcgatcgctgtcgccaagttcgtaaagatgtaggagtagatgaaaaacttcctcatctatgcggtcgttgtgcaaaaatcgttgaagacttctatcctgaagctgtagctgaaggattcgaagaaaagtaa

SEQ ID NO: 2179 - DNA (genomic), 813 bp, Enterococcus faecium; double-stranded, circular
  misc_feature (B) LOCATION 1...813
  hypothetical: NO
  anti-sense: NO
tattgtttgctgttccttttaacggcattattcattttcccgatgctgtggatggtagtttcctctatgaagcctgaagcagatgtctatcaaaatttagcttccttcaaagcttttttacctagtttgaatccagctaattggtttaaaacttatcaagaggttatttcccggttcagtgtgggaacttatttattaaacagtattttttatggtttaacctttgcctgtgggtcaatcattgtaaactctttggcgggttttgcctttgcgaaggttaatttttcaggcaagagaattatctttggagctttgttagctctgctgattgtcccgatggagacggttttaattccgcaatttaccatcgttaattcactaggcttagtgaatactcgcttggcagtgattttaccagcgatggccagcgcgtttaatatctatctgtttagaaatttctttatcgcgattccagaagaaatcattgaatcagcgaaattagatggtgcaaatattgttaaaattttctttcacatcatgctgccaatgtctaaaccagccatagccacagtaggtgtcttatcctttatctccagctggaatgattatatttggccgttaatggtcttaactgacagcagcaaattttcaatgcaagtggcaattactacgatcaatactacacagccagtttatatcaatcaagtgatggctgttttaaccattgcaacgattccactgattattgtttatatcgttgcacaaaaatatattctgcagggacttggcggttctggaacgggtataaaatag

SEQ ID NO: 2180 - DNA (genomic), 342 bp, Enterococcus faecium; double-stranded, circular
  misc_feature (B) LOCATION 1...342
  hypothetical: NO
  anti-sense: NO
caactgcttcgactgcttcactttcagtttctacttttacttcattccatttcatatctgtcactccttaataacttgggtacggtaaataagtatctgcttcattttgctgttttacttctactaattctgctagttgctgattatcccagtgaagctcgaatacagcttcgtcatcgtcttcatccaaaaaatcaagcaaatcgctttgcccttgagctaatacttcatttagatattccactaaagaatcagctactgattttgccaaccctttttttccttcataagggattactgctagataattgcgttcatcaaaaacagatttctgaggattaa

SEQ ID NO: 2181 - DNA (genomic), 684 bp, Enterococcus faecium; double-stranded, circular
  misc_feature (B) LOCATION 1...684
  hypothetical: NO
  anti-sense: NO
tatgatattcggaaaaagaaatctcaaagggaggtaacttttatggggttgaatgaatttattttaggattgaacaatttagagacgatcacaagggcacctggattttttaaatatacagagcatacagttgcagcacattcgtatcgtgtagcatctattgcgcaagttctaggagacattgaagaagcgaatggacaaccgatcgattggaaactgctctatgaaaaatcattgaatcatgactacacagagcgttttattggtgatatcaaaacgccggtgaaatacgcaagcaaagagttaagagggatgctgcaaacagttgaagaaaagatgacggacgaattcatcaaccaagagattccagctgagttccaagaagtttatcgccgtcggttgttcgaaggaaaagatgaaaccgtagaaggagaactattagccatttcagataaggttgaccttctttatgaatcttttgatgaaatcatcaaaaataacccggaaaaagtttataaggagatgttcattgaggcagtgactacgattaaaagctttgaacatcggccttctgttcagtatttctttaaagagatatttccggaactattgaaccaggaattttatggaaaagaggcgtttttagaaaccgtctcaacgattgtaaagaaagaagaaaaataa

SEQ ID NO: 2182 - DNA (genomic), 258 bp, Enterococcus faecium; double-stranded, circular
  misc_feature (B) LOCATION 1...258
  hypothetical: NO
  anti-sense: NO
tgcatcattcgtggtgaagacgacattgtaaacctgcgtattaaggctggaaaaggtataacagaattatctaacgaatatggcgttccaaagggcacaatctctacctgggtaaagcttctttccccaatacaggtttcagagacagaaactatttctatgaaagagtataaggctcttcaaaagaaaatgaaagaactagagatagaaaatgaaatattaaaaaaagctaccgccatatttgccaaaaatcaatag

SEQ ID NO: 2183 - DNA (genomic), 282 bp, Enterococcus faecium; double-stranded, circular
  misc_feature (B) LOCATION 1...282
  hypothetical: NO
  anti-sense: NO
ccgcaaattcgtcgtttacgtttggaaaaaccgggacagcctcattttcgagttggtttatctgtaggaaaaaaggtcggcaacgcggtaaaccgcaatgaagtcaaacgaaaaatccgagcagcagtttattctataaaagaagaaattgatccggagttggattttattgtgattgctagaccaagtgtgaaggggttgacttatgatgaggttcgctccaatttagtccacgtcttaaaacttgcaaaaataatcgacagagaggaaaagagtaagtga

SEQ ID NO: 2184 - DNA (genomic), 1050 bp, Enterococcus faecium; double-stranded, circular
  misc_feature (B) LOCATION 1...1050
  hypothetical: NO
  anti-sense: NO
ggaggaattcgtatgtcagaaaaggaattaatgaaggtagtcggtttttatgaagggttgccgatcgatgatccaaaaagctttattgatgaaaaagaacagatacctgtacccagttcacgggatcttctggtaaaagtcaacgcagtatctgttaatcctgtcgatacgaaacttcgccaagataacgggataagaaatgctttacgtatcttaggttttgatggagtcgggaaagttgttgctgtaggtgacgaagtgcaaaaattttctgtcggcgatcgcgttttttacgcaggtacaacaacaagagcaggaagcaatcaagaataccaactagttgacgaacgtattgtcgctcttgcaccaaaaaatctttcagatgaagaagctgcagccttgccgttgacctcattgaccgcttatgaattgttatttgaaaaatttggtctaactccagaagaaaatgccaatcgcgggaaaaaaatcttagtgatcaacggatccgggggcgtcggttcgattttgaatcaactagcgcattgggctggcctagaagtctacgcgactgcaagtccgaagaattttgaatggctgaaaaaaacaggtgtagactatccaatcgattatcatcacgacttaagtaaaagttttcgtgaattaggaatcgatcaagtagagtatgtcgctgtattattcgatattacccgctactttgatcaaatcaagcaccttgtccgaccatttggacatgtgggaacgatcgtagggatcaaagagccgttagatataggtgtttggaaaaaccaatctatcagcttcgactgggagtatatgttcgctaaaacagactataactatgaaatcgaaacgcaaggagaagctttagcgcacattgctgctttagcaaatgaagggattatccgcagtacattgagcaaggtctattcagatgggatgaatgcgaagaacttgaaacaagcaaccaaagacgtagaaacaggacatatgttaggaaaagtcgttgttagtggtccgttcaacggataa

SEQ ID NO: 2185 - DNA (genomic), 324 bp, Enterococcus faecium; double-stranded, circular
  misc_feature (B) LOCATION 1...324
  hypothetical: NO
  anti-sense: NO
aaaatggttcgtcctcaagaagtccgtgcgccaaaagaaaaaatagaaattttagcaattattgaagacggcacacaaacaaagaagggatactcgatcgctttagtaaagtggaaaggaaaaaaaggtgttgctctgagatgggatggagataaccaacaagataaaggattccctgtcacagctaacggttatcatccagcgtggtttgttctgcctgataaatttatggaattatacagctatgattatgcaagagccgcagcatcaatcaaagcattagataaattaacagaagagcagaatgaaatggaggaaaaataa

SEQ ID NO: 2186 - DNA (genomic), 228 bp, Enterococcus faecium; double-stranded, circular
  misc_feature (B) LOCATION 1...228
  hypothetical: NO
  anti-sense: NO
attctattgctccaaatcaaggcaaaggaggaaattaccatggcaaaagtttgttactttacaggtcgcaagacaaaaagtggaaacaaccgttcacacgctatgaactcaacaaaacgtactgttaaacctaacttacaaaaagttcgcgttatggtcgacggaaaacctaaaaaagtttgggtgtcaactcgtgctttgaaatcaggaaaagttgaacgcgtttaa

SEQ ID NO: 2187 - DNA (genomic), 810 bp, Enterococcus faecium; double-stranded, circular
  misc_feature (B) LOCATION 1...810
  hypothetical: NO
  anti-sense: NO
tttatattgctagtagaaaaaaaatatgctattatttgtattgaggtgatcgtgaaaatgcttacagaggaacgcagacaaaaaatcctagacttgcttgaacagcagaaaatcgtgaaatcacaagatcttgtaaaccttttgaatgcttctgaatcaacgataagacgtgatttacaagagctggagaatagtgggtttctagaaagagttcatggcggagctaagaaagagcaattattgaattttgagcagaatatgagtgaaaaatcactcaaaaacgttcacgaaaaacagcaaatcgccaaatcggcagctgaaaccattaatgacgaagatgtcatttatttagacgctggctctactacgttagaaatgattccttttctgcaaggaaaacagatcacagtagtgacaaattccgttcaacatgcggcaaatttagttgatttggagcttgctaccattattttaggtggaacgataaagctggcaactaatgctgttttaggatctaatgcgatagaacaactaaaaaattttcattttaataaagcatttatgggaatgaacggtgcccatcttgaacaaggattcacgactccggatccagaagaggcagctgttaaacgtttagccatgaaaaattccgaagagacatttgtattgattgatcataccaaattcaaccagttgtccttcacctctgttgcacctttggaagcagccacgatcataaccgagcgttgtccattagaattcgttaatgaattccgtgaaaagacaacaattaaggaggcaatacaatga

SEQ ID NO: 2188 - DNA (genomic), 276 bp, Enterococcus faecium; double-stranded, circular
  misc_feature (B) LOCATION 1...276
  hypothetical: NO
  anti-sense: NO
agaacttctcgattgaagcgttcaggatcttttctagctaattcatgtccttgttctttcacaagcacaaaggaagcttttggtatagttttagctatatacaaagaatgttttagcttgattacatctttttttcccacgatgatcaaagtgggggagttgattttttttaaatcattttctgtaagcccgatgtcatgcagcaaaagtttgataactaaaagatttttgcgaagacttgggcgaaataaagagagtaaccatacccatgcataa

SEQ ID NO: 2189 - DNA (genomic), 984 bp, Enterococcus faecium; double-stranded, circular
  misc_feature (B) LOCATION 1...984
  hypothetical: NO
  anti-sense: NO
atgaattctcgctacaagatcaacttggttttactatcaaagcaccgagatggggcagcagcttacaagtttccgccagaagaagttgaaacgctaatcgaaaacatcgaatggacagtcggtcgaacaggggtagtaacgccaacagctatcatgacaccagtccgagtagcaggaacgacagtaagccgtgccagcctgcataacggtgattatattaagttgaaggatatccgcttgaaagatacagttctgatttataaagcgggagacatcatcccagaagtttcgcaagtcgtgttagataaacgacctaaagacagcgaagaataccaattgcctacacattgtccagtttgtggaagtgaacttgtccatttggatgaagaagtagccttacggtgcatcaatcctaaatgccctgctcaaatgaaagaaggtttgaaccactttgtttcaagaaatgcgatgaatatcgatgggttggggccgcgcgtactagaacagatgtatgataaaaaactagtagcagatgttgctgatctttacaaattgacagaagaagagttattgacgttggacaaaataaaagaaaaatcagcaaataatattttgacagcaatcgacaacagcaaagataattcggtcgagcggttgattttcgggttaggaatccgacatgtcggagcgaaagcagcaaaaattttagcagaacatttcggtgatctagaaacattgagtaaaagtgactatgagtcgattattgcgcttgatacgatcggtgatatcattgccgacagtgtagtcacttatttcagtaacgaagaagtccatgaattgatgaatgaattaaaacaagcaggcgtcaatttcgaatacaaagggcttcgaaatgcccaattgcaagaagtcgagtctccttttaaagaaaaaacagtagtcctgaccggtaaacttacaagttttgatcgtgctgagatataa

SEQ ID NO: 2190 - DNA (genomic), 627 bp, Enterococcus faecium; double-stranded, circular
  misc_feature (B) LOCATION 1...627
  hypothetical: NO
  anti-sense: NO
cgaatttatcgaagacgcaggcaaacgatcagcagaaatggtgatcgaatttgtcaaacatctcgtataaggaggactaagatgaacgcattgatctcgattgactacacatatgattttgttgcagaggatggaaagctgactactgggacagcaggacaagtaattgaaaaaaagctgactgctcatacaaagaagtttattgatcaaaaggattttgtcgtttttgccattgatgcgcatgatccaaaagattcctttcatccggagaaccgcttatttcctccgcataatgtgataggaacgggtggacgggaattgtacggctctttaaaaagtttataccaagactatgagcaagaggaaaatgtttattggatagacaaacggcattattccgcttttagtggaacagatctagacatccgtttgcgagaacgccagatcacagatatttatttgaccggcgtatgtacagatatctgtgtgttgcatacagcagtcgatgcgtataatttaggatacaaactccatattttcaaagattccgtggcaagtttcgatcccgttggacatgaatgggcattgagacattttgagtccacactaggcgcagaaattttataa

SEQ ID NO: 2191 - DNA (genomic), 1254 bp, Enterococcus faecium; double-stranded, circular
  misc_feature (B) LOCATION 1...1254
  hypothetical: NO
  anti-sense: NO
agatcctatcgtttggattattttttaagatcctatcatcagttatacttaaagaaagaggaaaaatgtatgaaaatcattcgacaaattgaagtgtttgcaccagattacttaggaaaaatggatgtactgattgccggtgggaagattttggctgtagaagaacagctagaaggcggctacgaaggagtggaagtagaagaactttcaggtgagggaaaagtactaaccccgggtttcattgactgtcatttccatattttaggtggaggaggagaaggcggttatcaaaatcgaacgccagaagtcacattgagccaattgactacagctggtgtaacgacagttgtcggttgtttgggaacagacggagaaggtagagatatgactgcgttgatcagcaaagcgaaaggtctggaagcagaaggaatctccacttatgtatacgaaggttcgtaccgattgccggtaaaaacagtaacagattctatcatcaaagactttttgacaattgataaaattatcggaatcggagaaatcgcagtatccgatcaccgttcttctcagccaagttttgaagagttcgctcgtgcagtagcagatgctcgtgtaggaggcatgttatccggaaaagctgggatcatcaatgtccacttaggcggaggaaaaagaaagctagagctattgacacgaatcgtagaagaaacagaaattccgatcacacaatttttgcctactcatgcaaatcgcacaccagaattatttgaagcttgcgtggcatttgccaaacgtggtggcacgattgacttcactgctagcgaagatcctgatttttgggagaagacagatggtgaagttcgcttcagcaaagcactgaaacgattgatcgaggaagatgtttctttagataatttcacgatgacctcagatggacaaggaagcttgccttattttgatgaaaacaatcatttcctagggttaggagtaggaagtgccaaggcattgctagtagggatcaaagaagctgtgcaaaaagaaagtatccctttggaaatcgccttacgagctataaccagtaatccagcacgtatattgaaattggataaaaaaggaaaaatcgaaattggtgctgatgcagatctgtgtatcttggataaagaaacgcttgatattgatacagttatcgctaaaggagaaataatggtccaagaaaaagaagtcaaagtatgggggactttcgaaaaaagtttttaa

SEQ ID NO: 2192 - DNA (genomic), 225 bp, Enterococcus faecium; double-stranded, circular
  misc_feature (B) LOCATION 1...225
  hypothetical: NO
  anti-sense: NO
cccccatatcgacaatatgctgcggattacttcggacgggcgcaagctggcgctggatcagcggctgcaaaatccgctcctgcccgacgacccggacagcaaggtcaacgcctgcgtgaaaaatatcgtgcaggaatggcaggccagcacggagattttaggaacacaattagtgttttgcgacctcagcacacccaagggggacggctcattcaatgtctatga

SEQ ID NO: 2193 - DNA (genomic), 516 bp, Enterococcus faecium; double-stranded, circular
  misc_feature (B) LOCATION 1...516
  hypothetical: NO
  anti-sense: NO
aaacaccatcgtttccaaagcaatcgttgtttgtcaagtaatggaacgttcttagaaagcaggagtgaaatgacagtacagcaagaaatagtagatacaataaaaaaatacgataaaatcattatccacaggcatttgcgccctgatcctgatgcattaggatcacaagtaggattagccgaactattacgggaaagtttcccagaaaaagaaatacgtcaagtaggtgaaacgattgaagggcttcgctttttagcagaaatgcaagaagttgaagatgtcttctaccaaggagcgctagtcatcgtgactgatacagctaattcacccagaatcagtgatcaaagatatcagttggcagaaaaactgatcaaaatcgaccatcatcccaatgatgacccttatggagatcttgtgtgggtaaatacaaaagcaagtagctgtagtgagatgattgcagaatttgctttgatgtttcctgaatctttaaagatgaacgttaaggggccccgggtc

SEQ ID NO: 2194 - DNA (genomic), 606 bp, Enterococcus faecium; double-stranded, circular
  misc_feature (B) LOCATION 1...606
  hypothetical: NO
  anti-sense: NO
gaaaggcatcgattagctcgtgagcttcatgattcagtttcacagcaattatttgcagcgatgatgatgatgtcggcattgacggagcaagcagaaaaaagtgagacaccagaaatgttccgtaagcagttgaaaatggtggcagagatcatcaacgcttcccagtctgagatgcgtgcgctgcttcttcatctgcgtccagtcaatttagaagaaaaaagtttaaaacaaggcattgagcagttattgaaggaattgcagaataaaatccagatttcgctaaaatgggaggtagaagatgtaaaattaactagttccattgaggatcacttgttccgaatcgttcaagaattgttatcaaacacattaagacatgctaaggctaatgaattagaagtctatttgcataaaatagataacaatcttttattacgtatcattgacgacgggacaggatttaatatgaatgaaaccaaaacgggaagttatggattgaacaatatcaaagaacgagtagctggtattggtggaacagtaaaaatcattagttttaaagggcaaggtacgagcgtggagaccaaggtccctttgatgaaggaggcatag

SEQ ID NO: 2195 - DNA (genomic), 210 bp, Enterococcus faecium; double-stranded, circular
  misc_feature (B) LOCATION 1...210
  hypothetical: NO
  anti-sense: NO
agaattaatcggataaggaggacaacaataatggctgaattaaaagttactttaaaacgcagtattatcggacgtcctcaaaaccaacgcgatacagttaaagcgttaggtcttacaaagattaacagttcagtggttaagccttctaatgaagcaattaaaggcatgatcaatactgtttctcacctagtggacgttgaagaaatttaa

SEQ ID NO: 2196 - DNA (genomic), 681 bp, Enterococcus faecium; double-stranded, circular
  misc_feature (B) LOCATION 1...681
  hypothetical: NO
  anti-sense: NO
gtgttcctgctggaaactattttgattatcgaagacgatgaagctgttcattctttactggaggaggttcttgaacagagatacaaacttcttgatgcttattcaggtacggaaggaaaattattgttaagcacatatcctgtcgatttgatccttctagatctcatgcttccagggctttcaggtgaagcattgttagcagaaatccgacagacatcgaatgttccgatcatcgttctttcagcaaaaagcgatcaaagagataaagtttccttgttggcagcaggagcggatgactatgtgacgaaaccatttgatatcgaagaactgttgttacgaatcggcatccaacttcgtcatcagacttctgtccaagtaaaagatctgtcgcaacgcatctattacaaggaaatcttactggacaaagagtcgagggatgtaaatgtgaatggtgtggctgtccatttgacaggaagagaattcgatctgctgaagctttttttagaacatccgaaaaaagtattttcgcgagcaaatctttatgaaacagtttggcaagaaccatattttgatagtgagaaaacagtgaatatgcatatttccaatcttcgagggaaactagcaaaggcacatgctgtgtatattcatacggtgtggggagtggggtttagatttgattaa

SEQ ID NO: 2197 - DNA (genomic), 369 bp, Enterococcus faecium; double-stranded, circular
  misc_feature (B) LOCATION 1...369
  hypothetical: NO
  anti-sense: NO
aaaggcaatcgatttgcacatagagaacttaagaagggaaattcggagattggaggaatgagcgtggataagaaagcagcaatgaaacgaatcatcgaactgacacattctgagaattggcaagaagacaaagaaatagttgcagaagtccaaaagctcggtaaatcaatgtggactgaaaaacccaaacggaaaacgccgagaaagattgcaatttggcatggtgatcgaattctagtgacaggtactgctgaacagttatctgaaattactggtctgagcaaaaacattatttgggatagagctaggagcttatggattgattcaaaaggacgacagtttaggtatgtggaggagaaaaaatgctag

SEQ ID NO: 2198 - DNA (genomic), 339 bp, Enterococcus faecium; double-stranded, circular
  misc_feature (B) LOCATION 1...339
  hypothetical: NO
  anti-sense: NO
tctaaaaatcgtgaaggccctgatgaaaatggcgtttcccgcttcgtattgtttcgcgaaaaaggaactcctgagactaggactgaggaagaggatcggctggttcaaatgattgaagacattgtattgaaagtcgaacgagtccactttttgacgatcgtcaataccttgccagacaatgctcatttatttgcatctgttttagatgagatcaaacctccctctattgtcagtacaattgctggattcgatacgatcatggtcatctcggaaaatgaggaggacgcaaaacgagtagaagaatttcttcaccatccaactgaagtatcacttttttaa

SEQ ID NO: 2199 - DNA (genomic), 549 bp, Enterococcus faecium; double-stranded, circular
  misc_feature (B) LOCATION 1...549
  hypothetical: NO
  anti-sense: NO
ttgatgaatcgaatatggaataaaagtcatcgaaacaactgctctttacttatgatccttctccttggattcatcctttggcagacacctgtccatgcctccgaattcaattttgcggtagattttgaattaccggctaatcagattgataagaacaaaacatatataaatgtaaggatggagcctgggaaaacacaggaaatcccctacacggtctttaaccgaacagataaatcagtaacagttgagacattgatccactccgctacgacgaattcaaacggtgtgatcgaatatggagaatcaaaaagtaaatttgatgaaacattaagttatgatatgaaaaacttagcaaaaacagtgggagaaataactgttcctcctcaaagtgcggtcactgagacactttcactgaaagcgccagaaaaagagctggctggtgtggtcgcaggagggatcacgtttcaagaaaaaaaagagaacgtttctaacaaaagtacagttggtgtcgtcaatcagttttctcaagtgaaagcaatcttgatttga

SEQ ID NO: 2200 - DNA (genomic), 591 bp, Enterococcus faecium; double-stranded, circular
  misc_feature (B) LOCATION 1...591
  hypothetical: NO
  anti-sense: NO
ttcactgatcgtagccaaagaaagtttagcggaaaaagtacagatggctgcacctcaatccattcatttatcagtcaacagcatggtcaatccgcaaaaatacgaatcgattgcacaatatttgaaacagacagcttaagggaggaaaacagcatgcaaagtttgccattcgacatgatcgagctcaatcgatcttttaaaaccaaagaagaagcgatccgctattgcggtcagatgcttgtagaagcagggtgcgttgatgaggaatatatcgatgccatggtagatagagacaaaatgttatctgtttatatggggaattttatcgcgattcctcatggaacagatgaagcaaaaaaatatgtgaaaaaatccggcatctgtgtcgttcaagtaccagatggtgtagattttggtaccgaagaagaagaaaagattgcgactgttttgttcggtattgcaggagtcggagatgagcatttgcaacttgtacagcaaatcgcactttattgcagtgatatggacaatgttgtccagctagcagacgcgctcagcaaagaagaagtaacggaaaatctagcaattgcttaa

SEQ ID NO: 2201 - DNA (genomic), 777 bp, Enterococcus faecium; double-stranded, circular
  misc_feature (B) LOCATION 1...777
  hypothetical: NO
  anti-sense: NO
ttgggcgatcgtagaatgaaaaaccagtatccagatctagctaaacaggttgtatttatcacaggagctgcttctggaattggtgctgcgcaagcccgagcgtttcttgaacaagatgcttttgtatttggattagatcaaaagttcggtaaaatggaagaaatttctttgcgatttcctgaaacttttgcctacgcactaggtgatgttcgacaaatgaaagaactccaacaagcggtatcgaaatgccaaaatcattttggtgaagttacgattttactgaatacagcggggatattggatgcctacaaacccttgatggaaactgacgaatcgctgtgggatctgatttatgagacgaatgtgaaaagcatgtatcagctgacaaaaatcatccttcctgatatgatccgccaaaaaagcggaacgatcatcaatatggcttcgattgctggcttgattgctggtggaggtgggatcgcttatacaagcgcgaaacatgcgattgtcggatttaccaaacaactcgctctggattacgcaggacagggtatccgagtaaaaggaattgctccaggagccatccaaacaccaatgaatgcggctgattttgaagggaaaggtgagatggcagagtgggtggcaaatgaaacaccagtcaagcgatgggcacagccggaagaagtagctgagctgacgttatttcttgcctctcctcaagcaagctacatacaaggaacgatcatcccaatcgacggcggatggttgttaaaataa

SEQ ID NO: 2202 - DNA (genomic), 312 bp, Enterococcus faecium; double-stranded, circular
  misc_feature (B) LOCATION 1...312
  hypothetical: NO
  anti-sense: NO
tttcaagatcgtgggacagtttcgtgtggtaaaggcattcatcgatctaaaagaattcgcttaagtcctacgatcgacttgaatgacttcaatacaaaacttcgtaatgcacgtaagttcttggaaaagggcgataaagtgaaagcttctatccgtttcaaaggccgtgccattacccataaagaaattggtcaaaaagtcttgaatcgcttagctgaagaaactgcggatattgcaacagtggaacaaaaagcgaaaatggacggacgcagcatgttcttgacgctggcaccgaaaaacgacagtaagtaa

SEQ ID NO: 2203 - DNA (genomic), 528 bp, Enterococcus faecium; double-stranded, circular
  misc_feature (B) LOCATION 1...528
  hypothetical: NO
  anti-sense: NO
aaaagggatcgcttgatgatttcccttagagttgatgcaaaagaccgtatttggggcagtttagcagatgaaaaaatattcaaatctttaagcaaatatggaacagaagaaatgaaaaacaaagatgtgataggaacagcataccgcttgaaattaacaggtacgtacgttttaacggaagatttctattttgggtttatccatccttctgaacgatataatgaaccttgtctaggcgagcagataaaaggtcgagtgattggtgtccgaccagacggtgtactgaatctttcattgaagccaagagcatatgaagctatatcagatgatgcacaaatgattttaaccattttagaacgttctgcagatcagcaaatcaactttacagataaatcggatccagaagaaatcatgaaagcttttggtatcagcaaaggagcatttaagcgcgcattaggtaatcttttgaaacaaggattgattacacaagaaaacggtgtgacaaaactagtcaaaaaatctaattga

SEQ ID NO: 2204 - DNA (genomic), 594 bp, Enterococcus faecium; double-stranded, circular
  misc_feature (B) LOCATION 1...594
  hypothetical: NO
  anti-sense: NO
gggcttattttattcaagaaaggggcaaagtctatgatcaaagctattttttttgatattgacggaacattggtcaccaatcgttcaaaagcgttggaatcaacaaaacaagcaattgaatatgctcggaaaaacggcattttatgcggtgtagcaacggggcgcagcccagtaaaaatcaaagaaatcattgatgaattggaattagatatgtatgtcgtgtataatggtcaactggtttttactgcaaatcgcacgattatcgaccacccttttgaacaaaaagtattggaacatattgttgaatttgcagatgagaaccatcgacaaatcgtttttggtgcgagaaatcggttagatggatcaacgacgatgctattaggacaatcgatttttatcaagcgactagtcagctttttaccgcgtaaattcccggtacgtctgatgaaaaaaatcctccaggtttttagccctcaccgacaaaaggatcgttatgaaacgttagagatattaaaagaaccaatttatcaatgtatattgctcagtccggagtcagaacagaaaaagttagaacatcgctttcccggagtgtaa

SEQ ID NO: 2205 - DNA (genomic), 1389 bp, Enterococcus faecium; double-stranded, circular
  misc_feature (B) LOCATION 1...1389
  hypothetical: NO
  anti-sense: NO
tgccaaagtcgtgataatttaaagagaagaggtgcacgaatgaataattttgatatattccgcttcaaaccgtttatcaatgaagcgttaaccgcaaagggcttcaaacagcccacagaggtccaggaacgtttgattcctttaattgcaaaaggaaaaaatatcattgggcaatctcaaactggtacaggaaaaacacatacgtttttgttgcctttgtttgaaaaaatcaatgcagaaaaagaggaagtacaagttgttattacagctccaagtagggaactagctgcacagatctatgaagcagctacacaaatcgctaaattttctacaccggagatccgtgtctcgaattttgtcggcggtacagacaaacagcgtcaattaaatcgtctgcatcaccaacagccacaggttgtagtaggcacgcctggtagaatattagacatgatgaatgaacaagcgctgaagattcacaccgcatttgcatttgttgtcgatgaagcggatatgacattggatatgggttttttaaatgaagtagaccaaattgcaagtcgattaccagaaaagctgcagtttttagttttttctgccactattccagaaaaacttcgtccattcttacgaaaatacatggaaaatccaatcattgaagaaatcaaaccaaaagcagttatttctgaagacattgaaaattggctgatttcaacaaaaggtaaagatgagaatcaaatgatttatcaactgctgacaattggtcatccttatttagcaatcgtatttgccaatacaaaacagcatgtggatgaaattgccgattacttgaaaaaccaaggcttgaaagtagcaaagattcatggagacatcaccccaagagagagaaaacgagtgatgcgacaagtacagaatctggagtatcaatatgttgtagcgactgatttagctgctagagggatcgatatcgaaggtgtctctcatgttattaatgcagaaattccagaagatctagacttctttatccatcgtgtcggacgtactggacgtaatggcttaaaaggaacggccattacgttatattcgccaaatgatgagcaagccattgatgcgatagaaaaattgggcgtctcatttgaaccaaaagaaatcaaaaacggggaaatcgtcaaaacatacgatcgtaatagacgtgccaaacgagaaaaatcaaaagatgtattagatcccacgctgattggtcttgtgaagaagacacagaaaaagatcaagcctggttataagaaaaaaatcgattgggcaattgcagaaaaaaataaaaaagaacgcaaaatcgaacgcagacagcaaagccgtactgctcgtacaaataagaaaaattcacataaataa

SEQ ID NO: 2206 - DNA (genomic), 183 bp, Enterococcus faecium; double-stranded, circular
  misc_feature (B) LOCATION 1...183
  hypothetical: NO
  anti-sense: NO
ccgtccggtcgtaggttcgagtcctacaaggtccattgtggcgttgtaagtttcatatggaggattacccaagtccggctgaagggaacggtcttgaaaaccgtcaggcgggtaaaaccgtgcaagggttcgaatcccttatcctcctttttcatattatcgcgggatggagcagtctggtag

SEQ ID NO: 2207 - DNA (genomic), 1044 bp, Enterococcus faecium; double-stranded, circular
  misc_feature (B) LOCATION 1...1044
  hypothetical: NO
  anti-sense: NO
ctagaaggtcgtgtaaaagagcgcatggaagcaggagcttttggctatattcgcggtggttctgaagatgagtggacgatgaaagaaaatacgacttcttttaatacaaagaaaatcatgccacggatattacgcggaatcgactcagccgatttgcatacatctgttttcggaattgaattagatacaccgattatccaagcgccatcagcggcccaaggattggcacatgaaaaaggggaagctgatacagctaaaggagtagctgctgctggatcaatcttttccatcagcacttatgcaaatacgacaatcaaagacgcagccgatgcagcgccaggcgcaccgcagtttttccaattatatatgagtaaagacgacagattcaatgagttcattttgaacaaagcagtagaagcaggggctaaagctatcattttaacggcagattcaacgctcggtggttaccgtgaagaagacgtcatcaatcaattccaatttccattaccaatgcctaacttagctgcgtatagcgaacaaagtgcaagtggtaatggcgaaggaaaaggaatcgcagaaatttatgcagctgcaaaacaaggcttgacaccagatgacatcaaaacaatcaaagaaatcacccatcttccagttatcgtaaaaggaatacaatcgccagaagatgcagtaatcgctatctctgcaggggcagatggtatctgggtatccaatcatggtggacgtcaattagatggaggtcctgcgtcctttgaagtattgccaaaaattgccgaagtagtcaacaaacgtgtaccagtgattttcgactctggtgtccgtcgaggagagcatgtcttcaaagctctggcaagtggtgctgacttagttgcgattggccgaccagtgatttatgggttgaatctaggtggggcagaaggagtaacatctgtttttgaacacctgaacaaagaattgtcgatcacgatgcaacttgcaggaacaaaaacgatcgatgaagtaaaaaatacgaaattgatggattaa

SEQ ID NO: 2208 - DNA (genomic), 309 bp, Enterococcus faecium; double-stranded, circular
  misc_feature (B) LOCATION 1...309
  hypothetical: NO
  anti-sense: NO
acttttatgctgatggaaggaaaaacacaattatggtttaaatttgacccttcgaatagatttatcaaagatttttataaagtatggaattcagaagttttctttttagcaatcgaagatagcttattaatcaatctctactattctaataagaactatttcaaaattcctgctgcgaaaactagaatgaagaagggtgtatactttttgtttgatatcgtgactgacgtgccggacgcacgtagcgatcatcggcgttatgactatataaagtatactttcgttgatccagaaagatacaaagattaa

SEQ ID NO: 2209 - DNA (genomic), 309 bp, Enterococcus faecium; double-stranded, circular
  misc_feature (B) LOCATION 1...309
  hypothetical: NO
  anti-sense: NO
acttttatgctgatggaaggaaaaacacaattatggtttaaatttgatccttcgaatagatttgtcaaagatttttataaggtgtgggattcagaagttttctttttggcaatcgaagatagcttattaatcaatctctactattctaataagaactactttaaaattcctgctgcgaaaacgagaatgaagaaagatgtatattttttgtttgatgtggtgactgacgtgccggatgcacatagcgatcatcggcgttatgattatataaagtatactttcgttgatccagaaaggtataaagattaa

SEQ ID NO: 2210 - DNA (genomic), 273 bp, Enterococcus faecium; double-stranded, circular
  misc_feature (B) LOCATION 1...273
  hypothetical: NO
  anti-sense: NO
attgttttccgccaattcaatgagtggtgcgatttgcgactacattatatcaaaagaaagagaagggaggaagaagaaatggcttattcaacgattggagttgttgttgaaaaaagcagagacaatctcgtttttgtgacagaaattcaaacaggcagagcttttgtcgtcacagacaaagcggcaaaagcgtatcaaaatggcgatattttaacgttaaatctgactacgaagacgtgcgtcgatgcggcagaagattatccatttgtttag

SEQ ID NO: 2211 - DNA (genomic), 678 bp, Enterococcus faecium; double-stranded, circular
  misc_feature (B) LOCATION 1...678
  hypothetical: NO
  anti-sense: NO
tggtatttccgctataatttttcttataaagaaataggagaatattatatggaaaataaaaagccttatggaactgtattgatcaaagcctctaaaatactagactatttagcggaaaaccaagatgtctctttgcagacgatcgcaaagggtgtgggaatgacctcttctacagtcttgaaaatactagatactttgttgatgatcggctacgtaaataaaaattcagagaaaaactatcgtttaggtgcaaagcttattcgctacgcgaataaaaacattgaacaaatcgatttggtagagttgactttaccgtttttagaacagctgcagcaaaagatcgatgagactatccacttaggggtattggacaacaatgagatcttgtacgtgaacaaactagatccaaaacatcaaacgatccgcatgtcttcaaaaatcggaatcacccgaccattatacaattctgcgatgggcaaagccgtattagcagaattcagtgaagagcagtacactgattatcttgaaaagcatccgttgatcccttacacagaatatacgatcaccaatgcattacggttgaaaaaggaaatccaaacggtaaaagaaacccacatcgcatttgacgatgaagatatcgaacgtgatattttttgtttagggagccccaatccttga

SEQ ID NO: 2212 - DNA (genomic), 183 bp, Enterococcus faecium; double-stranded, circular
  misc_feature (B) LOCATION 1...183
  hypothetical: NO
  anti-sense: NO
tcaagaatgctccaggtctgggggaaagctggaaggcaagaaagattgcaaacgcgatcccagaatgattccgaagaaccatccgataaatttaagaattttctttttcataaggctccctcagtagttagtattaagcattctgattataccatagtgttatttcctatcaagctctcctag

SEQ ID NO: 2213 - DNA (genomic), 363 bp, Enterococcus faecium; double-stranded, circular
  misc_feature (B) LOCATION 1...363
  hypothetical: NO
  anti-sense: NO
aaattattccgaaaagtgaaaaaactcaaacaaccagcttggaataaaatcgacttgcaagcacatacgtacatcggttggaatgatccagggacgcaaaaaaaattcatggtctattacgaagatggaaaattaaaagggatcagcggtactttatcaccaacgattaataagggaatctgtgcgatctgtcagaaaacatcgaatgtctcgctctttctttctacaacgaaagccggttctgatggcacgtatacgaaaaaggggaattatatttgtcatgatagtgatcaatgtaatcaacagttaacgaaattggctcctttctatgaatttgctgaacgtgtaaagaaagaacgataa

SEQ ID NO: 2214 - DNA (genomic), 2253 bp, Enterococcus faecium; double-stranded, circular
  misc_feature (B) LOCATION 1...2253
  hypothetical: NO
  anti-sense: NO
gtaaaattccgtgatcaagctagatggactcctactaaccaaatgaaagctgctcaaaagacggctttcggcagttttcatttgtttagtagcgtcttgctttcacgagaaggaaaaggagaagttatgtcagaaaaacaagtattcaaaacgacatggggcggccgtcccttacaaatcgaagtcggtcagctagcaaaacaagcaaacggagccgttttagtccgttatggagatacagtagtcttaagtgcagctgtggcctctaaagaagcaaaagatacagactttttcccattaacgatcaattatgaagaaaaaatgtatgcagcagggaaaatccctggaggtttcatcaaacgagaaagccgtccaagtacggaagcaacattgactgcccgtttgatcgaccgtccaattcgcccgatgtttgcagaaggcttccgtaatgaagtccaagtaacgaacatcgtgatgagtgtaaaaacagactgctcgccagctatggcagcaatgctaggttcttctttagcactatcaatctcagatatcccatttgacggcccaatcgcaggcgtagaagttggtcgtgtaaatggcgagtacgtcttgaatccaacagtagaacaagcagaacaaacagatatcgaattgactgttgccggaacgaaacaagccatcaatatggttgaaagcggcgcgaaagaagtttcagaagaagacatgcttggtgcattgctgtttggttttgacgctatcaaagagttagttgctttccaagaagaaatcgttcaagcagtagggaaagaaaaaatggaagtgactttactgcaagttgatgaagtattgaaaaaagaaatctttgatgcttcttacgctacaatgaaagcagcagtaatgactgaagaaaaacttgctcgcgaagataatatcgagcaggtgaagatcgatatccgcgaagcttatgctgagaaatttgcaggtcatgaagatgaagatcacttgttgaaagaagttaaacaaatcacagaagatcttgaaaaagatgtcgtacgtgaattgatcaccatcgataagatccgtcctgacgggcgtaaattggatgaaatccgtccattgtcatcagaggtcagcttattgccacgtgtacatggatcaggtttgttcacacgaggacaaacacaagctttatcagcttgtacactcgcacctctaggagagcaccaaatcattgatggtttaggggtggaagtcagcaaacgattcatccaccactacaatttccctcaattttctgttggttctacaggacgtgcaggctctccagggcgtcgggaaatcggacatggcgcattaggtgaacgtgcgttagcacaagtaatcccttcagaagaagaatttccttatacgatccgtttagtagcagaagtattggaatcaaatggttcttcttcccaagcaagtatctgtgctggcacattagcattgatggatgcaggtgtaccaatcaaagcgccagtcgccggtattgcgatgggacttgtttctgatggtgaaaactatacgatcctaactgatatccaagggctggaagatcatcttggcgatatggactttaaagttgccggtacaaaagatggtatcactgctttacagatggatatcaagattcaaggaatcacagaacaaatcctaactgaagcattaactcaagcaaaacaagcacgtatggaaatcttagaagaattgacttcaacgattgctgctccacgtgaagaattaagccaatatgcaccaaaaatcgaaatgatccagatcgaacctgctaaaatcaaagatgttatcggtaaaggcggcgatacgatcaacggaatcatcgatgaaactggtgtgaaaatcgatatcgatcaagatggaaaagtaagtattgcttcagctgatgcagaaatgatcaaaaaagctatcaagatcatcgaagatttgaccaaagaagtcaaagttggtgaagtttatctagggaaagttgtccgtatcgaaaaattcggtgcattcgtcaacttgatcaaaggaaaagatggacttgtccatatttcccaattagcaaacgatcgtgtcaataaagtcgaagatgttgttaaactaggtgatgagatccttgtgaaagtaactgaaatcgataaacaaggacgcgtaaatctgtcaagaaaagcaatgttgaacgaagatggttcaacgaaaaatgaagaaaaataa

SEQ ID NO: 2215 - DNA (genomic), 261 bp, Enterococcus faecium; double-stranded, circular
  misc_feature (B) LOCATION 1...261
  hypothetical: NO
  anti-sense: NO
aggcttctccgtggagaaaaacatcatcatctccagcatttccggccgggacgtttccaagaaactgcggggcatctgccaacaatacgtgaagccggatatcaagctgatcattctgaattacaacgaactcagcgccgccatcgaccgcgccgccgacgaaacggaatacttgaaggagacttccttgatcctgaccacttcctacttggataccgacgtcgctgtaccaacattgaatctgttggacgtgctggatga

SEQ ID NO: 2216 - DNA (genomic), 228 bp, Enterococcus faecium; double-stranded, circular
  misc_feature (B) LOCATION 1...228
  hypothetical: NO
  anti-sense: NO
attaccatccgtcccattgaaagaaaaagccaagcatgggcattattgatcagccaactggattctaaanaanatgagattcgttcctttttgaaatcgtggaagtgttctaaaccaatgattanagacgttcaagcacttgtccagggactacaacaacgagaaactggagctttggaacattcgaattgttcttccttaagcaaaaaaaaatgcactgccatttaa

SEQ ID NO: 2217 - DNA (genomic), 1158 bp, Enterococcus faecium; double-stranded, circular
  misc_feature (B) LOCATION 1...1158
  hypothetical: NO
  anti-sense: NO
atacggatgctgaaagaatatcgaatggcactccatcaaattcctgaaatcgggtttcatgaattcaagacaaaaaaatatttatatgaacaagtaaaaaacagcgaggccgttatccatgaaatcggcgaaacaggactactcctttattttgataatcagcaagaagaaacgattgcttttcgaacagatatcgatgcactgccagtcaaagaagaaacgaatctctcttttgcttctaagcatgaaggttatatgcatgcatgtggtcatgacggacatatggcgatgcttttagggttgactgactttataactaaacacattgaggatcttatttataatgtagtactgatctatcagccatcagaagaaatttccggtggcgcacaaagcgttattcagtcaggattgttggataaatatgaagtacaagcaatatttggctttcatctatggcctggactagctaagggagaagttttctctcgaccaggacctttgatggcacaaagcagtgaaacagacattatcattaaaggccagtctgcacatattgcttctagtgaaaaaggaatcgatagtctggaggcagctgtacgatttttgaagaatgtttatgattttgaccggcaattaccggcagagtggaatcatctaatgaaatttggccaaatccaaggtggaacgatccgaaatgttttagctggagaagttattgtatccggaagtatccgttcttacagttcagatatgcaaaattatttgaagaggggattagaccatttagcagaacagtttcactctacagctactatttcttttcgctataatgacggctatccagctgtaatcaaccatagaggcttatatgcagcactgttagattcaaacaaactacatgaattagatgctccagttcttcaagccgaagattttggcatatatacgcaacaatatccatgtgtatttttctttttaggtgtcggtgatacccctgctttacatgatccgacgttcgattttgatatggatgttttagaaaatggtgtagaatggtacaaaacgattctttttacagaaaatcttcttgtaaaaatcgatagcagttcaaaagaggagcgagtaaataatgatgaatttatccaatcgatttag

SEQ ID NO: 2218 - DNA (genomic), 771 bp, Enterococcus faecium; double-stranded, circular
  misc_feature (B) LOCATION 1...771
  hypothetical: NO
  anti-sense: NO
gcattaatccgtggtgaccgtcgcattatgcaaaaaatgggtgtgaatatcgatgaactacttctttcacagcctgacacaggagaacaaggtctagagatcgctgatgctttagtatcaagtggggctgtagatatcgtagtagtcgattcagttgctgctttagttccacgagcagaaatcgacggcgaaatgggtgactcacatgtcgggttacaagcacgtttgatgtctcaagcattgcgtaaactctctggttcgatcaacaaaacaaaaacaatcgctattttcatcaaccaaatccgtgaaaaagtaggcgtgatgtttgggaatccagaaatcactcctggaggacgcgcattgaaattctacgcaacgatccgtttggaagtacgtcgtgcagaacaattgaaacaaggtacagatattgttggtaaccgtacaaagatcaaagtcgtaaaaaacaaagtagcacctcctttcaaaatcgctgaagtagatgtcatgtatggtttagggatctcacaagaaggagaacttctagacatggcagtagaaaaagacattgttgataaaagcggtgcttggtattcttataaagaagatcggattggtcaaggacgggaaaacgctaaaatctatatggctaatcatcctgaaatgatggcagaagtttctgctctagttagagcagcttatggtattggtgaagaagtcgctgtcccagaagatgaaaaaggacaagaagaattgcctttagtagaagaataa

SEQ ID NO: 2219 - DNA (genomic), 474 bp, Enterococcus faecium; double-stranded, circular
  misc_feature (B) LOCATION 1...474
  hypothetical: NO
  anti-sense: NO
agcaatgtgctgaaagcttttgaacaagttagacaaatggaagagcggatgcgcgagctagagattttcattagcgaaggtacgccagacacacctgcttatagttcttatttaaaagaatacgaccggctgcaacacgatttttcagatcgaaacggctatggttatgaaaatgaaattcgttccgtattgcatgggtttaaattcgattcttcattttatgatcagaaaatcgatactttatcaggcggacagcgcacacgtttagctttagctcgcatgcttttgcaacaccctgacattttgattctagatgaaccaacgaaccatttagatatcgagacactttcctggcttgagaattatctgcaaagctatactggtgcattattgattgtttcccatgaccgttattttttagataacgtagtcaatgaagtttatgaattgccatcgtcaccacgaaattcgatc

SEQ ID NO: 2220 - DNA (genomic), 213 bp, Enterococcus faecium; double-stranded, circular
  misc_feature (B) LOCATION 1...213
  hypothetical: NO
  anti-sense: NO
gcatgtgtgctaggtcaatgcttcggcaaccatgcaaggttcgattccttgccagcgacattaaatgcctatgacggttacgactaccgaaaaaagatcgttaagaagctatacggtgctacgtacggcaatgtagtaagtgtgctatctgtacaccaccaagcttcggtcactgtggcggaagtagaagacgcagcggtaaatggcgagtag

SEQ ID NO: 2221 - DNA (genomic), 618 bp, Enterococcus faecium; double-stranded, circular
  misc_feature (B) LOCATION 1...618
  hypothetical: NO
  anti-sense: NO
aaacagtaccgtacttacggcagaatgttggttaggaggacaagtgttatgacagaatttgatcaaaatcaagagaacaaccagtcaatggaagacgcaatgaaaagcgtacaagaagtaaaagttggcgatgttgttaagggcgaagttttagtcattgaagacaaacaagtgattgtcggaatcgaaggggctggagttgaaggagtcgttccggcaaaagaattatcaactttgccggtagaagatatcagcgaagtagtaaaagtcggtgatgtattagatttagtcgttatcagtacgatcggcaaagataaagaaaacggcagctatctactttcaaaacgccgtttagatgctaaaaaagtttgggaagatatcgaaagagatttccaagagggcaaggtcatcgaagcacctgttacaaatgttgtcaaaggcggtttagtcgttgacgtcggtgtacgtggttttgtccctgcatcaatggtggaagatcattttgttgcagacttttcagactataaaggcaaaacattgagctttaaaatcatcgaaatcgaaccatcagaaaatcgtttgatcttatcgcataaagcggtagtggaaaacgaaaga

SEQ ID NO: 2222 - DNA (genomic), 726 bp, Enterococcus faecium; double-stranded, circular
  misc_feature (B) LOCATION 1...726
  hypothetical: NO
  anti-sense: NO
atacgccaccgtttttccgtcgtaaaaaataaaggagaggaagagcacatgattgctgacaacttgcagaaaatcaagcaagaaattcaggattcgtgtgctcttgttcatcgtgatccgaaagaagttacattagtagctgtaacaaaatctgttgaatccgctcaagctgaagaattggttagagctggcgttatgaattgtgcagaaaaccgagtagataaattattagaaaagaaacaagatttatttgattttcctgaaataaagtggcatttaattggtaatttacagcgcagaaaggtaaaattgattgtaaatgaaattgattactttcatgcgttggacagtttaagattagcagaagaaatccagaagcggttagagaaagaattatcctgttttattgaagtaaatgtttctggtgaggaatcaaaacatggaatttcaccagatgagcttttaccgtttgtggaatctttagctgcctgcacaaaaatcaaggttgttgggttgatgactatggcgcctaaagaagcttctgatgagcaaatccataaagtgtttggtacgctgaaagaattgcgtgatcttgttcaagcaaaaggttatgcccatgcaccatgtagtgaattaagtatggggatgagtcaagactttcaaattgcgattgaagaaggtgcaacatttatccgtgtaggaacagcgctattcaaagacgaataa

SEQ ID NO: 2223 - DNA (genomic), 666 bp, Enterococcus faecium; double-stranded, circular
  misc_feature (B) LOCATION 1...666
  hypothetical: NO
  anti-sense: NO
cggcgtaaccgtggaggattaatcatgaaaaaacgtttatttatgccaatgagcttacaatttttttctgaaccaggagacggtggatctggtgatgagggacaacaaggaaacctaccagctggctcacaagagacaccgcccgaagcaaaagaagaaaacactactggcaaaacattttctcgtgatgaagtagcgaaaatgatcgctgctgaaacaaagaaagctgtcactgctgctgaagaaaaatggcgtgcagaaaaagacgaagctgccaaacttgccgaaatggacgataaagagaaagcagattacgagaaacagcaacttgaagcaaaactagctgaattcgaacgtaaagaagtgctgtctaagatgtcagaacaagcaagtgaaatgctgtctgagaaaggcgctacgcccacgaaagaaatgcttcgactaattgtgtcagaagatgctgaaaccacatcaaacaacgttaaaacatatctagcatctgttgaagcagaacgtgaagcaatcaaagcggaatatgaaaaacgactcggcggaaaagttcctttagatggaaacggcgcaacaatttctcgtggtgcacagctagcaaaaaatgcaaacaaccaaacgaaaaagcctgagaatgacccttgggcaattaaatag

SEQ ID NO: 2224 - DNA (genomic), 405 bp, Enterococcus faecium; double-stranded, circular
  misc_feature (B) LOCATION 1...405
  hypothetical: NO
  anti-sense: NO
ctcattgaccgctgggctaccagcaaaataaaaatccggttctattcagaagattcagaaggttcgtattatttgcaaatgactggcagagatatttttgattttgccgtacgagacgttgcaaacaatatccaagaagtcatgaaagacaaaccagttgattatctgcttttgcatcaggcaaacctcagaattattgagaaaattgcccgaaaagtaaagatgccgcaagaaaagttcctgaccaatatggataaatatgggaatacatctgctgcaagcatccctatcttattggatgaagcagtttctagtggaaagatcaccttaggaaaacagcagaaagtaatatttacaggctatggcggaggtttaacatggggaagtattctcatggagttgtag

SEQ ID NO: 2225 - DNA (genomic), 276 bp, Enterococcus faecium; double-stranded, circular
  misc_feature (B) LOCATION 1...276
  hypothetical: NO
  anti-sense: NO
agatactgccgaaatctattctattgtatgggaataaaaaaagactatcatcaccaaggattaggaacaaaactttttaaagaagcagaaggttacgcagcaaaacattacaaatatttgcaagtgaagactgtagacgaggggcactactctatatatgatcaaactatttgtttctacgaatcattaggattttcaaggttggaagtttttccaaatttatgggatgaatggaacccatgtttagttcttgtcaaaaaattggaacaaaagtga

SEQ ID NO: 2226 - DNA (genomic), 282 bp, Enterococcus faecium; double-stranded, circular
  misc_feature (B) LOCATION 1...282
  hypothetical: NO
  anti-sense: NO
ctttgctgccgccagtttttcgggcagcatcccgaaaaagttcccgatgcccatagacggctccaaaaccgtccccggcgtaaagtccatctgttccaccgcattgtagattgcctggataacggtggggctggtgtagtgggcgttgagaaccgtgctttgtgcagactggtactccccaggggtgagcagttctttcagttcggcgtattcctttgcccattttgggtcgtttggctcaaaggcgtgggaaatgccgccccagcccacataacgggataa

SEQ ID NO: 2227 - DNA (genomic), 237 bp, Enterococcus faecium; double-stranded, circular
  misc_feature (B) LOCATION 1...237
  hypothetical: NO
  anti-sense: NO
attgaacgccgccccacgtggagggtcaccccttcccctgtggagcgggggagggagaaaaaaaaaaaatttncttcttccccccccccccctaaattttctcaaaaaaaaaaaaaggggggagaatttaaaaaaacccccacaccaaacccgaaagtttggggtccgccaaccgtggttgtcttttctgaaattttgggggttgcccaaaagggccgggagtgcgaaatattttag

SEQ ID NO: 2228 - DNA (genomic), 195 bp, Enterococcus faecium; double-stranded, circular
  misc_feature (B) LOCATION 1...195
  hypothetical: NO
  anti-sense: NO
caaggtagccgtatcggaaggtgcggctggatcacctcctttctaaggaatattacggagactacacaatttgtttttactttgttcagttttgagaggtttactctcaatttaaaacggggccttagctcagctgggagagcgcctgctttgcacgcaggaggtcagcggttcgatcccgctaggctccattaa

SEQ ID NO: 2229 - DNA (genomic), 1737 bp, Enterococcus faecium; double-stranded, circular
  misc_feature (B) LOCATION 1...1737
  hypothetical: NO
  anti-sense: NO
gtagaaagccgtttctttgtttatttaaagttgacactacggggtacaaacattagaataaagttgtgcatgttttttgtacacatatatgcgaagatgcatattgacgagtttagaataatttatcatagaagctgtatagatgataaaaatgaaaaagatagtatggaggtggattttatggtattcaacattctcctcgctatcatcggtttaattgtcggtcttggtttagggtttatggtcgcaaagtcacgtcacgagaaagaaatagctggtgcacaatcatcagctgctggaatcatcgatagtgcaaaaaaagaagcagaaactctaaaaaaagaagcattgttagaagctaaggaagaaaatcagaaataccgttctgaagttgaaagtgagctgagagaaagtaagttagaattaaaatctcaagagaatcgtttgattcaacgcgaacaaacgctgaatcgtaaagatgactcgttagaaaaacgcgagaactcacttgaaagtaaagaagaagcacttagttcaaaacagcaattaattgaagagcgagaaaaagacgttgaaaaaatgattgaagatcaacaaaaagaactagaaaaaattgctggtttatcaaaagaggacgcacgagatgtcatcatgaaatcgactgaagaagagctgaatcatgagttaactctaatggtaaaagaatctgaacagcgtgccaaagaagaagcagatcgcaaagcgaaaaacttattatcattagcgattcaacgctgcgcagcagatcaagtttcagaaacgactgtttcagtcgttacccttccgaatgatgaaatgaaaggtcgtatcattggacgagaaggtcgtaatattcgaacgcttgagacgctgactggtatcgatttaatcatcgatgatacaccggaagcagttgttctttccggattcgatccaatccgaagagaaatcgcacggatgaccttggaaaaactgatacaagatggacgaatccatccagcgcgtatcgaagaaatggtcgagaaatctcgtaaagaaatggatgaacgtattcgcgaatacggggaagaggcagcgtttgaagtcggtgctcatacacttcatccagatctaatcaagatcatcggacgtctgcgattcagaactagttatggacaaaacgtcttgaagcattcggtcgaggttgcaaaattagctggtatcttagcagcagagcttggcgaagatatccaattagcaaaacgtgccgggttgctccatgatattgggaaagcacttgaccatgagattgaaggatctcacgttgagatcggtgcggaattagctgccaagtacaaagaaaacccagtagtaatcaacgcgatcgcttctcatcatggagatgtggaagctacttctgttatctctgtccttgtagctgcagcagatgcgctctcagcagcaagacctggtgcgcgaagtgaatcattagaaaactacatccgtcgtttaagaagtctggaaaatatttcgaacagcttcgccggtgtagaatcaagttacgcagttcaagctggacgcgaagttcgggtaatggtcaagccagaagaaatctcggatttagacgctgttcgtttagtacgtgatattcgtaaacgaatcgaagaagaactggattatcctggacacatcaaagtaatcgttattcgggaaactcgtgcaactgattatgctaaataa

SEQ ID NO: 2230 - DNA (genomic), 378 bp, Enterococcus faecium; double-stranded, circular
  misc_feature (B) LOCATION 1...378
  hypothetical: NO
  anti-sense: NO
cttagaagccgggggngtcaacccgatgtgaanaagtttcagttacatgtncaacatgcgtgtaaactgctcagtggttttgaacctatttttgaagatggtcgtttagaactcacaaataatcgtgcggagcgaaatatcaaagagctggtgataggacggaaaaattggttgcattccacaagtcttgaaggagcacgaacttcaggaatcattctgagtgtatataaaacagcagaacttaacggattgaatcctgtaaagtatctagagtttctatttgataagataccaaatcttcccgtactttcagcagaaactttagatcaactgttgccttggaacaaggatgtacaacaacatttttctcgtaactaa

SEQ ID NO: 2231 - DNA (genomic), 408 bp, Enterococcus faecium; double-stranded, circular
  misc_feature (B) LOCATION 1...408
  hypothetical: NO
  anti-sense: NO
aaccttttacgaaggagggaaaccaacgtgagttatcgtaaactaggacgcacatctagccaacgtaaagcgatgttgcgtgatttaacaactgatttattaatcaacgaacgtattgtgactactgaagctcgtgcgaaagaagttcgctcaactgcagaaaaaatgatcactttaggtaaacgcggagatttgcatgcacgtcgtcaagctgcggctttcgtacgtaatgaagttgccagcgtgcgtgaagaaaatgaggacatcgtcattgaatcagctttacaaaaactgttcaacgatattgcacctcgttacgcagaacgtcaaggcggatacacacgcattttgaagacagaaccaagacgcggtgatggtgcaccaatggttgtcttagaacttgtctaa

SEQ ID NO: 2232 - DNA (genomic), 735 bp, Enterococcus faecium; double-stranded, circular
  misc_feature (B) LOCATION 1...735
  hypothetical: NO
  anti-sense: NO
acgtacttacgacttcaacaatctctatatgtagtagggaatgaacaaagctatcattttaaacagttgaaagctgtcttgaaggaaatgggctttgactggtctgacgacatgcaccatattccatttggtttgatcacgcaaggtggtaaaaaattatcaactcgtaaaggaaagatcgtcttattagaagaagtattaaatgaagcaatccaatctgctaaagaacaaatcagcgagaaaaaccctgatttggaaaacaaagatgctgtagctaaacaagttggggttggggcagtcattttccacgatttgaaaaacgatcgactgaatacatttgactttaacctggaagaagttgttcgatttgaaggagaaactggaccttatgtgcaatatacacatgctcgtgcagtcagcctgttggaaaaagcaggatttgtcccttcagaaacagcagactatgcattgaatgacgataccagctgggaagtggttaaattagttcaaaaataccctgaaacggtcttgtctgctggggaaaaatacgaaccgtcagtgattgcgaaacatgcaatcaaattagcacaagcattcaacaaatactatgctcatacgaagattttagctgatgatgaacaaaaagaagcacgcttagctctagtttatgcagtgactgtattattgaaagaagaccttcgtttgctaggacttcatgcaccagataagatgtaa

SEQ ID NO: 2233 - DNA (genomic), 816 bp, Enterococcus faecium; double-stranded, circular
  misc_feature (B) LOCATION 1...816
  hypothetical: NO
  anti-sense: NO
gaaaacttacgaatcagtggaacgaaaccccaaggagaacgaacgacaccagttgatctggacaaacaagaatctttctctgttctattgatggggattgatactggagatttaggtcgggtcgatcaaggaagatcagatacgatgatggttgccacagtcagtcctgaagacaaacagacaacgatcgtcagcattcctcgtgatacgtatgtcgacatcgttggacatgacacaaaagacaagatcaaccacgcttacgcattcggcggagctgccatggcgatggataccgtacaaaaatatgtagacatcccaatcgatcactatgtctctatcaatatgaaaggtctaaaagaactcgttgatgcagttggtggtatcgaagtcaataatgacctcaccttctcacaagatggctatgattttacgatcggtaaaatcacattgaacggggatcaggcattgtcttattctcgtatgcgttatgaagatccaaatggtgactacggcagacaagaacgtcaaagaaagatcgtagaaggtgtagcgaaaaaagtgttgagtctgaacggtgtaagcaactatcaatccgttttgaatgctctagagtcgaatatgaaaacagacatgagctttgatgaaatgaaaaagattgctttagattatcgggatgcatttggtacgatcaagcaagatcagctgcaaggagaaggcttcatgcaagacaatatctcataccaaaaagtcagcgatcaagaacttgatcgtgtgaaaaaagaattaaaagatcaaatgaatctagagaataaatag

SEQ ID NO: 2234 - DNA (genomic), 303 bp, Enterococcus faecium; double-stranded, circular
  misc_feature (B) LOCATION 1...303
  hypothetical: NO
  anti-sense: NO
nnccattcgctggtgaagactggtacaagacatgctacagaactgaaccgcggaatggcattgatttccagaatgtctaaagcgaaaatcgtgccagctgtatatcaaggtccgttgacacttggggatctgttcaagcgtcagagagtgacagtgcgtttcggcgaaccaatcgacttatcagatatcaagaaaacggataaagaaggtatggcggagatcgaacgacgaacacaagcagcttttgacaaattggacaaagaagtgaaccctgatttcaaatatgaagtcaaaaaaaaataa

SEQ ID NO: 2235 - DNA (genomic), 582 bp, Enterococcus faecium; double-stranded, circular
  misc_feature (B) LOCATION 1...582
  hypothetical: NO
  anti-sense: NO
ctacctctacgacacagtaatgctacactagaagaagcgcaaaaagctgttgaagcaggcgcaagtgtatttgtccatgctttcaatggtatgcgtggattgaatcatcgcgaaccaggtatggtgggtgcgttattatctttagaacatgtcttttctgaattgatttgtgatggccatcatgtacatccaaatgctgcgggaatcctaatggaaaaagcaggacatgatcatgtcgcattaattacagactgtatgatggccggtgggatgcctgatggaaattacaatttacgcgaatttccagtagtagtaaaagaaggaacagcacgtctagaatctggcaacttagctggaagtatattgaaattgaaagaagcaattaaaaatgttgtagactggggattagcaacaccagaacaagcagtcatgatggctagtctgattccagcaatcagctgtaaaatcgatgatacatgtggaaaaatcgctcaaggacgcgatgcagactttatcgtattgaaccctgatatgacattggaagcaacttatctagatggcgtggaacgtttccacgcataa

SEQ ID NO: 2236 - DNA (genomic), 315 bp, Enterococcus faecium; double-stranded, circular
  misc_feature (B) LOCATION 1...315
  hypothetical: NO
  anti-sense: NO
attggtatacggatgatctttcaacgtattccaaggtttatcatgtcctgtaaagtgaacgatcgaaggtttttcatttccttctttatactgacgttcatatttttcatttggtgctggatgacgttcaaaaatcagcgaagtctgcatgttccattttggatgaagttgttcccaatcttcataaagtacagcattcaaagcatcttggtcgtgatagatgattcgatcgccattttcactgaggtaatggatagttttttctgtaatttcttttttattccattgatcaatgtcaatcaccatcactcctga

SEQ ID NO: 2237 - DNA (genomic), 225 bp, Enterococcus faecium; double-stranded, circular
  misc_feature (B) LOCATION 1...225
  hypothetical: NO
  anti-sense: NO
ttgcaaatacgccagttagcaaaaatagcaatacatcttcaagctttaaaattcgagagaatcatcttggtagtggaatcaactacaacaaaaggattaaaccaattaatagatagaattaccaatggaaaaatagaaaaggtagttattctatacaaaagttgtttaattcgcttcggttatgaacttagtgaaaccctttgcaatatatggtacagaatatag

SEQ ID NO: 2238 - DNA (genomic), 240 bp, Enterococcus faecium; double-stranded, circular
  misc_feature (B) LOCATION 1...240
  hypothetical: NO
  anti-sense: NO
ggtcgaatacgggtcgaaattggtgatttcgctaaggcagatactcttgtagtaaaagcacgaagctgtattgcagaggctcacaattctcagacagctatgttggctcgagaagcttctggggaggaacttccatacagcgttaccatgatgcatggtcaggaccacttaatgactactgtcttattaaaagatgtgattcatcacctcatcgaactttataaaagaggagcaaaataa

SEQ ID NO: 2239 - DNA (genomic), 192 bp, Enterococcus faecium; double-stranded, circular
  misc_feature (B) LOCATION 1...192
  hypothetical: NO
  anti-sense: NO
tttaagatacggaaattaatgccatcgaccacactaggagtaacggttaaaaatgatgaatggtataaaatagaaagaaccatccaatcagactattatcaaccattcaagcgtgaaatcccatctgtagttgttacaaacgctgagaaagtctctgctccgaaaaatcagtatgtgtatcgttctttttaa

SEQ ID NO: 2240 - DNA (genomic), 234 bp, Enterococcus faecium; double-stranded, circular
  misc_feature (B) LOCATION 1...234
  hypothetical: NO
  anti-sense: NO
aaagagatacgaatcactgatttttttgaagaaaagaaatggagtgagctgaacgttagagatattgggagctttcgtaactgcttattaaacgataatggttatttgcaaccgtattgctcgcttctacatgaaatatttcatgaaatatttcgcaaaacctttgattatgtagttacgtttccattcttgactaaaaatgtttcaaaaacgaacaaaggtgttaaaaggtaa

SEQ ID NO: 2241 - DNA (genomic), 240 bp, Enterococcus faecium; double-stranded, circular
  misc_feature (B) LOCATION 1...240
  hypothetical: NO
  anti-sense: NO
caatttgtacgtcgcttttcatgtgtgatcttcctttctatacattggatttacttttcgatgatatctacaacagctttaccacaagtcagttctttttctagctcgttctttatttttatggcacatggtttggaaaaaggagcagcttctttccatgaaccaagtaaaggatattcgttactgatacctttcacatattgtttgtttttgacgccttttgtttttacttctacataa

SEQ ID NO: 2242 - DNA (genomic), 1452 bp, Enterococcus faecium; double-stranded, circular
  misc_feature (B) LOCATION 1...1452
  hypothetical: NO
  anti-sense: NO
aacaccgtacgctatgcgccaagtccaactgggcacctgcatattggaaatgcaagaactgcattattcaattatttgtttgcccgccacaatgatggagactttattattcgtattgaggatactgaccaaaaacgtaatatcgaagatggcgaaaaaagccagttggaaaaccttgcttggttgggaatgaattgggatgaatctcctgaaaatcctggagaatacggcccttaccgtcaatctgaacgtaaagaaatctatcaaccgctgattgatcagctgcttgctagcaatcgagcatacaaatgctattgcacagaagaagaattagaagcagaacgggaagcacaacgcgcaagaggagaaatgcctcattacgcaggaacatgtgcgaacttgacacctgaagaacaagcagaaaaagaagcacaaggtctagaatctgttgtacgtttccgtgtgcctcgcaatacagaatacgcatttacagatatggtgaaaggcgctatttcgttcgaatccgataatatcggtggcgactttgtcatacaaaaacgcgatggtatgccaacttataattttgctgttgcggtcgatgatcatttgatgaaaatcactcacgttttacgtggagatgaccatattgccaatacaccaaaacaactgatgatctatgaagcatttggctggacaccaccaaccttcggacatatgacattgatcatcaacagtgaaacaggtaaaaaactaagcaaacgtgacgaatcaatcttgcaatttatcgaacaatatcgcgaattaggctatctaccagatgcaatgttcaactttattgcattattgggctggtcacctgtgggcgaagacgaaatcttcgaacaccaagaattgatcaaaatgttcgatccaaaacgcctaagtaaatcacccgcagctttcgatgcgaaaaaactgcaatgggtaaacaaccattacatcaaagcaatggatctagatgcatttactgacatgtgtctgccttatctaatcgctgatggacgtgtagcagaaaacccagatgaaaagacaatcgaatgggtgaagaagatcgttagcctgtatcaacctcaaatgagctatgctgcagaaatcgttgatctgtctacgctatttttcaatgaacatcctgtattgaatgaagcagcaaaagaagtacttgctggtgaaacagttcctactgttctccacgcattcaaagcacagctagaacaaatggaagtagtagatgctccaactgtcaaagctgccatcaaagctgttcaaaaagaaactggcgtaaaaggaaaaaatcttttcatgccaatccgtgtagctgtatcaggacaaatgcatggtccagaattgcctgaaacgatcgaattgcttggtcgtgaaaaatcattagcacatttaaatcaagtactgaactaa

SEQ ID NO: 2243 - DNA (genomic), 393 bp, Enterococcus faecium; double-stranded, circular
  misc_feature (B) LOCATION 1...393
  hypothetical: NO
  anti-sense: NO
aaggacgtacgagagcggaagcatttggccgtaccatccgacaaggcgcagtggttgcgggcacttactttattttttgttacgttgacgttgtgtgtagtcgccatcatgattttatcggtgactgaaacgatacctaaaacttctggcatcgaatatattgcttttgaggtcttctctgcgtttggtacaggtaggtcttaccatgggattgacgccagacttgactgcaatagggaaattgatcattatagcgcttatgtacattggacgagttggtgtattgactgtggtcttctctctgatgacaaaagcacaaagaacacaatcaaaatacaaatatccacaagaaagtgtcatgattggataatttcatcttctgacaaaacctag

SEQ ID NO: 2244 - DNA (genomic), 819 bp, Enterococcus faecium; double-stranded, circular
  misc_feature (B) LOCATION 1...819
  hypothetical: NO
  anti-sense: NO
gtgaaagtacgtcgcagtgaacgtctagttgacatgacacagtatttattgaatcacccgcatgaattgatttccttaacaagctttgccgaacgttatgaatctgctaaatcttctatcagtgaagatttgggaatcatcaagaaaacatttaaagaacgagggtatggaaccttggaaacaatcccgggtgctgcaggtggtgtattgttcatccctgaaatttcatatgaagaggcgaaaaaatatattgaatctctagcagaacgtctatcagaacaagaccgtctgcttccaggaggatatgtttatctctctgatttgttaggagaacctgaactgctgcgtcaagttggaagaatcattgcttctaaataccttggtgaaaaaatcgatgctgtaatgactgtagccacaaaaggcgtacctattgcccaagctgtgtcctattatctgaatgcgccattcgttattgtacgccgggactcaaaaataacagaaggatcaacagtaagtgtcaactatgtgtctggatcttctgaaagaattgaaaagatggaactgtctaagagaagtttgaaacgtggttcacgtgtccttgtagtggatgatttcatgaaaggcggcggaacagtcaacggaatgaagagcttgattgaagaattcgaatcagaacttgttggcatcactgtatttgccgaatcaaaattcaacggtcatcgcgccatcgatgattatacgtcactgctttatgtcaaagatgtagatactcaaacgaaaaatattacggttgtgccaggaaattatttttcagaataa

SEQ ID NO: 2245 - DNA (genomic), 810 bp, Enterococcus faecium; double-stranded, circular
  misc_feature (B) LOCATION 1...810
  hypothetical: NO
  anti-sense: NO
cgtgtatcgcttgtggtagacgacgtgtctgtactatcgcttgaagttgatgaatctgagctatcacttgtggtagaggatgtatctgtactgtcacttgaagctgacgtgtccgtgctatcacttgtagtggtagatgaatctgagctatcacttgtggtagaggtagtatctgtactgtcacttgaagctgacgtgtccgtgctatcacttgttgtggtagatgtatccgtactgtcgcttgaagctgacgtgtccgtgctatcacttgtggtagaggtagtatctgtactgtcacttgaagctgatgtgtccgtgctatcacttgtggtagaggtagtatctgtactgtcgcttgaagctgacgtgtccgtgctgtcacttgtggtagaggtagtatctgtactgtcacttgaagctgatgtgtccgtgctatcacttgtggtagaggtagtatctgtactgtcgcttgaagctgatgtatccgtgctatcacttgtggtagaggtagtatctgtactgtcgcttgaagctgacgtgtccgtgctgtcacttgtggtagaggtagtatctgtactgtcacttgaagctgatgtgtccgtgctatcacttgtggtagaggtagtatctgtactgtcgcttgaagttgatgaatctgagctatcacttgtggtagatgtatctgtactgtcgcttgtgtctgtcgtatctgtaccattgtcgctgataaatatttcgttaggatcccaacgattggtagctgcatctaaaatcacatttgttcctataatcgttccgtcttggttttga

SEQ ID NO: 2246 - DNA (genomic), 441 bp, Enterococcus faecium; double-stranded, circular
  misc_feature (B) LOCATION 1...441
  hypothetical: NO
  anti-sense: NO
tcaattccacgagaaacaaaatcaggctgttttagcacactttttaggttgctccctgcatttctcttttgttccttagttggtatgataggtaccaaatcaagttcattatttacttttcctgtgctgctttcgctgctcgtgcttcctgtgctactctcactactcatgcttcctgtgctactttcactactcgtactctccgtactgctttcgctgctcgtgcttcctgtgctactttcactactcgtactctccgtactgctttcgctgctcgtgttttctgtgctactttcactgctcgtactctctgtactgctttcaccgctcgtgttttctgtactgctttcactacttgtgctatccgtactgcttggcggtccaacaactgtccaactgcttggtttcaaattctccgtgatcgtcatctgtccatcataa

SEQ ID NO: 2247 - DNA (genomic), 543 bp, Enterococcus faecium; double-stranded, circular
  misc_feature (B) LOCATION 1...543
  hypothetical: NO
  anti-sense: NO
ctagcaccacgggtaggtttgatttataaaattattgaggatgataaacaaactgagcttaatatgtgctattttgatagagaacaagattttttttattatggtggaatgggtggaggatctattgttccaaagataaatttagtagagttagatgtaaataattacagggaattatatgtttttaatagtttagattttgaaatacctatgaaacagatgaaaaatattgacatacatatactgccaagtgagtcgtgccaaatagaatattcaatcgaatatttttacaaaggtaaaaaaataaaaaaatgtgacaagtgttttgaatcagctgtggtaaagtttcctcaatttaaactaaatccagctgcctcgatacaatttcaaggacatgtatttgatgttttagctaaagataacataaaaaaatacaaaaaaggtaatatattccatattgatatacaaatatcttctaatttagaagatataaaaaaagcctttaaaattaaaacaattggcactgctcctaattttaaataa

SEQ ID NO: 2248 - DNA (genomic), 615 bp, Enterococcus faecium; double-stranded, circular
  misc_feature (B) LOCATION 1...615
  hypothetical: NO
  anti-sense: NO
tcattgccacgacccattatggagaaatcaagaaattcgccggagatcatgaagattttgtgccggctgctatggctttcgatcgggaagcacttcgtcctaaatatcagttgcgggttggaagaaacaggagaaagccaagctttgtggattgctcataaaatggatatgtcgatgaaattgatccatcaagcagagcgttacttggcggaaaaagcctatcggacacagaaaaaagaatttcttcctaagacagcagttacaaataggaaggagaataaaaaagaacgtcagctctttgcaaaaggtgatcggatatttgtcaatgaataccaaaaagaagcgttagtttatgaagatataggtgaagatacgattgatgtatatttagacaaaaaaataatccacgtgcctcgtcagcgtgttcgtctggtgcgttcagcagaagatctgtacccgacaggttacgatttagacagtctgtttatcgattataaaacacgtaaacggcagcgtgacctagagcgaggatcaaaaaaagctcataaagtactagtaaaagaaatgcgcaaacgacaggaagaaagaagagtaaacgatgaaaacagcaagtga

SEQ ID NO: 2249 - DNA (genomic), 570 bp, Enterococcus faecium; double-stranded, circular
  misc_feature (B) LOCATION 1...570
  hypothetical: NO
  anti-sense: NO
agacgcacacgcctggagacgaaagctatgttgaaaaaatttaaagcatatgccagaagcctttttcaagataaaatgatctatacagaaaaaacaatcgaacaaatcgatcgtcgctatatactaagagaattgactatagaagatatcaaagagctattggatgtcgaacgagaagtctataatggcgagttgccatggaccaaaagtgcctttatgtcagaattgaagtcaccacttcctcatctatatttagggatctttgataatggaagaatgatcggatttgtcggctcaagagcgttcggtttagattgccatatcacgaatattgctgttcgaccggcatatcagcgaaaacgaattggttcgctgcttattgacgaaattgagaactttgctataatgaatcgctgtgagacgatgtcattggaagtacgcatgagtaatcaggatgcgcaaagactttatcggaaattagggtttcaagctacgacaatcaaaaaaagatattacactgaaacaaaagaagatgcgttggatatgataaaaattttagaaaatgagtga

SEQ ID NO: 2250 - DNA (genomic), 222 bp, Enterococcus faecium; double-stranded, circular
  misc_feature (B) LOCATION 1...222
  hypothetical: NO
  anti-sense: NO
gtggatgcacgatcgaagggcatagattcgagattttcggaagatgtgaaaattgtcaataaggatttaaataaaataacatttgataatttaaaaaaaaagcaagatttccttgacggtcaaaacagcattagatataatatttacaggacagtcttgttttttgagatatatttcaataacaattacggttactttttaagctcggagggagggaattaa

SEQ ID NO: 2251 - DNA (genomic), 1644 bp, Enterococcus faecium; double-stranded, circular
  misc_feature (B) LOCATION 1...1644
  hypothetical: NO
  anti-sense: NO
tacgatcaacgtagaaaaggagatgtttttatgaaagttgttgtcattggcggtgtagctggcggtccttcatttgccactcgtttccgtcgattgaatgaagcgcacgaaatcattatctatgaacgcggagaaaatatttcttatgcaagttgtgctttgccttattatttaggaggtgtgatcactgaccgtgactcgctgatcgaacgtacaccagaaatattgaaaacaaaaaacaacatcgatgtctttactaaacacgaagtaacagcaatcgatccttctactaagcgattaacagttaaagacctatccacaaatgaagaaataaaaacagattacgataagttgatcatctcttctggtgctagaccagattatccggatattcccggagtttttgaagcagaaaacggctttgtcctccgtagtgtgacggatgcggatcgaatcaaatcgttccttgaagaaaaaaatccacaacatgtcgtcattcttggtgcaggtgttatgggtctggaattagctgagaatttcaagcatcgcggcttagacgtgactttaatcgatcaattgccacaagtcgctttcccttatgatccagaaattgctaatttagtttatgacaaattgctgaaagaaggattagccgttcatttagaaacaagagttactgagatccgtgataaaggtcgagaaatagtattatcagatggctccgtcctttctgctgatatgctaatttttgctgttggtgtttctccgaagaatgaagtggtgaaagcaaccggcatacaattatcagatacaggtcagatcattgttgatgaccagttacaaaccaatctgccggacatctatgcgattggcgatattatcgaaacgactagtgtagtgactggtcagccgatccaaagtatgctttccagtgcggccaatcgtcaaggacatatgctggcagatattttaaatggtacgcctatgcgctatcgcggatatattggtgcaggtgtcgcaaaaatctttgatcatacagcaagttatgcgggaatgacagaacatgaattaaaagcatcaggcataacaaattataaaactgtttttatcactccctttgaccatgcctatttctatccagaagctacaagattaaatctaaagctgatttttgatgcagatagcggtcgtattttaggtggacaagcatttggagaaaaaggtgtcgataaacggatgggagaactttctgtagcaatcaccggaaacttgacagtctttgatttgcctgatttggagttgccttactctccaccgtattctactacccgtgacccgttgaatatagctggttatgtcgcaatcaatcaaatgacgaatatcgtagaaacgatcaaagcaagtgatatacccgaaaacgatttgaaagaagcgttctttttagatatacgtgaacctaataaagcaccttctggcagtatctcggcaacaaaaaatattccaatgaatgagttacgagatcgaatcaatgaaatcccaaaagataaaaaagtttacattactttcagaagaggattgaatacttatacttctgcccgaatcttggcaggtttgggtatcaaagcgattttgattgaagaataa

SEQ ID NO: 2252 - DNA (genomic), 1071 bp, Enterococcus faecium; double-stranded, circular
  misc_feature (B) LOCATION 1...1071
  hypothetical: NO
  anti-sense: NO
ataaaacaacgtgaaagtagaggatctacaatgactgattttaatttttttaaggcggatagagtttacaacgaattattttatcaatttccaaaagtctttattgtttctgacgaatacaaaaaaatgaaagattcaactaagattgcctatatgcttttaaaagcaagattagagatcgcaatcagcaaacggcaaatcgatgaagaaggtaatgtttattttacttatacgacaaatgaactatgtagcgtattaaactgccaaaaacaaaaagcgatagcaatcaaaaaagagttggaatcctttggtttattattacaaaagcagatgggatttaacaaacagttagggaaaaataatcctaatagactatatctagcagaattaaaagtctcagaaaatgatatctacttactcgaaaaatttgatagagagaatagggaaaatgttgataaatcagagggtatgaaaatcatacccaccctcgacgaaaaatcagacgctgaatcccttggggctcaagagggtatgaaaatcataccgtgccaaaacgttgataaatcagagggtatgaaaatcataccagaacttaataataatatattagacactaatagacacaatatagacactgaaaaagaccgcctacaagatcaattgttgttagacaattttgagacaattatgacaaacgacagcattgctacgtttgtccctgaacgagtattaaatttgataaaaacattttcttcaagttacagtgaagctcaaaaaaccgtccagactattcataatgcaaagaaaaaagctgaaatagaaagtggtatttcgatagtttttgaagaactcgatagttattatgtcaatgcagaacaagaattatacacgacactgttaaaagcctatcaaaaattaaaaaccgaaaaagtcgaaaatatccagaacctgatttttgtctatgtaaaaaattggtttatcgaaaaaccaatagctgctaaagtatcaagtgaaaaacgtttgaattctgaaagctccccaagcactattacgaaagactggttagagtga

SEQ ID NO: 2253 - DNA (genomic), 267 bp, Enterococcus faecium; double-stranded, circular
  misc_feature (B) LOCATION 1...267
  hypothetical: NO
  anti-sense: NO
ttgttgcaacgcaatcatatttgtaatatagggggtaaaaacgtggggaaaccaatcatttcatttgatcaagtagtgaaacgctatgatgatgaaacagtattaaaaaaagtaagttttgagatcgaacaaggaaaattttatacactgcttggtccttccggctgtggtaaaacaacgatcctacgtattatagctggattcaccgaagctacagaatgggacatctattttgaagggaaacggttgaatgatttgcccagctaa

SEQ ID NO: 2254 - DNA (genomic), 186 bp, Enterococcus faecium; double-stranded, circular
  misc_feature (B) LOCATION 1...186
  hypothetical: NO
  anti-sense: NO
gtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaa

SEQ ID NO: 2255 - DNA (genomic), 186 bp, Enterococcus faecium; double-stranded, circular
  misc_feature (B) LOCATION 1...186
  hypothetical: NO
  anti-sense: NO
gtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaa

SEQ ID NO: 2256 - DNA (genomic), 183 bp, Enterococcus faecium; double-stranded, circular
  misc_feature (B) LOCATION 1...183
  hypothetical: NO
  anti-sense: NO
cattttaaacgaatgattgaggtgatttcctcaagtcattcgtttttttgtgtcacaaaacttgttttttcacgacatatcttaacgtatacgaaaagtcgcgacaatactttaacagaaagaagaaaaagaacaactgacagttttagtcctaaaaaatctaaactctttagatatgagtaa

SEQ ID NO: 2257 - DNA (genomic), 183 bp, Enterococcus faecium; double-stranded, circular; identical to SEQ ID NO: 2256
  misc_feature (B) LOCATION 1...183
  hypothetical: NO
  anti-sense: NO

SEQ ID NO: 2258 - DNA (genomic), 207 bp, Enterococcus faecium; double-stranded, circular
  misc_feature (B) LOCATION 1...207
  hypothetical: NO
  anti-sense: NO
ctcaacaaacggcaaaatatgaggaactatttttccgtttttttctctaatactcaggtcaggacgctgatttcacaacctctcgataaacggtgttcaaaagccagtttctcggtagtaagtcaaatttatgcaaaaatgtggaaagccattttcacaaaatttttcttactacttgaaactaagcagctttttcacaacctctaa

SEQ ID NO: 2259 - DNA (genomic), 270 bp, Enterococcus faecium; double-stranded, circular
  misc_feature (B) LOCATION 1...270
  hypothetical: NO
  anti-sense: NO
ctcagcaaacgtcaaaatatgaggaactattttgacgtttgtttctctaatactcaggtcaaaacgctgatcttacgacctcttttccttaaacggtgttctcctgccaactcctcggtcacaagtcacaatatcatcaaacatgagaagcagttttttgaaattgctccttgtgactcagagttaaacggcaggctcacaacctctttcttaaacggtgttcaaaagcttgcatctgcggtaatacgcccaatcaaacgaaaaatatga

SEQ ID NO: 2260 - DNA (genomic), 240 bp, Enterococcus faecium; double-stranded, circular
  misc_feature (B) LOCATION 1...240
  hypothetical: NO
  anti-sense: NO
tgctcaaaacggactacccaaagcattgataaacgcaaatgcagtcacctggattcgaacagctgctgtatctgcgctggcaacagattacttagcaaatccgcatgcagaaacacttgctttaattggagctggtcaacaagcattgtcgcatttgactgcgatttctaccattcgtcccatcactacagtgtttgtttacgatattttagaagaaagacgaaatacttttatcgctaa

SEQ ID NO: 2261 - DNA (genomic), 183 bp, Enterococcus faecium; double-stranded, circular
  misc_feature (B) LOCATION 1...183
  hypothetical: NO
  anti-sense: NO
ctcaaaaaacggcaaaatatgaggaactattttgacgtttgtttctctaatactcaggtcaaaacgctgatttcacaacctctttttcggtcaagttcaacaacagtttttacgcgtcgatctctggcgctttgcccaaatgagcttggatcatccagatacgtttttctgtggctgttttga

SEQ ID NO: 2262 - DNA (genomic), 192 bp, Enterococcus faecium; double-stranded, circular
  misc_feature (B) LOCATION 1...192
  hypothetical: NO
  anti-sense: NO
ctcaaaaaacggcaaaatataagaaactattttttcgtttttttctctaatactcaggccagaacgctgatttcacaacctctttatttcacattcaatatccacatgaatcccacaaatacaaagaacagaccatacatgattggagatacttcttttcctcttttagctgctaacatggtaattggatag

SEQ ID NO: 2263 - DNA (genomic), 948 bp, Enterococcus faecium; double-stranded, circular
  misc_feature (B) LOCATION 1...948
  hypothetical: NO
  anti-sense: NO
atgaaaaaacgaaaggggttcaatcatttttttatgaatctatggcgttataaagcacttgtcctgatggctgtaccgggtatgctttggatgatttttttcttttacatacctgtaatggcgaatgtcgtagcattcaaaaattttcatatttcagcagatgggttcttggctagcttgagggaaagtccttgggtgggttgggaaaatttcaaatttttattttcttcggatcaagcatttctcatcactaaaaatacaattttatataatgtagcatttatccttttgaatctgctgatctcagtcgtatttgcaatcattatgagcgagttgagaaataaacgactcgttaaagtttatcaaacgatgtccttactaccttattttctatcttgggtcattatcagttactttgtttacgcttttttaagtcctgacaaaggaatattcaatcagtggatcactggacatggaggagaagctgtcaattggtataatgaaccgaaatattggccgtttatcttggtgttcattggtacatggaaagggattggttataacagcattatttactttgcatctgttatgggaatcgatccgacttattatgaagctgctatggttgatggagctagcaaatggcagcagatcaaacatgtgacgataccacaacttattccactaatgacgattttaacgattttagccgtaggaaacattttccgagctgattttggcctgttttataacattcctaggaattccggtgcattatatgatgtgactcaagttttggatacgtatatctacaatggcctgacatccacaggagattttggtatgacggctgctgcaggactttaccaatcagttgtcggctttgtcttgttgatgatcacaaatacgatcgcccgacgttttgatagcgattctgcattattctaa

SEQ ID NO: 2264 - DNA (genomic), 921 bp, Enterococcus faecium; double-stranded, circular
  misc_feature (B) LOCATION 1...921
  hypothetical: NO
  anti-sense: NO
agaatgaaacgtatactaaaaatgaccatggttcttttctctcttcttatacttgcgagttgttccttccctggtcttgccagcaatacagatgaagacaccatttcgatcacaggtggaatcacttcagaagcacagatcttagcaagtctagttgccggaatggttgaacattatacagataaaaataccgcaatcatcaacaatctggctactacaactatcaaccatcaagcgatgatgaacggagatgcttcaatttcagcggctcgctacacaggaacagatttaacgactacattgaaccttcctcctgaaaaagatccgaaaaaagcgtttgctaccgtgaaagatgaatttgagaaaagatacggtcaaacgtggttcccgtcctatggttttgaaaatacgtatgtctttcttgttcgaaaagacaccgcacaaaaataccatctatctaaagtcagcgatctgaaaaatgtagcggatgaattagtagctggtgtagatacttcttggatcaatcgtaaaggagacggttatgacggcttccaagaaacttatggcttctccttcaattcgatattacctatgcagattggacttgtttatgacgcagtcgaagcaggaaaaatggatattgttcttggctactctacggatggacggatcgccagttatgatctagtcatgttggaagatgatcgtcaattcttcccaccatatgatgctgctccagttgtagacaacaagatattagctgatacgcctcatttaaaagaagccttaaataagttaggtcataccatcagtacggaaaaaatgcaggaattgaactacgaagcagataataatctagtggaaccatcagtagtagcacaacgtttcttacaagaaaaccactattttgaagggaagtga

SEQ ID NO: 2265 - DNA (genomic), 657 bp, Enterococcus faecium; double-stranded, circular
  misc_feature (B) LOCATION 1...657
  hypothetical: NO
  anti-sense: NO
caacagaaacgaaagaggttaataataatggaacaaaaaaatgatttttcaacaattatgactggtagaagatccgttcgcgtatatgatgaaacatacaaaatcccacacgaagaaatgctggaaatgatcaaagaagcgacgactgcaccttcttctgtcaatatgcaaccatggcgctttgtggtcgctgaaagcgaggaagcaaaagaaatcttgcgtcctttgatccgtttcaatacgagacaaaatgatacttcttctgcaatggtcatgatttttggcgatatgcaatgttacgaatatggcgaagaaatctataaccaagcttacgaatcagggaagatgccaaaagaagtcagagatcaacaattagctgcgatcattccttattacaagagtttttcaagagaagaaatgaacgatgtagtcaaagtcgattctagcttagcggctatgcaattcatgttagttgcgcgtgatcatggctatgaaacaaatccaattggtggattcgaagcagatcagttggcagaggcatttggtttggataaagaccgttatgttccagttattattttatcaataggaaaagcggtagaagaaggttacgagtctgttcgtttagcaccagaaaagatcactacgttcgaataa

SEQ ID NO: 2266 - DNA (genomic), 1113 bp, Enterococcus faecium; double-stranded, circular
  misc_feature (B) LOCATION 1...1113
  hypothetical: NO
  anti-sense: NO
atcactgaacgatttagaatacaggaggacaatcttttgaagattactttactatatggcggacgcagcgcagagcatgaagtgtccattctttccgcattttcagttttaaatgccatttattataattattaccaagttcaactcgtatttattacaaaagaaggacaatgggtcaaaggtccattactaacagaaaaacctgccagcaaagatgtcttgcatctttcatgggacccaagtggacagacagaggaaggctttacaggaaaagtgatcaatccgggcgaaatcaaagaagaaggagccatcgtttttccagttttacatgggccaaacggggaagatggaacgatccaaggcttcttagagacattgaatatgccttatgtcggcgcaggcgtattgaccagtgcatgtgccatggataaaatcatgaccaagtatattttacaagctgctggtgtgccgcaagttccttatgtaccagtacttaagaatcaatggaaagaaaatcctaaaaaagtatttgatcaatgtgaaggttctttgctttatccgatgtttgtcaaaccggcgaatatgggttctagtgtcggcattacaaaagcagaaaaccgagaagagctgcaaaatgctttagcaacagcctatcagtatgattctcgagcaatcgttgaacaaggaattgaagcgcgcgaaatcgaagttgctgtattaggaaatgaagacgttcggacgactttgcctggtgaagtcgtaaaagacgtagcattctatgattatgaagcaaaatatatcaataataaaatcgaaatgcagattccagccgaagtgccagaagaagtttatcaaaaagcgcaagagtacgcgaagttagcttacacgatgttaggtggaagcggattgagccggtgcgatttctttttgacaaataaaaatgaattattcctgaatgaattaaactctatgccaggatttacggagttcagtatgtacccactcttatgggaaaatatgggcttgaaatacggtgatttgattgaagaactgatccagttaggaatgaatcgataccatcagcgtcaatctttttttgaaaaaaatgaataa

SEQ ID NO: 2267 - DNA (genomic), 327 bp, Enterococcus faecium; double-stranded, circular
  misc_feature (B) LOCATION 1...327
  hypothetical: NO
  anti-sense: NO
aaatgcgaacgtgaaataattattgtaggaatgcaaattggtgtgttaaaatggttacaatttactaagcaaaaaggggtgcattttcctatgcaatttcttgagccaaaaaataagaacgctaagtctgtggattgggaaatatcagagcaagtaagggtgatagttaagcaatacgctgaatatgcagagcgtactgaaagcgaagcagtggatgaattcttattgaacattttagacgataagaagtttattgaatggattgccaacaagcgaagtaataagcggattgttgaaaaaatgggtatcaaagatagagtgggttga

SEQ ID NO: 2268 - DNA (genomic), 207 bp, Enterococcus faecium; double-stranded, circular
  misc_feature (B) LOCATION 1...207
  hypothetical: NO
  anti-sense: NO
tggacagaacgtttcaatataattggattcaattgttactcacctattttcattaaatttcctgatcgccatagcaaccatgctccaacagttgtctggaacaggttcagtgtaccaaataatataaatgcaggactgaatggctcgggaaataagcacagagaacaaagtcccaccactcctaatgctagcgaaaggagtggataa

SEQ ID NO: 2269 - DNA (genomic), 750 bp, Enterococcus faecium; double-stranded, circular
  misc_feature (B) LOCATION 1...750
  hypothetical: NO
  anti-sense: NO
gatgaggaacgtacggccattgtaattcaagacctttcagccgcttatcaagggaaaactgttttgaaaactatcaacttgacgataaatccacaaaaaattaccggtattatcggaccaaacggtgcaggaaaatcaacatttatgaaatctttgctagagttgataccagctactactggtaaagtcaccttttctggacagtcggtaaactcagtccgtaaaaaaatagcctacgtggaacagcgaagtgaattggatctttcctttccaattgatgtattaggcgttgtacttttaggaacatatccatctttacgaattggacaaagacctgggaaaaaagaaaaagaacgtgcaagacaagctttgaaaaaagtagggatggaagaatatgccaaaagacagatcagcgaactatcgggtggacagcttcagagagtttttattgcaagagctctagcccaaggagcagaatggatctttttagatgaaccattcgtagggattgatgcgttaagtgaacgaaagatctttgacatcttgcaggaattgaagaattcaggaaaaacgattttgatcgtccatcatgatcttcataaagtagaagaatatttcgatgaggttattcttttaaataaacagctgatcgcttccggtccagtacaagaagtctttacatcgaagaaccttcaattggcctatggtgagatcatcagacatttagtaaaaggaggagagaaaaaatga

SEQ ID NO: 2270 - DNA (genomic), 189 bp, Enterococcus faecium; double-stranded, circular
  misc_feature (B) LOCATION 1...189
  hypothetical: NO
  anti-sense: NO
aaaagggaacgtatgtttgcatactccttttttttgagttataataatacgcgaagagagataatttcattatttaaacaaactaaaaatcttgatattacttcttttcaggcaatacgaatattattcgcttacatttttttgtataaatttagttgttttaaatttaattgtctgctatgcctgtga

SEQ ID NO: 2271 - DNA (genomic), 603 bp, Enterococcus faecium; double-stranded, circular
  misc_feature (B) LOCATION 1...603
  hypothetical: NO
  anti-sense: NO
atttggccgctgaataaggagtccttacagatgaaagtaacagatacaaaattaacagatgtcaaaatcgtagaaatggacgtctttggcgatcatcgcggtttcttcacagaaagttattcaaaagcaaaatttgcagaacatggattgaaatatgactttgttcaagacaaccattcactatcagctgaagctggtgtccttcgggggcttcatttccaaaaaggagaagctgcacagacaaaattgattcgggtagtcactggagcagttttagatgtagtagtggatatccgcaaaggtagcccgacttatggtcaatgggacggatttatcttatctgaacataatcatcgacagttgcttgtacctaaaggatatgcccatggattcgttactttgacaccaaatgtgaacttcctttataagtgtgataattactataatgcagaagcagatgggggcatcgcatttgatgatccagatttagcgattgattggccaattgatccatcaagagcgattatgtcggaaaaagatcaccgtcatccgacattaaaagaatttgaagcagaaaatccatttgtttacggagaaatctaa

SEQ ID NO: 2272 - DNA (genomic), 468 bp, Enterococcus faecium; double-stranded, circular
  misc_feature (B) LOCATION 1...468
  hypothetical: NO
  anti-sense: NO
aaacaaagacgtcttggatactcactatttctcttaagttgctttgctttggcattaggatttgaagctgtatcagaagatattttaagtggtattctttttgaaccattcgttcattcttttttatctcatttatttattatcttaacgtcagctttcatcatctggtactattggagccgaatgttttactataaaaaatggtacggaattttttgtacgttccaacttttgatttttatcggcgttctgctttatgcaacttttactcctgcagaacttcctgaattaatgccgattgctaatattgctagtgttataagcactttagtcacttcacttgcatgcattggcgaagcatataagaataaccgtttttatgtagcttgtacaccttggatcgtcttggtagccattatccattgcttgatttacatccaaacggcattaggtatctatcaaacttaa

SEQ ID NO: 2273 - DNA (genomic), 225 bp, Enterococcus faecium; double-stranded, circular
  misc_feature (B) LOCATION 1...225
  hypothetical: NO
  anti-sense: NO
gaagctatttttgtttggctgttcttattacttgatgcagggcagctttttcacaacctctttttttatttatgtttcataatcaatatggtaaggatgcagctccgtatggtagaccgcctccgaatattcaatcatttccccaatttgcgtagacgatttccgtatccgtttgatgccgatctgtgcgtctgttttcagaattccttgttcttcttctgttaa

SEQ ID NO: 2274 - DNA (genomic), 252 bp, Enterococcus faecium; double-stranded, circular
  misc_feature (B) LOCATION 1...252
  hypothetical: NO
  anti-sense: NO
ccggcaggacgatctgaccctgttcccgctggcaacggacgcaccggcacagaagccggaaagcctgcggaagtttctgaatgtagacctggaaaccgtcctgccccagatcatgaagcagaaaaccgccttttaccagacagacttaaactatgcgctggatgccatgagggagggcgcaacgtccggcgacccggcaaaacagaactttgtcctgattttccggcagagcggcgtggagtgcttaaatga

SEQ ID NO: 2275 - DNA (genomic), 192 bp, Enterococcus faecium; double-stranded, circular
  misc_feature (B) LOCATION 1...192
  hypothetical: NO
  anti-sense: NO
caatatttgcgacttgatttgccacaaagactaacacggagccgaaaaaaatcagttttaaaatcagactatgttcctttatccattgcagcatcaagtatcgtttatttttcacattttcccattcctaacttgtatacttttgtgtcataccccaatgttatcttatttattttaatttttccactttag

SEQ ID NO: 2276 - DNA (genomic), 939 bp, Enterococcus faecium; double-stranded, circular
  misc_feature (B) LOCATION 1...939
  hypothetical: NO
  anti-sense: NO
tcgagaacgcttgccgcgttaatgaagtgtttttcacatattcgaagggaggaacctatgatgatatatggggcaattgaagctggagggactaaatttgtctgtgcagtcggtactgaggaattaacgattttggaaagagtcagttttcccacaacaactccagttgaaacaatgaagcaggtcattgatttttttaaaccttttaaggaacaattggcaggcatcggggtcggctgctttggtccaattgatattcaatgcaaatcaacgagtttcggtcatatcacatcaacaccaaaacttgcttggcaaaatttcaattttgtaggaacgctaaagcaatatttcaatattccgattgaatggacaacagatgtcaatgcggcttgctatggtgaatatgttgctggttctggcaaagggttagcaggtgttgcatacttcactgtgggaacaggtatcggaggtggtgccttgttcaatgggactttcgtggaagggttcagtcatccggaaatggggcatatgttgatcaagcgacatccaaaggacaatttttcaggaaactgtcccttccaccaagattgtttagaggggatggcagcaggaccagcgattgaaaaacggttgggtgtaaaaggccagaatttattggctgacgattcgttttggcagattgaagccttttaccttgcccaatgtgcatacaatacaacactgatgttttcgccagatagaattatttttggcggtggtgtaatgaaacaagaacacatgaagaaaaaagttcaggataaatttgttgagcttataaatggatatgttgaaataccaccaattgatagctacattattacgcccgaattaggtgataatgccggaataatcggcggattagcattggccagaaaagcggtaagaaataagcaaccataa

SEQ ID NO: 2277 - DNA (genomic), 600 bp, Enterococcus faecium; double-stranded, circular
  misc_feature (B) LOCATION 1...600
  hypothetical: NO
  anti-sense: NO
aaaagaatgcggaaaatggaacaattggcacaacggaagaaaaaaatcgtgattggtgtaagtggcgcttcaggcaccatttatgccatcaacctagtgaagaaactaaaagaatatccgatgatagaaacacacggaatcatcagtccatgggcaaaacagaacttaaagctggaatccgacttatcactaactgaattcgaaagcctgtttgattaccattattcaaacaaagatttaggtgctgctgtcgccagcggatcatttttgaccgatggaatgatcatcgtaccggcaagtatgaaaacagtcgcaggtatctctgttggtttaggcgacaacctgattgcacgtgctgctgatgtaacaatgaaggagcaacgaaagttagtcattgttcctcgtgaaacgccattaaatgccattcacttggaaaacttgactaaattagcacgactaggtgtgcaaatcataccaccaattcctgctttttataatcagcctcaaacgatccaagatcttgttaatcaccatacaatgaaacttttggatcaatttgaaattgtaaatgagcattcaaaacgttggcagggtgattaa

SEQ ID NO: 2278 - DNA (genomic), 1164 bp, Enterococcus faecium; double-stranded, circular
  misc_feature (B) LOCATION 1...1164
  hypothetical: NO
  anti-sense: NO
aggaggatgcgcatgaaaagctgcgggattatcgtagagtacaatccttttcacaatggacatcgctatcatgtggaaatggcacgaaaaataacaggagcagaggtcgtcattgctgtaatgagcgggaattttttgcaaagaggcgaaccggctatcatcgataaatggcatcgcgcgaatgaagctttacaaaatggtgtggatttagtagtggagcttcccgtcgaatgggcggttcagtcagctgactattttgctaaaggtgcagtaaaaatcttgcaaacactggactgtgacagtttgtgttttggaacagaagaagagacttcgtttgattacagcagtttcggacgctttgtccaagagaatcaagataggatagaagaggcatttcaagaactgtctgatcaaacgtatagttatccgcaaaaaatgactgaggtttttcgcagtctgtatcccgatattacgcttgatttttcttcgccaaatcatatcttgggattaagttatgcaaaggaaaatgccaagtatgtccaccctatggaattacatccgatccgacgtaaaagtgcaggctatcatgaaaaaatcatcacagatcagaggatagccagtgcaacagccattcgccatgcgttagaagaaggaaaaagaatagctggacttgtgccgcctcagacagaagaagatctttcaacttgttcgctgcagacttgggaatcttattggccgtatttgcgttatcggttgttatcttctactttgctggaactgacagatatctatcagatgaccgaaggaatagaatcgcgcatgaaaacagcagctgcaactgctgatagttttgaggattttgtgtcaaaggtaaaaacaaaaagatatacatggacacggatccaacgattatcttgttatgtcttgctgaatatcaaaaagcaagagattcctgtccaacaaaataaaaattatcttcgactacttggatttaccgatgctggaagaagattcttaaaagaaaaaaaagagatttctatttattcccgaatcggaaaaaaagaggcacaagaagcggaactgttagttagaagtgatcaaatctatcaattgggaggcaatattccggaacagaatttcgggcaaatcccaatccgagtatag

SEQ ID NO: 2279 - DNA (genomic), 381 bp, Enterococcus faecium; double-stranded, circular
  misc_feature (B) LOCATION 1...381
  hypothetical: NO
  anti-sense: NO
cactttgtgcgaaatggcgcaagcagttttgtggatttatccggtaaaatctgtatcgattttgaaattagaggagaaacttgctataatcaaagtgaaagaaggagtgggattttcatggatcatgtagtgttagaaatcgatttgcatttgatcaataatattcgggtgatttactatgttgtaagtaacagtgtcgaacaacgtgtactgacgaataaaataaatggtattttagcaaagaaagacgttcaccgattcaataatggtgaaggaagttattatagtatcccagtagaaaaaattatttatacgacagtcaaagtcagagaagatctagataccaaaaaagcatatgaacctatttttacaacttattga

SEQ ID NO: 2280 - DNA (genomic), 438 bp, Enterococcus faecium; double-stranded, circular
  misc_feature (B) LOCATION 1...438
  hypothetical: NO
  anti-sense: NO
tctttggtgcggatcattcatcaattaattaaagaaaaccatatccttttattttgtccaagtatcacgatgatgcatcgtttgaaagccacacttcaagaggctcttccgagatatgagatcacagatgtttcttcaagagacaatcagcgggcggaaaaagtccagaaaatgcgagaagcaaaatatgacatactgttaaccacgatgatccttgaacgtggagtcacatttgaaagaatatccgttatcgttttaggagcggatcatccggtttttactaaatcttctttggtacaaatcgcaggaagagccgatcgtaaagggccttatacgaacagtcaagtatactttttctatgaagaaaaaactgcagctattcgaaaagcttgtcaggaaatcaaagaaatgaatgaagaagggaagaagatgctgtga

SEQ ID NO: 2281 - DNA (genomic), 552 bp, Enterococcus faecium; double-stranded, circular
  misc_feature (B) LOCATION 1...552
  hypothetical: NO
  anti-sense: NO
agctgctcgcgaaaatggactagaattttagaagaaggaggaataccattcatggtttatatcgatccaaaacatttggaattagaagaccgcgttgttgcaattaaccgtgtaacaaaagttgttaaaggtggacgtcgtctacgttttgctgctttagttgttgtcggtgacaaaaacggacacgtaggatttggtacaggtaaagctcaagaagttcctgaagcaatccgtaaagcaattgaagatgcgaagaaaaacttagttgaagtacctatggttggttcaacaatcccacacgaagtaatcggtgcttttagtggtggtagaatcctaatgaaacctgctgtagaaggttctggggttgctgctggtggaccagttcgtgccgtattagaattagctggggtagcagatatcacttctaaatctttaggctcaaatacaccaatcaacgttgttcgcgcaacagttgaaggtttgaaacaattgaaacgtgcagaagaagttgcagaacttcgcggcaaatcagttgaagaattaatcggataa

SEQ ID NO: 2282 - DNA (genomic), 1410 bp, Enterococcus faecium; double-stranded, circular
  misc_feature (B) LOCATION 1...1410
  hypothetical: NO
  anti-sense: NO
cgagaaacgcgtttgcgcattgcttttttacgattttcttcgatcattgcttctttttcgtcaatcggatcgatcactgtttttttcacagaagcgaccaaaccagcaacggcagcggctgttgccaagctgcctactaatattccagatacaaattttttcattgaatccacctcatttattatttgttatatctattatggaacaaaagagaaaaaaaggctagttttacgtttgtttgtaaacctttgcaaaaaatccttgaaaatgtttactaaatgttttattataaatttaccagataaatttacgaaattttactttcttcttttccaccataaaagtagacttcgcttttttaattattttaattatatagaatcaacaaacacaatttcactaatcaaaggagtgttttttatgacaattttagtactaggcggagccggctatatcggttcgcacgctgtagaccagctagttcaaaaggggtatcaagtagctgtggtagataatttactcacaggtcacaaacaagcagtacatccagatgctcatttttatgaaggagatattcgggataaagaatttctacgttccgtatttgaaaaggaaccgattgaaggagtaatccattttgctgcaagctctttagtaggagaatctgtcgaaaaaccattgatgtattttaacaacaatgtatacggtatgcaaatcttgcttgaagtcatgcacgagttcaacgtgaataaaatcgtattctcttctactgcagcaacttatggagagccgaaagagtctccaatcacggaaaatacaccaactaatcctaaaaacccgtatggcgaaagcaaattgatgatggaaaaaatgatgaagtggtgtgatcaagcgtatggcatgcgctatgtcgctttgcgctacttcaatgtagccggagcaaaagcagatgcatctatcggagaagatcatacaccagaaacgcatcttgtcccaatcattttacaagtagctcttggccaaagaaaagcattggctgtttatggagacgattacgatacaccagatggaacatgtattagagattatgttcaagtagaagacttgattgccgcgcatattttagctttggaatacttgaaagaaggaaacgaaagcaacttcttcaatttaggcagtaacaaagggtattcggtcaaggaaatgttagaagcagctagagaagtgacagggaaagaaatcccggcagaaatagcaccaagaagagctggagatcctagtcgattagtcgcttcaagtgaaaaagcgagagagattttgggctggaaacctgaatacacagatatcaaagcaattatcaaaacagcatgggattggcatgtcagccatccaaatggttatgaagaatag

SEQ ID NO: 2283 - DNA (genomic), 294 bp, Enterococcus faecium; double-stranded, circular
  misc_feature (B) LOCATION 1...294
  hypothetical: NO
  anti-sense: NO
gtatctgcgcgaatgcatcaaaatgatggacaggcagggcaaaaccatttccgaaatactggagcttgtcagcctgaacgatgggagaatcgtacccatagccgaaccgctggacatagggcgcacggttgccgagctgctacccgattttcaaaccttggcagaggcaaacaaccagcggttcgtcacagatattccagccggacaaattgtcctgtccgatccgaagctgatccaaaaggcgctatccaatgtcatattgaatgcggttcagaacacgccccagggaggtga

SEQ ID NO: 2284 - DNA (genomic), 384 bp, Enterococcus faecium; double-stranded, circular
  misc_feature (B) LOCATION 1...384
  hypothetical: NO
  anti-sense: NO
atggtagcgctatctaaactatacacttttgaaaggagaaaatatgtgagcccgttcagatctgctgcattggaagaagaaagtgaccctcggatcaacgatgtcgttttatctacagggaatatcaaccagaaatatatcgtccgcgatatcgtttttgttgtggaatgcttagaagctgatttgtttgacccatcttttcccaaagatgaccttttcttaacaacgaagaggaaattaaagacgaaggtacttgaatatggtgcgaatgcagtaatcaactgtcattttgagtatcagcaaaaaaaacgcgacggaaagtattttctggaactttttgcttatggaacagtgatccaatttatccaaacaacgattggttaa

SEQ ID NO: 2285 - DNA (genomic), 1311 bp, Enterococcus faecium; double-stranded, circular
  misc_feature (B) LOCATION 1...1311
  hypothetical: NO
  anti-sense: NO
aagagtaagcgggcaatcaactgtgaaaaggagcatataaatatggtgtatcaattggcagaaggcgtgaatcttcatgtcttaccaacaaaacaatacaaaacgatccggatttttatccgttttactgcgcgtctgcaacaagaagtcatcacgaaacgttcacttctcagcagcatgttggaaacaaatagtttgaattatccggatcagacaaagttaagtgcgcaacttgcagagctttatggcgcaagctttggattatcagttagaaaaaaaggaaatttacattggctaaacgcagggatcagttttgtgaatggtgaatatgtcaatgatccaaaccttttttctcaagcggtagattttttaaaagaggttttattttatccaaatattaaaaatcatcagtttgatcagttgacgtttgacttggaaaagaacaatctgcgtctatatttggaaagtttgaaggaagataaacaaacttttgcttcctatgccttgcaagaactttattttgaaaacagcccggaacaaaagatcccagggttgggcgtagtcgaagatttggacaagatcactgctagttcgctagcgtcctactatcaagaaatgatggcaaatgatcaaatcgacatttttgttgtcggcgatgttgatccggacaaagcagctgaagcagttgggcaattaccatttgagtcgcgggaaacagtttatccagatctgttttatacccaacctcaagtgaatatcgtgaaggaacgacaagtacgtgagccaatcgttcaagcaaagctgaacctagcttatcagacaaatgtgtattacgatgaaccagaacgttttgcgctaatggtctttaacggtttatttggcggttttcctcactctaaacttttcatgaatgtcagagagaaagaaagtctagcttattatgcctctagtagcgtggatacgttccgaggattcatgagtgtccaaaccggtatcgatgaaaagaaccgaaatcaagtacttcatctgattcacgagcaattagaaagtttgcgaaatggtgaaataacagagttggaactgtctcagacaaaagcaatgctgagaaaccaatatctgctttctctagactctccgcaagcggcaatcgaagcttcttttttggacagctggctgccggaaacaaaattatctgatgaagaatggttgaaacgtatggagagcgtaacgatcaaagagatacaacaagtagctgagcaaatcgaattgcaggcaatcttctttttagcaggaggaaatgcaaatgaataa

SEQ ID NO: 2286 - DNA (genomic), 192 bp, Enterococcus faecium; double-stranded, circular
  misc_feature (B) LOCATION 1...192
  hypothetical: NO
  anti-sense: NO
ggaggcaagcggatgggaaaatttaatagagcgctagtgttcagcgcaccgctaatcatctacgctttaggactttggggaagcaggcaagcgttgataggaacgattgtttacatggtttggatttttatggggcttgatgaagctgaagctgagtacagagcgaaaaagccaaccgagggggctgactaa

SEQ ID NO: 2287 - DNA (genomic), 1422 bp, Enterococcus faecium; double-stranded, circular
  misc_feature (B) LOCATION 1...1422
  hypothetical: NO
  anti-sense: NO
gaaaggaagcgatacagaatgttaataaatgaattaaaaaaatattttggatttgattcatttcgtcccggccaagaagaaattattcaggcgttgcttgatggagaagatactctcgctattttgcctacaggaacgggaaaaagcctttgctatcaattgacggggtatttaatggaaggtctggtcatcatcgtgtcaccgctgctttctctaatggaagatcaagtgacgcaattacaaaaacgaggggagaaacgagtagctgctttcaatagtttactttcgcaatctgaaagaagatacgtcctccgtcatctatcgcaatataaatttttgtttttgagtcccgaaatgttgactaatccttctcttttagagcatctgaaaaaacaaaatattgcgttatatgtagtagatgaggctcattgcgtgtctcaatggggagttgatttccgtccagaatatcaacagttaggaaaaatccgaaagcttttaggaaacccggtcacactggcactaacggcgacagcaacagatttagtagcaagagatatacgtcatgtactatttgatcgaccaccaaaagagatcagacaatcagtcaatcggcaaaatatctcgctttttgttcggaaaacgcagcaaaaagaacaagaacttgaacacttcatggaaagagcacaaggagcggcaatcatttattgtgcaacaaaaaaagaagtcgaacgattgtatcatttattcagggaacgttttacagttggatactatcacggtggtcttgatgcagctcaaagaagacaacttcaacagcagtttgtaaaaaatcagctgcagtttctcattgctacgaatgcatttggtatggggatcgataaatctgatatccgttatgtggtccattatgatttgccagacagtctagaaaactatgtacaagaaatcggtcgagcaggcagagatcaggaagaaagtgcagcaattcttttttatcaaagtggggatgaacgtatccattatttctttaatcaactttctagagaacagcgacaaagttttgagctttatttggaatatgccacagagcaagctccctttgatgagctgcaaaaaaaatggatggagctgatccagcagtctgaaaaaccagaaaattgggtggaacggctcaaacgtcaggaaaaagaaaaagaattccgcctgcagcagatgcttcgctatattaatgaagaaaactgccgcagaaaattcatcttagcttattttggcgaaaaactctccgaaaagccgcagaattgttgtgatattgatggagcaaaagcagaacttctgccaaagaggaagcttttttctaagactgaacaacttcattgggaaacgattttactaaatttatttaaaaaaaacatggaacattga

SEQ ID NO: 2288 - DNA (genomic), 261 bp, Enterococcus faecium; double-stranded, circular
  misc_feature (B) LOCATION 1...261
  hypothetical: NO
  anti-sense: NO
cgccatattttccatattgaatatacagatactgctaaaaggatgatgaaaaaagcaaataaagtatctactactgatggaatggagataaaaaatggactagtaagatccatatccatcattcgaaccaaaatcattgaaaagagtttggaaaaaataataccgagtaatatcccagaaatacaggcgaacaatccaattatcatgatttctaacacatatatacctgatatctgcagtttattcataccaaaaagctga

SEQ ID NO: 2289 - DNA (genomic), 948 bp, Enterococcus faecium; double-stranded, circular
  misc_feature (B) LOCATION 1...948
  hypothetical: NO
  anti-sense: NO
aagcgacggcgttgtcgaaggcggaactggttcggtgaaaaaggaggatgcaaaatgaaaaagatcctgattactggtgcaaatagctatattggtacatctttcaaaaaatggatgacacaatttcaagacgagtatcaaatcgacacactaagtgtacgaggtgacgcgtggcgagaacatgatttttcggggtatgatacggtttttcatgtagcaggtatcgcgcacgcagatgtctcgaaagtaagcgaagaaactaaacagctctattatgcggtcaatcgagaccttgcaattgagacagcaaaaaaatataaacaagatctatcaggaaagaacggacaattcatttatatgagttccatcattatttatggtgaagaaacaaatatcaacaaaaaacgtgtaatcactccagataccaaaccaaatccttccaatttctatggtgacagcaaactgcaagcggaaattggcttacaaccattagatgatgatactttccatgttgctattttacgtccaccaatgatctatggaccggggagtaaggggaactttccagaattagttaaactagcggataagttacctgtctttcctgctattaaaaatcaacgttccatgctatttattgaaaatttatgcatgtatttaaaagaaataattgatgaagaaaagaatggtatctttttcccgcaaaataacgagtatgtcaggacaagtgatattatacaaacaatagcaaaatataaaaaaaagaaaacggtcatccttccttatttcaactattttgttaaattgttagggtattttcctggaaagattagcaggcttacaaacaaagcatttggaaatctagtttatgttcctaatgaaagagacgatagactagttgacttcgaagaaacaataaaaaagagtataggatataaaaatgagtaa

SEQ ID NO: 2290 - DNA (genomic), 273 bp, Enterococcus faecium; double-stranded, circular
  misc_feature (B) LOCATION 1...273
  hypothetical: NO
  anti-sense: NO
tatgaaaggcggctatttgggcgttccgatttttttcgtcgtatctggttatttgatcacggatctgctgcggcaggaatgggaacaaaatggaaaaatcaatatttggcaattttatgtcagaagaatgaagagactctatccggcacttgtttttatgcttgtgacagcttcggcttatatcactttgtttcagcgagggctgttaaacaatcttcgaggagttgtggtcagcagcttactgtatgtcaacaactggtggcaaatcaataa

SEQ ID NO: 2291 - DNA (genomic), 1584 bp, Enterococcus faecium; double-stranded, circular
  misc_feature (B) LOCATION 1...1584
  hypothetical: NO
  anti-sense: NO
aaaagaaggcgacactctgtgagaataacacagactgaaatgactttccactcacagtttttgtctaactatatacaaaaacagaataaaaaggaggtatttatgctaattgaagcaagaaaaaaagagttacttgttctacaaatggtcattcaaaaaaataattgttctttacaagaattatccaatgacttacatattccaaaacggacaatcaaagaactgatccgaaaaataaatgtatcactcaagcaatttttattgattgatgaatttatttattctaatcataaaggagagatccaaaccaaagaaaccgatcaaactaaaaagttagctgttttttctaagttaaaattatgctacctaaaagaatccaatcgttttaactatttgatgttactaatcaattatccacaaactgctgtaccaaaaaaatatttacttgaacaactttatatatcgccctcctatctcgaaaaactgacaaaacagctcaatcattccttaaaaaaattccatttacggatcctatctgtaaaaaattgctgtactcttgaaggaaatgagttatctatccgtctctatctttacttttttctttcagatacatttggaggtaacgattggccattttcctcacttgaattaaatgcactaaaaatgaacagtacagatgagcaaatagaaaaaatttcaaaacaagaaaaaaatatctacttgctgttaactttattcatattacgaaacaaacaacaggcatattttccaaaaacttcttctgaaatcactgaattgatggacttattgcagcatacacatgattattcagaatactttacttctttttcagtgagtcgcccttgtgaagagacagaaacagagagagcctactttaattattttttctattgtttttttccaaatcaaatctcttttcgacaaaaacaggagattggttttttattttccacaagcaaaaaccttatttgtcgacaagtcggtcaattgatgacttacttaactcaacagtttcctctcaaccatttagaaaataaaataccaatttatttttattttcttgtgttggcagttgtttttttcgaactgttgggtgaatccagcagtagtttttctacactttgctttccagaagccacgtccaatcattctagttcttttatacaggaaaagaaattaagagaaaaaatcgatacaattttttcaaaaaatggggaaagaaaccaaatcagtcaataccttagtcaattgatccaacacttactacaaacagaaacgaaagagcagttactcatccatttgcagataaccaaacagtttacaggaaattatcatcttcaaagccatttgcagcagttatttcgcaaagatgctgttaaaattaccgcatattcagaacatgctgatttgatcattacagatcagcatgagaaaatttcagatgaaacggagactttctatctggatacaacgcacaatacagtgttatttggcaagttaataaaagcggttcatgaactgtatatgaaaaaaggttatgagaacaaaacaaagaggatgtga

SEQ ID NO: 2292 - DNA (genomic), 1263 bp, Enterococcus faecium; double-stranded, circular
  misc_feature (B) LOCATION 1...1263
  hypothetical: NO
  anti-sense: NO
gacaatattttagaaaatgtgaaacagaggtgtattatgaagcgatggcaaaaagttctattaaccttgttaggggtattcgttttgctgattgccggattatcagcatacggaatcagatttatgggagaagcgagccaaacagtaaacaaaatttctaaaaactctaatcgaatatcctccaaacgttctgagagagtaagcattgatgacaaagaacctttttcggttttgctattaggtttagataccggtggattaggaagaacggaacaaggacgttctgatacgatgatggtagtaacagttaatccgaaacaaaaaaaatcaacgatcatcagtttggaccgagatatttatacgaatatcgtaggttatggaacggtagataaattaaatcatgcctacgcatttggtggtgtcgaaatggccatggattcaattgagcaactgctcgatattcgtattgatcattatgtaacgatcaatttggatggcatggaagatttgatcaatgcggtcggtggcatcaaagtgaataataaaattgactttactttggatggtgtccatgtaccagtaggtgaacaaacattgaatggagaaaaaggtttagcctattctcgaatgcgacacgaagatccagaaggcgatatcggtcgacaacgtcgtcagcgggaagtagtgacgaaaatcgtcaataaagttttaagtttagatggcgtaagcaattatagaaaaattttaaaagcagttgagaacaatgtgacgacggacttagattgggatgacatgcttgatgtagcgacgaactacaccccggcgtttgaaacaatcaaacaagaccagttgcaaggcgaaggacaaatgatcaatgatatctactatcaaattttaggaaaaaatgatcttctttccatccaaaatgaactgaagaaacaattaaatataaaaacaagcgatacattacctaatttgaaaaatgagaatgcttcaatgatgttctttgatgattcggaagatggcgattcgacaaacggtgatggatcgaatagtgaagggtacaccgattattcttcctattcagaaaacacatatgatcagtaccaagatccgaatacctattatcagcaaacagaagatacaagtcagtactatacaccaagtcaagatactcaaagttatgatccttacgctggacaggaacaaaatggttatggttatgaccagaataatgagtatggaacaacaagtgggtactag

SEQ ID NO: 2293 - DNA (genomic), 387 bp, Enterococcus faecium; double-stranded, circular
  misc_feature (B) LOCATION 1...387
  hypothetical: NO
  anti-sense: NO
aatcatcagctggtatcgccgttggaggacgttcaggtatcacagctattactacaggggattttcttcttgttaggcttgttcttttctccattactatcagttgttacttcacaagtaactgcaccagcattgattatggtaggagtattgatggcacaatctttgcgacaaatcgaatggggaaacttagagattgcgatcccttcattcttgatcttgatcggcatgcctttgacttatagtatttcagatgggattgcattaggttttatcttctatccaattaccatgttagcagctaaaagaggaaaagaagtatctccaatcatgtatggtctgttctttgtatttgtgggattcatgtggatattgaatgtgaaataa

SEQ ID NO: 2294 - DNA (genomic), 264 bp, Enterococcus faecium; double-stranded, circular
  misc_feature (B) LOCATION 1...264
  hypothetical: NO
  anti-sense: NO
tatgctaagctgaaatcaaaaggggggcgttactttatggctaaagaaaccgaagataaattagcgaaattagcaaaagaatctggcaatgactttaaaaagttagatgagatggaaaaagaattcaaattgaatgaaagtcctgatgtagaacgagacgatcgtgaagaatcaaaactagaaaaaacgttagacaaggcgcctatttttccgcctaacacgccgaacaatccaacgaatcctggcagccctgcgaatccttga

SEQ ID NO: 2295 - DNA (genomic), 240 bp, Enterococcus faecium; double-stranded, circular
  misc_feature (B) LOCATION 1...240
  hypothetical: NO
  anti-sense: NO
tggcacaagctatgcgatcttttatcgaaaatagttaatttaaaaaaagacgacaaaatgtgtcgtctttttatttaccatggtaagaatgttgtcttgttttttcaatacagcttgattgagactagttttatggacaatagagagaaagttattgttttattccagagaatttttctggtcgtagatctactaattgaacatgactgtctaaagaaccacttgggctttcaagagtaa

SEQ ID NO: 2296 - DNA (genomic), 228 bp, Enterococcus faecium; double-stranded, circular
  misc_feature (B) LOCATION 1...228
  hypothetical: NO
  anti-sense: NO
aatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatcggagttcttagtatattgttcaaacttaaatttcatataa

SEQ ID NO: 2297 - DNA (genomic), 237 bp, Enterococcus faecium; double-stranded, circular
  misc_feature (B) LOCATION 1...237
  hypothetical: NO
  anti-sense: NO
aatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatcaatgtcttttataatagcttttcatatattatataatcaatctttataa

SEQ ID NO: 2298 - DNA (genomic), 198 bp, Enterococcus faecium; double-stranded, circular
  misc_feature (B) LOCATION 1...198
  hypothetical: NO
  anti-sense: NO
aatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatctcttgactag

SEQ ID NO: 2299 - DNA (genomic), 228 bp, Enterococcus faecium; double-stranded, circular
  misc_feature (B) LOCATION 1...228
  hypothetical: NO
  anti-sense: NO
aatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatctaattctaccaatattactattttcattcttatgaattag

SEQ ID NO: 2300 - DNA (genomic), 192 bp, Enterococcus faecium; double-stranded, circular
  misc_feature (B) LOCATION 1...192
  hypothetical: NO
  anti-sense: NO
aatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatcataa

SEQ ID NO: 2301 - DNA (genomic), 261 bp, Enterococcus faecium; double-stranded, circular
  misc_feature (B) LOCATION 1...261
  hypothetical: NO
  anti-sense: NO
tcagactttagaaaggtcgtgagtgctttgaccacaggaattgtaaaatggtttgacaacaaaaaaggatacggctttatcagttatgatgacacagaagaaatttttgtacattttactgcgattgaagaagagggattcaaaactttggaagaaaatcaagtggtcgaatttgagatcatcgaagggaatcgaggaacacaagctgcccatgtcaagaaaggcaacgttcagactaccgatactagtatgcatgaatag

SEQ ID NO: 2302 - DNA (genomic), 186 bp, Enterococcus faecium; double-stranded, circular
  misc_feature (B) LOCATION 1...186
  hypothetical: NO
  anti-sense: NO
ttcctatttaggcaacatataacggttataaaagaagcaatagattatgatggtatcgattggatggatacatcttgggattcctttatcaatttgagcgtagcgtgtttttcatttatcgataaatttgttattcatttttttgataatcctatttacatatttacgtcctggttcttaaaatga

SEQ ID NO: 2303 - DNA (genomic), 1488 bp, Enterococcus faecium; double-stranded, circular
  misc_feature (B) LOCATION 1...1488
  hypothetical: NO
  anti-sense: NO
gggggaaagctcatggctcataagcataaattagatagtattttagactttcccgaagccagcgagcgtgaagacaatatcattgaattgaaaacctggatgtcacgattaagatgcaataaagacgatcagattaaaagtaacagtgttgtgaatgcagaattgattttaaccaatgatagcaatttagctggaacaattgcttataacgaatttagcggatacattcacctattaaaagattctccttggatcaatcgtaccgctggagaatgggaagacagttttgaggatgccttaacggcatatattgaagaaaactacaatgtagtttttgatgacaacaaaatacacaaagcagtagtaaatgtggctagaaagaatgttttcaacccagtaaaagaacgtatcgaaaaagttaaatgggatcaacagcctagactggaaacactgtttattgaccttttaggggtagacgacaacctttacacacgagaagtaacaaaacgttggatagtcggatcagtcgcacgtatctataaaccaggaataaagtttgagatcgttccagttttggatggaccgcaagggattggtaagagtaccgttccagcattactttacacggatgattttttcaccgattcattagattcgctaggtgaaaagaaagatgattatatgcagcttcaaggcaatgtaattattgaacttggagaattatcttcaatgaacaaaactaaaattgaacagataaaaaacttcatcagtgccaagatcgataaaattagacctccttatggtcggaatgtcatagcttgggcaaggcaatgtgtatttattggaacgtcgaatgatgggcagtatttgaaagatgatacaggaaaccgccgtttttatcctttgccttgtaagaataagccaaagatgaatccgtttaaaacaaaggatgaatattttcttcaagtgttagctgaagcaaaggtgctttttgataaaggacaacgaatctattttagtcccgatgaagataaagaagtcttagaaattgcaaaagactatcaagaggatgccaagatggagaatccaattaaagaagcaatcactaaatatttggaaatggaaatcccgtataaatgggaagaagctccagcgtgggcgagacgttcttattatcagaactatcctgacagtaaatgtaatgagaaaaatttacagcatttctataatggagctactatgcaacaagagttttatttagttgatagcgtactcaccgctgatattttggaagctgtttttgataaacaagcaaaggatttattgaatggtcgatcagatgcagaaactaaaaagattgccttgattattagcagtattcctggttgggaacggaagcaactgccaaaaagaaataaacgacgaggattttacaataagtcaaatgcctatgaaaataaaaatcgagctggaaagtacaaaaagtaa

SEQ ID NO: 2304 - DNA (genomic), 315 bp, Enterococcus faecium; double-stranded, circular
  misc_feature (B) LOCATION 1...315
  hypothetical: NO
  anti-sense: NO
cgatttcttagattgaaaaggaaagataaatattatagattattacttttgacagctgaagcaggatggatggattttccagaagttgtaaaagaagttcaagagataggtgcaactatttctgatagccgctcctctcctatgaactatcaggatgcccatggaattaaaataattgatcaagagagaaatgtcagaaaatacacaacaataaatgagtgtgtaattaatgaaaatctttgtagggcaccgataacgaaacacattaagaatagaagcaaagcaaaagacggaagaacttttactaccttctaa

SEQ ID NO: 2305 - DNA (genomic), 705 bp, Enterococcus faecium; double-stranded, circular
  misc_feature (B) LOCATION 1...705
  hypothetical: NO
  anti-sense: NO
aagttgaagctaagatcaaactttacggaaaaatgggtgctgaaccatttgaagcatttctctgaacggagccagattgaggttaatgaagatcatatctccgtccaaattccaaataaacgtgtgcgtgcagaccttgttttctacttacctaaacgagtatacgaccacgcagctattaaacttctaaatggcaacatcatgattgaaacattggaagctaaagatatttatacaaaatctacgaatggtaacatcatcgtggaccaattaactgcaacgatgctggaagtagaaggtgtaaacggcaatatcgatattcgaaacgggaacatcttagattctattatcgaaacagtaaatggtacagtgacatttggtgcgacagcagaaaacctttctgtgtctttggtaaatggtgatgtacgtcttacgattaaagaagataatttgaaaaaagtagaagcaagttcagtgaacggaaatgtcaaagtcgctttaccagatggcatcggtttggaaggacatgctaaaacaagtcttggaagtatcaacagccgtctgtccaattacgaagtagttcgtgagaaaaaagaacggacaaaccaaatgttgcaattccgtcgtgtttcagatggtgaaatcgcgcaagtgcaactttcaacgacaacaggaagtatctatttaaaagatacagataaataa

SEQ ID NO: 2306 - DNA (genomic), 552 bp, Enterococcus faecium; double-stranded, circular
  misc_feature (B) LOCATION 1...552
  hypothetical: NO
  anti-sense: NO
atagtgaagctgttcgggctgttacaagcagagacagataccgaagatgaacaaatcaaaatgacttatttgaaaatgatttcgttagccaaacgggagatattgatccaaacgccttattacataccggatggatcgattcatgaagcactgaagttggctcttctttcaggcgtaaaagttcatatccaaatacctaacaaaccagatcatcttctcgtttactgggcaacgtattctttcgctgcagagctaatcgagtatggagcaaggatcgaaacatatgagaatggatttattcatgcaaagacgatgattatcgatggtggcattgtttcagttggctcagcaaatatcgatgttcgttcatttcgcttggactttgaggtcaatacactggtttatgatgaacgaatggcttcacgtgtaagaaaagctttttttgaagactcgaaaatttctacgcatctcacaaaagaaatgtatgaaaaccgaggaataatcatccagatgaaagaaggattaccaagattgatttcgccgctcctttaa

SEQ ID NO: 2307 - DNA (genomic), 546 bp, Enterococcus faecium; double-stranded, circular
  misc_feature (B) LOCATION 1...546
  hypothetical: NO
  anti-sense: NO
gcaaaacttagaaataacataaaaatgatatctattatttggtttttgttttttttcatttttttctcctatttaaaagtaataaaaattgattcttttctagtatatcatactagtgctatgaaaaatttaacgcaaaacttattaaaaaaagacaattctagtatactgaaaatagaattaaaaaaggagaacaacaaatctatgaaaataagtaaaaaagcatttcttttagtagttcttatcttacttagtactttatattcagtaaattttatgagaaatgctcaagaaatttatacaacaggtgatttatcttttcatctttcacgaatcaaagggttatcttctatttttgaagggccaatcaactatacaacatttaacaattatggagatggactgaactatttttatccttttcttacaataattcctgcagtcgttttttatggaatttcaaataacttaatattaagttatgttctatatatttggttattaaatatttgtacgattctgattagtttttgggagcgtcaataa

SEQ ID NO: 2308 - DNA (genomic), 1191 bp, Enterococcus faecium; double-stranded, circular
  misc_feature (B) LOCATION 1...1191
  hypothetical: NO
  anti-sense: NO
agaactattagcaacaaacgaaacttatcaagaaatcgttcattcacaactaagagaggaggacttagcatgagtaaaacaaacacacgtccctctcatggaccagcaggcggtccaggacatggtggacctggcagaaatctcggtgtaaaaggtgaaaagcctaaaaatttctggggaacggtacgccgattgtttggctatatgtctaaacgtatggttgcgatcatcgctgtatttgtactagcaatagcagccgtgatcttccaaatccaaacaccaaaggtcttggggaaagcaaccacagaaatattcaaaggtgtaatggctggcgctcaacagatgcaacaaggccaacaagtaacaaaatttccgatagactttgataaaatcgcgcagatcattgcgacagtaatcgtgatgtatttgatttctgctgtattcaactttttacagcaatttattatgacacgtgtttcccaacgaacagtttatgaattacgtcatgatttggaagccaaaatgaatcgtgtaccgatttcctattatgatacacatacaaatggggatatcatgtctcgagcaatcaatgatatggataacatcgcaagcacgctgcagcaaaatttgactcaatttgtaactagtgcagtcacattgattggggtcatcgtgatgatgctttcaatcagctggcaattgacgttagtcgcgttattgatgatccctttaagcttgatcatcgtgatgatcgtagcgccgaaatcacaagtgtttttcgcagatcagcaaaaaagtttaggtttattgaataaccaagtagaagaaacatatggtggtcataccattgttaaaacattcaatcatactgaaaaagaccaggaagtatttgaaaaagaaaatcagaatctgtatgccgctggttggaaagctcaatttatttcggcaatcatcatgccgttgatgaatttcgttaaaaatctaggctatgtgttcgtcgctgtactacgcggagtaaaagttgcaaatgggaacatgacattaggggatgttcaagcgttcttgcaatatacaacacagttctctcaaccaatcactcaacttgcaagtttgatgaacactatccaatcaacagttgcttcagccgaacgggtatttgaagttttggatgaaggaaaagatgtccaatga

SEQ ID NO: 2309 - DNA (genomic), 222 bp, Enterococcus faecium; double-stranded, circular
  misc_feature (B) LOCATION 1...222
  hypothetical: NO
  anti-sense: NO
agtttcattagcctaaagacactctggagatggacgagtgaaaagccgtcccgcgtacgagcgttattcgtaagaggaaagagaaatctttcaaaattaggtggtaccgtgtatgaatttcattcacccttgttcatgatgaacaagggtgatttttttatttacatagctaagaaagggagagaaaactatgagtttccaaagaccaaaaggaacaaatga

SEQ ID NO: 2310 - DNA (genomic), 1383 bp, Enterococcus faecium; double-stranded, circular
  misc_feature (B) LOCATION 1...1383
  hypothetical: NO
  anti-sense: NO
aataacattagagccaaaattgttgtctctaacggaaaagaaaggaagaagaagatggaacaaacaaaaaagaaaaaatttcaaatgccttcagcgtatacggtcttatttattattattgcagtaatcgctgtacttacttggtttataccagctgggcactatagtgtagacgatgcaggcaacatcgtcgctggatcatatgaacgagtacaacaaaatcctcaagggctgtgggatattttcatggcgccaatcaatgggatgctaggtgtaccagcgggggagctaactaaagaaacacctgctgcaatcccaatctctttcttcattttggttgttggtggatttttaggtattatcaacaaaacaggggcactagatgccgggattgcttcagttgtgaagaaattcaaaggaaaagaaaaaatgcttattccagtattgatgctgttatttgcattaggcggctctacttacggaatggcagaagaaacgattccattctatgctttactgatcccagtcatgatggctgtaggctttgatacagtagtagctgtagcaatcgtattagtagggtctcaagtaggctgtctagcttcaacggtaaatccttttgcaacaggcgtagcttcacaagctgttgggatttcgatgggtgaaggtattggtcttcgattcttgatgttcgttattttgttagctatttctattgtatatgtgtatcgttatgcatcaaagatcgaaaaagatccaacaaaatcattagtatacaaccaacgtaaagaagatatgaagcatttcgatattgaagcaatcggtcgtcaagaagtaatcacgaaaaaacaaaaacatgttaatgtattgttctttattacttttggtatcatgatcatcagtttgattccttggacaaccttgaatgcgaatttcacgatttttgaatcattgacaaactggttaacaaaccttccggtactaggtacggttctaggtaaaagcatgcttccattaggtgactggtacttcccagaaattactatgttattcttagtaatgtccatcgtagtagcaatcacttatggcatgaaagagtctgaatttgtctctgaatttttagctggtgcttctgatttgatcggtgtagcaatcgtagtagctgttgctcgtggtatccaagtggttatgaacaatggattaatcacagacaccatcttacattggggcgaacaaggattaagttcattatcttcaagtgtattcatcattattacatttattttctatatccctatgtcatttttgattccttcaacttccggcttagctgctgcaacaatgggaatcataggacgtctgtattcaccacaggttgccccc

SEQ ID NO: 2311 - DNA (genomic), 774 bp, Enterococcus faecium; double-stranded, circular
  misc_feature (B) LOCATION 1...774
  hypothetical: NO
  anti-sense: NO
caaaaaattagaggaaatcaaatgaatgaaaaagaatgggatgaatttgctgaagaatattatgaaatccagcaagaatcgcaagtaactattgctgaagatgtaaaaaattatctgaaaacggagaaagtcctgcctgctgaaacagcagcagacgttgctggaggatctggcagatttctttccttagcaaaagaaattaatcgctatgatttgatcgatttttcttcaggaatgctagaaaatgcaaaaaaagaagcagaaaaaaatgagttgccaaatgtttcctttatcaaacagtcgttagaagaatttatccaatcaaatgagacatatgaaatggtttttacagcagcaaatccagcattggtacatcttattcaattagaaaaattgatgaaaaagtcaagcaaatggtgcgtgataatcagagtagtggaatcaatcgatgatgttttttatcctatcgaaaagcaactaggaatgatagaagaagatcctaatacatcgccagttgtaatggatcaatttgaaacatacttaattgatgaaggattcaaagtgaagaaaaaagattttacttattttacacaggaatcaattactgaagaattgatgaagctatactatgacgcgtacgcaaaagatcctgttgtgaccaggtacattcgcaaactattcagtgaaaaacgagaaatccttagtacgactaagctgacctatagactgctcctttggtccgcagataaaaaaagaacctttcacgactcgtga

SEQ ID NO: 2312 - DNA (genomic), 3150 bp, Enterococcus faecium; double-stranded, circular
  misc_feature (B) LOCATION 1...3150
  hypothetical: NO
  anti-sense: NO
atgaaaattagtcaccgtgaggaagcggaagtcgaagaacagttgatccgtgtattgggggaagggcataatcagtggacgtatcgtcccgatctaaaatcagaagaagatctttgggtcaatttacgccaaaaaatcatctcaaataatcaagcagaactgaatgattttcctttgaccgataaagaatttgaaacgatcaaaacagaattgttactacgaacgaaaaccccctttgatgctgcgaaatggttaaaaggtgaaaatggaatggctcggatcacgattgaacgggaagatccgcaactgggttctgtctcgctcattctttattctaatcaagacattggtggaggaatctctacctatgaagtggtccatcaaattgcaaaacgtggaagtaacatagaagcacgggatcgacgttttgacgtcaccttactgatcaatggattaccgattgtccaaatcgagctgaaacaagtaaccgcaaaagatagtttttatcaggcgtttaaccaaatcaaaaaatatgcagaagaaggtatgtttcggaacaatatcttttcgaccttacagttgtttgtggtttccaatgaacaaaccactcggtattttgcaaatgccttaccaaaggatttgcatcctaagtttttatttagttggcgaacgaaagataataaaaaggtagaaaacttatatgagttttgcaaacaagtgctaaatatcccggatgctcatcgcttgattgcggattatacgattgtcagtgaagatcaagacaataaaatcctcatggtgttacatccttatcaagtacatgcgattcaagccttgtttattgctgcaaataaacatcaatcaggatatgtgtggcatgcgactggttcaggaaaaacgttgactagttttgtatctactaagcttttagcacgaaaatcggggatcgatcggacgatcatgttagtggaccgcaaagatttagataatcaaaccaccacagagtttacgaaatttgcttcggaatttaatactgggatttcttccgggaacgccaaagcgaatagcttgatcgtgggaacaggaagtgccaaagagttaagtgaaactctgttggcagatgccaatgcaaatgttgtgattattacaacccgtcaaaagctagatgcggcgttgaaatatgcaaaaaaacaagaagagaaaaaaggaaccaatcgcttccaaaaattaatggggcaacatatcgtgtttgtagtagatgagtgtcatcgagcgttaagtgctgaaaatatggaagaaatcaaaaaaatgtttccgaaatccacttggtttggctttacaggtacaccgattttccctgagaatcggaaacaagccaaagggcaattggcacgtacgacccatgatcagtatggagaggtcttgcatacctataccatcaagaatgcattagaagatggctcggttttaggatttcaagtagagcatgaaaacaccgtggagccgacttcattagagaataaaatctatcggaaattaaaagaagtagaaacatatgcagagtattcaccggaacagatcaatcgtatgattgatcaaatggagcctgtcaaaaaagaaagttatttggaccctactgtttttgaagcagatgaacatatccaaaaagtcattcataaaatgttccgtccagacaatgcctatacaaaatttgattttcgaaatggccgtccaacgaagtctgcgatcttaaccacgagttccattgacatggccaaaaagtattatcgagcgatcaaagaaatgacgaaagaacctgactggttaacaaaagagtttcctaatcagcccattcgtgaaggaagaacgatggaggatcctgattttccacgaatcgctattacctattcattagaagaaaacagccgagattcaagtgtccaacaagaagaaatgcaaaaaattattgaggaatataatcagtattatgatacttcctggtcattagcagacattgagcgttataacggagacatcaataatcgtttggcacgaaaaagagcggaattcaaacaatttgggaaacaaattgatttagtgatcgtagtggatcgtctattgacaggttttgacgcacctacgattcaaaccctatttgtggatcgtaatctagagtatgcaggattgatccaagctttttcacgtacgaaccgtacgtatccagaaaaaacaaaaggactaattgttactttccgaaagccagccacaatggagaagaatgtcgaggatgcgacaaaactgtattcagaagcaaaagaagaatcgggtttgatttatccaagttatcaggaatccaaaaaaagattcaagcaagcatatggtaagttaaaagaggtttcatccatggaatccattgatgaacatacgccacttgaaatccgtatcgagtacgtcaaagcattccaagaattgaatcgtgcttatgaatcgttagtgacttatgacgattacaatgatgacatggtgaaatcttcaaccttgaacaatcaaattcaacttttggaagaacaaattggcgtgtacgagaccgtgaagggttcattaatagaggaagaaccagaaaaagagggagaagatttttccacgatcgaattttatagtgaaaataccacgaagttgtatgatattgattctacttatattgatcaattactaggaacttatgcggcgaatagttcagatgcacgagaagaaattgaaaaagctttggctaaattgaataaaacagaaggagtcaaagaagtttaccgacaaattttaaatgcgtttgatgtggggactttagatagtaatgaagatatctttgtcattaaacgtcgctattttacacaagcgagtgatgatttgattcatgtcttttccaatgagtggtttgtttctgagaaagaattacatgcttctaatctgcaatatatgccaggtgaagatccaattcctaatatgaaagcaattatcaacagtaaggattacgaaggatataaagccaaccatccagaagcgaagccatttaaatacccacaagaaatgaagcgagcatggcgtaaaatgttagatgatgagctgattccacttgaaaatgaattgaggtaa

SEQ ID NO: 2313 - DNA (genomic), 621 bp, Enterococcus faecium; double-stranded, circular
  misc_feature (B) LOCATION 1...621
  hypothetical: NO
  anti-sense: NO
ttggaaattagtgtatttgaaggtgcaaacaaaagcgaattatcaatgatcgaagtagcacacgcgatcttagaacaacgtggcgatgtcatggatttttctgatttagctaaccagatccaaaactatcttgggaaatcagacagtgaaattcgtgattcactcgcacaattttatactgacttgaatattgacggcagctttatctcattaggggataatcgttggggcttgcgttcatggtatgctatcgattcgatcgatgaagaagtaaaccatggaatggacgaagaggatgaagatactccacgtcgccgtaaacgcaagaaagtcaacgcctttatcaatgatgatgaagacgcgatcgattactatgacgatgacccagaagatactgatctgacagaagaagatgacgatgatctgtttgatgacgatgatgatgaagatgaagaaatcgctgcttataattctgacttgcaagaaatcggagcagatgacccgacagatgatgaagaagacttgccaggaaatatcgaagaagatttaagtatcatagacgaagacgatgatgatgaagattatgaagaggaagaattttctgactctgaaaaagaataa

SEQ ID NO: 2314 - DNA (genomic), 603 bp, Enterococcus faecium; double-stranded, circular
  misc_feature (B) LOCATION 1...603
  hypothetical: NO
  anti-sense: NO
aaagcgattagtaaaggaggaaatccattggaattaaagaaattagaagttcccacatcttcgatcacagaagtgaaacgatcgccgatggatgtatttgctcaagcgcgagacgcgggaactggcgtatatatatttaatcgggaaaaagtagctggtgtgatgttgacccaagaacaatacgaaacgctcttgcaagaactagatgtccttcgtcaaacagtgaaagaggaactgaaagaaccaaaggaaaaagaaatacatgaagaatctgtcaataaaacagcttccgtcgtatccaatgctgaagggatggaagagttggcacaaacattacagcactcgcttattactggtgtgacgattacagcaaaaaatctagatgaacgaatggtcgcacttggttttattacgaaaaaaaccggatttggcggggtcgtggatatgctcagcgaattgatgaaaaccgggaaaatcaattaccagctaagaagaaaaccgcaaaatcggaccatcatcgctgaaatcataggggagcaaaacagtcaatcccaattgatggataagattattatcaaaaaaatttttctacatgaattataa

SEQ ID NO: 2315 - DNA (genomic), 972 bp, Enterococcus faecium; double-stranded, circular
  misc_feature (B) LOCATION 1...972
  hypothetical: NO
  anti-sense: NO
caacatgttagaaaggaagagagcatgcccactttagcagatgttgcaaaacgtgccaatgtttcaaaaatgacggtctctcgagtcatcaatcatccggaacaggtgactgacgaattgaaagagttagttttctcagcaatggctgaactggattaccgtccaaatattgctgcaaaagcacttgtcacgaatcggtcgcagatcatcaaattatttatactggaagaaatcgacacaactgagccctattacatgaatttgctgatgggaatcgctaaacggatcggtaaagcgcattattctctccaattagttacaaatgatgccttcgacgtcggttcttgtgatggatacatcatcacaggtgtcagaaaaaaagacttcgattggatcgaccgtttggaaaaaccagttgtcttgtttggggaaaattctgaaggatatgattatgtagacagcgataatgaatatggtacagcaaaagcaacgcaatatgccttagaaagagattatcaaacgattatttatatcggtatcgaagtggacgagccttttgaaatttcaagggaaactggttatttatctgtgatgaaggaagttgatcttcctagtaaaatcttgcggtttccaaatcattcgacagaagtagaaagatatatgacagaaaactgggcagattttacagataaaacttgttttgtatgtagttcagatcggctagcactaggagcagtaagagggattataaatgctggaggacacttgcccgaagaatttggtgtgattggatttgatggggtatttttagaccaaatcagttcacctaaattgacaacgatcaagcaagatattatacgtatgggtgaagtatgtggagaaatgttgttaaaaaaaatagaagaaaaaggggcgagtcaaggttatcgtcgtttttttcctgaactagttatcagagagacaacgaattaa

SEQ ID NO: 2316 - DNA (genomic), 2907 bp, Enterococcus faecium; double-stranded, circular
  misc_feature (B) LOCATION 1...2907
  hypothetical: NO
  anti-sense: NO
ataatggttagcaagaataataagagagtatttctagaaaaaacaaagaaacgagtattgaagtacagtatcaaaaaattaagtgttggggttgcatctgttttgattggtgttggtcttgtcttgggaacaactgaactagttaaagcacaagatgaaatttctccaagcagcccacttgaaacagcgataagctccgtacaagtaggtgacaaagtagcttcggggaatacttttcaggagaatcctggttatacgaaaaattataacttttcggatttacaatttagtcctcaagaactaactggagacacactaaaaggcaatacaattggatttgaagtttacggaaaacataatattgcagcatcaactaaaaactgggaaatccgtcttcaattagatgaacgattagctaaatatgtagaaaaaattcaggtcgatccaaagaaaggaattggatcttctagacggacctttgtaagaattaatgattcgctgggtagacctacaaatatttggaaggtcaattatattcgtgcaagtgatggattatttgctggggcagaaacaaccgatacgcaaaccgctcctaatggggtaattacgtttgaaaagagcctagatgaaatttttaaagagataggcatagacaatctcaagaccgatcgtttaatgtatcgaatctacttggtaagtcatcaagacgatgataaaattgtaccgggtattgatagtacgggctactttttaacagattcagatgatttctataatagcttagatgtatctgaaaataatcctgaccagtttaaacatggatcagtaagtgcaaaatatgagaaacctaatactcaaacaaaagatggttcaggatccacaggtgctaatggagctataatcttagatcataagttaacgaaaaattataatttctcatattcatcttccgcaaagggcacgccttggtatgctaattacaaaattgatgaacgattagttccatatgtagcgggtatacagatgcacatggttcaggctgacaaagtaacatatgatgtttcgtttgaatccggaacaaaagtagctgatttagcaatcgagcgacgggaaggtcatgaaaattatggcataggttcaataactaataatgatttaactaaacttatcgattttgctaatgcaagtccacgtccagtcgttattcgatatgttttacaattgactaagccattagatgaaatcttagaagatatgaaagcaacagcacaagttgaagaaaataaaccatttggtgaagatttcatctttgattcttggttgtcggatacgaataaaaaattaatccagaacacttatggaacaggttattattatttgcaagatattgatggtgatggaaaccctgacgataaagaagagagcggagacacgaatccatatatcgggaaacctgaattagaagaagtatatgatgttgacacaacagttaaggggaaagtattcatccacgagttagcgggaacaggtcacaaagcccaacttgttgataaagaaggtactgtattagcagaaaaaactatcgctccaaatgaaaaagatggggctccaatttcagatactgtagaatttgaatttacgggtgtagattcaagtaaattaatcgcgaaagatgaattaaaaatccaaatcgtttctccaggttttgataaaccagaagaaggttcaaccgttattaaggaatcaccaaaagcggttgataaacaaaccgtggtagttggatttaaaccagatgctaaagaatcaattcggaataataaaaacttacctgaagatgcagagtattcatggaaaacagagcctgatacttctaacgttactgatagtacgaaaggtattgtaactgttaagatcggaaatcgaactttcgacgtggatgtagagtttgctgtaaaagcttctcaagctatggaaaatgatgcaacatacgtacctataacaacaactccagaaacgacagttcaaagtggaaaacctacatttgataaaccagatgttcctttagctaaagatgccttttcaatttcagatgtctataataaggacttcggtaatgcaagtgttgatgcaaacactggtattgttacattcactccagctaaaggtgtaggagaatcggagccgattactggaacaattcctattaaaattgtttaccaagatggttctgtaggcacgaccgatttagcagtaactgtaagtaaagatatttatgaaaatccaggagaaaacattcctgcaggctaccacaaagtaaccttcaccgcaggggaaggaacaagtattgaaagtggaacaacagtctttgcagtgaaagacggcgtaagcttgccagaagataaacttccagtgttgaaagcaaaagatggttatacagatgcgaaatggccagaagaagcaactcaaccaattacagcagatgatacagaatttgtatcaagtgcaacaaaattggatgatatcattgaaaacccaggggataacattccggctggctatcataaagtaacctttactgcaggagaaggaacaagtattgaaagtggaacaacagtctttgcagtgaaagacggcgtaagcttgccagaagataaacttccagtgttgaaagcaaaagatggttatacagatgcgaaatggccagaagaagcaactcaaccaattacagcagatgatacagaatttgtatcaagtgcaacaaaattggatgatatcattgaaaacccaggggataacattccggctgggtatcataaagtaacctttactgcaggagaaggaacaagtattgaaagtggaacaacagtgctttgcagtgaaagacggcgtaagcttaccagaagataa

SEQ ID NO: 2317 - DNA (genomic), 417 bp, Enterococcus faecium; double-stranded, circular
  misc_feature (B) LOCATION 1...417
  hypothetical: NO
  anti-sense: NO
actttttctagttacataagcaaatgcattttttatcattattcaacctccaaattcattttatttacttttttcaactttttaccacttagttctaaaatgatatccgcagaatctgctacttccttactatgtgttacaactattacacatttatttctatctttagctaatgtctttaatatattaattatttctccagcagtaacactgtctagattaccagtaggctcatcagctagtattattggagcatctgataccaatgctctagcaatagctactctttgttgctgtccaccagataatttcataacatttctttttatttgttttttatctaaacctagttcaaacaagatactttcatctgctgatttatttactaatctaatattttcaattggtgataaataa

SEQ ID NO: 2318 - DNA (genomic), 183 bp, Enterococcus faecium; double-stranded, circular
  misc_feature (B) LOCATION 1...183
  hypothetical: NO
  anti-sense: NO
tttccgtctagtcaaattggttcagaatgtagacacacagatggtaagaagtcactcacaattcgagaatggacttgtcctatttgccgtatacatcataatcgaaacgtcaacgatagtatcaatattttgaccaagggctatgaatacaagcattgccttagaaaacatcaagaaccttag

SEQ ID NO: 2319 - DNA (genomic), 207 bp, Enterococcus faecium; double-stranded, circular
  misc_feature (B) LOCATION 1...207
  hypothetical: NO
  anti-sense: NO
agggagtctagtgtttcgactgcatatcttgcttcaaacaagtgcatacttacatacattattctcatgaaagaaacaaaaataattccacttaaaaaaaacaacatcaacaagtcaacagctaagatcttgggagtggtaagagaagttataaaaaaggttataggaactatcaaaatgcaaactatgccaaaaaatagccattga

SEQ ID NO: 2320 - DNA (genomic), 528 bp, Enterococcus faecium; double-stranded, circular
  misc_feature (B) LOCATION 1...528
  hypothetical: NO
  anti-sense: NO
aatgtgcctagcaataatttggaagggatgaatgaagtgaaaactatttatctggatcatgcggcaactacccccatgcatccacaagtaattgaagcgatgacggcaatcatgcaagacacgtttggaaatccttcaagcatacatggatttggtcgccacgcgcatgaaaaattggaaacagcaagacaaatcattgcagacagtctgcaagcaaaacctcacgagatcatctttaacagtgggggaacagaaggggataatacagctatcttagaaacagcgttctcgcgtcaaaaagaaggcagacatctaatcactacagctatcgaacatcctgctgttcttaataccatgaaatatttagagacaaaggggtttgacgttacatatctgcctgtagatgaaaaagggaatctgtcgatcgaagaggtcaaaaaagcgttacgagaagatacgatcttggtctctgtgatgtacgggaacaatgaaatcggaaatttgatgccatatcaaagaaatcggtga

SEQ ID NO: 2321 - DNA (genomic), 774 bp, Enterococcus faecium; double-stranded, circular
  misc_feature (B) LOCATION 1...774
  hypothetical: NO
  anti-sense: NO
aatagtactagaatagaagtgtattctcaaaagaacaagggaggaaaaatcatgtcaggacatagtaaatggcataatatccaaggaagaaaaaatgcccaagatgcaaaacgagggaaagtctttcagaaactttctcgtgaaatttatatggcagctaaagcaggcggtcctgatccatctatgaatccagctttgcggcttgttgtggacaaagcaaaagctgcaaatatgcctaacgacaatgtggaacgggcgattaaaaaggctacgagtgccgtagatgaaacgaattacgatgaaatcacgtatgaaggatatggtccgggtggagtaggaatcttagtccatgcattgacagataaccgtaatcggacagcgacaaatgtccgagtagcttttactcgaaacggtggatcactgggagaaacgggttcagtcagttacttgtttgaccgcaaaggatatatcgctattgaacgcgatgggttgactgttgatgaagagacgatgtttgaggatgtattagaggcgggggcagaagatctgcaaacttctcctgaagtattcgagatttatactgcaccagaagattttgctgctgtacgagatgagttggaaaaagagttcactttggcgcaagcagaattgacgatgattccacaaacgacgattgatttaaatgaggaacaaaaagagcaattggaacgtctagtagataagctagaagacgatgatgatgtttcagaagtctttactgctgctgaaatgtaa

SEQ ID NO: 2322 - DNA (genomic), 774 bp, Enterococcus faecium; double-stranded, circular
  misc_feature (B) LOCATION 1...774
  hypothetical: NO
  anti-sense: NO
aagcggactagaattatgacttataaaaatattgtttttgaccttgatgacactctttatgaccatcaactcccctttaaacgtagcgttgagaaatgttttccaacgattgatatccaacaaatagataacatttacaaacgtttcagatgttggtctgatgttgcttttcctaaatacacgaaaaaactcatcagtattgagcagcttagaatttttcgctgtcagaagactatggaagaatttggcatcgatagtatttctaggacagaagctctagacttccaagctgactatgaatatgaactcgatcagattacgatgattcctgagatacatcaactactgctggctctacataaaaaccgcatcccaataggtattctaactaatggccctgttgacttacagagtcgaaaactccaaaatattggtgcctatcaatattttgaaaagcaaaatatcatcattagtcagtccactcacggaggagctgcagaaaatagctatgaaggtaatgtaaaaaacttacaaagttaccaaaatgtccaattatctaaaagggctatagaaattcttaaagaggaaattgagttaaatcaccaacatataagattcaatcctgattataaagataatggatggatttttacttccaaaagtcgtcataaacctggaatggcaacagtttttttgacaaattttataaggtgcagaacttctttccgtatgctattcccgattgtccttgacaatgagcctcctcggatgtga

SEQ ID NO: 2323 - DNA (genomic), 1011 bp, Enterococcus faecium; double-stranded, circular
  misc_feature (B) LOCATION 1...1011
  hypothetical: NO
  anti-sense: NO
gtagaagctagagttgtgaccaagaaagtggaggtccccatgtcaaaacattactttgacccaagattaaaaatttttgcgttaaattccaatcgcccattagcagagaaaattgcagcagcagtcggcgtcgagttaggaaaatcatctgttactcaatttagtgatggagaaattcaagtaaacattgaagaaagtattcgtggatcgcatgtctatgttattcaatcaacgagcagcccagtcaatgataacttgatggagttgctgatcatgattgacgcactgaaacgagcaagtgcaaaaacaatcaacgtagtcatgccttattatggctatgcgcgtcaagaccgtaaagcacgtgcacgggaaccaatcacagcgaaattagtagcaaacatgattcaaaaagctggtgcaacaagaatgctgactttggaccttcatgcagtccaaatccaaggtttctttgatattccagtcgatcatttgatgggtgcgccacttattgccaattatttcttagaaaaaggaatcaaaggcgatgatgttgtcgttgtttcaccagaccatggtggtgtcacacgggcacgtaaattagcggaatttttgaaatctccgattgcgatcatagacaaacgccgtccaaaagcaaatgttgcagaagtaatgaatatcattggacaagtcaaaggcaaaacttgtgtactgatcgatgatatgatcgatacagcaggtacgatcacattggctgccaatgctttgaaagaagctggtgcaactagtgtgtatgcttcatgtacacatccagtattatccggccctgctttacaaagaatagaagattcagctatcgagcgtctagttgttacagactcgatctatcttccagaagatcgtaaaatcgacaaaatcgatgaagtaagtgttggcggactaatgggagatgcaatcaaacgtatccatgaaaacaaaccagttagtccattgtttgaaacaaaaaataaataa

SEQ ID NO: 2324 - DNA (genomic), 612 bp, Enterococcus faecium; double-stranded, circular
  misc_feature (B) LOCATION 1...612
  hypothetical: NO
  anti-sense: NO
atgcaagagctgaagacccgcagtgcccggcaccatagacctaaaagaaaaatggtgatcaataaaaaagcgattgctcctttaattggaacgagtcttttagttgggccgatgatggttacagcggtaccgcaacatgttcatgcagatgaacaaggatctcaaacagtcgctgatcctcaagcgtttatcgatcaaatcggctggtctgcgtcagaagttgctgcaagtaatgacttgtatgcttcagtcatgatcgctcaagcgttgttggaaagtgcatatggcacttccggattagctagtgcgccaaattataatctattcggtgtgaaaggaagctataacggacaggtcgtttatatggcaaccaaagaatatgtaaacggacaatgggtaacgatgaatgagccattccgaaaatattcttcttattgggaatccttccaagaccatgcgaatgttcttcgttcaaccagtttttccacgggcgattatcattatgctggcgtgtggaaaagcaatacaacaagtttttatgatgcaacagcgtacttgacaggtcgttatgctaccgatccaaattatggtccaaatggatgtttcaccaga

SEQ ID NO: 2325 - DNA (genomic), 525 bp, Enterococcus faecium; double-stranded, circular
  misc_feature (B) LOCATION 1...525
  hypothetical: NO
  anti-sense: NO
aaatattatagaatcaacactcagagaacgggttggtttttaatagatttaataagtactgataatgaaatttctcctggttgggaaaacgaagttggttaccctgtagaagaattttttcaagattactttgcggagtatgccgataggataatgagagattacgtaacagataaaactcaagaagtcatcaatcaatcccagtcattaaatgaattatctgataaggcgaaagaagaagcagttgccattatttcttcagggattagtgactatattgatatgagtggtgaaatcaattatggcgataaagacaaaattgtacgcatgataaaagcttttatcaaaacttttgatgtgaaggcagatcttaagtttaatgatacttacctagtaggaaaattaattaatatccttgggacagagaaagatacggaaacgtttatttcctctttgtctatgttgtttacagataagcatttttcaactcagcttggtggagaggaactagtggaaatcttttaa

SEQ ID NO: 2326 - DNA (genomic), 684 bp, Enterococcus faecium; double-stranded, circular
  misc_feature (B) LOCATION 1...684
  hypothetical: NO
  anti-sense: NO
ttagattatagtttggcagaaagcggcgggtgtacaatggttattttttatttcattcttattctgataattatagggatcagttaccattttctttcttatttttatgcaaagaaattagtaagagcgggagtacagagaggatatgactggtatgaagacactggtcatcgtttgatggaccctgctgcagtcacgtcagtagaaaaaaaacgacaaaaattagaagaagagtgtgaaagcttttgggagcagggaacacccaaaacaatcaaaagttatgacgggttgaaactagctggtcagatgttcatccatccaaataagcagaataaatgggtcatttgcgtacatgattaccgaagcacagggaaaagagacatgtctcatataggtaaaagatatgcagagaaaggattcaacgttcttgtacctgatttacgtgcgcacggagaaagtgaaggagaaatcatcggaatgggatggctagatcggctagatttaattacctggatccacctcatcttagatgaacagccgattgcgttcattattttacacggcggatcaatggaagctcctccgatcatgatggcaattggtgaaaaactcccatcaccggtcaaaggatttattttaaacaccggattttttcctgtttatccaaaatcccaattttgttga

SEQ ID NO: 2327 - DNA (genomic), 900 bp, Enterococcus faecium; double-stranded, circular
  misc_feature (B) LOCATION 1...900
  hypothetical: NO
  anti-sense: NO
ttaatctatagaagggagagctcagtgatgatttatggttcaatcgaagcaggcggcacaaaatttgtgtgtgccattggcgatgaagaaatgacgatcaaggaaagagtgagctttccgacaacgacacctgaggaaacaatacctttagtcattgacttcttcaaacaataccaagcagatttagcagggattgggattggctcatttgggcctatcgatatccatcgcgattccgccacttatgggtacattacctcgaccccgaaagtggcatggcaaaattttgatttcatcggtaccatgaaaaaagaatttccgatcccgatttcttggacaacagatgtcaatgcggctgcctatggtgagtatgtcttcggcagtggcaaaggattgagcagtgtcgtttactatacgatcggtacgggtgttggcggcggtgccttacaagaagggcgctttatcgaagggtttagtcatccagaaatggggcatatgctcgtcgtccctcatccaaaagatgactttgctggcagctgtccatttcatggcaactgtttagaagggatggccgctggacccgccatcgaaaaacgcttagggaaaaaaggacaagaggttgcagaagatgatccttattgggaaatcgaagcctcctatattgctcaatgtgcctacaatacaaccttgatgttttctccagatgtgatcatttttggcggtggtgtgatgaaacaacgccatatgctgcaaaacgtccacgacgcatttgcaaaattggtcaatgggtatgtcgaaacacctgagttaagcaaatatatcgtgaccccagcattagaagacaacgctggaacgctcggttgtttggcattggctcgagaagcggtcttacattcataa

SEQ ID NO: 2328 - DNA (genomic), 1533 bp, Enterococcus faecium; double-stranded, circular
  misc_feature (B) LOCATION 1...1533
  hypothetical: NO
  anti-sense: NO
caaccatataggaggattcatttgaaatttaaagaactagaattatcaccagaattgttgaaatcagtcgaacgcgctggttttgaagaagcaacgcctatccaagcagaaacgattccactagcattagctggaaaagacgttattggacaagcacagacaggtacagggaaaacagctgcatttggattaccaatgttagaaaaaatcgatccagatcgtcacgaattacaaggtttagttatcgcaccaacacgtgaattagctatccaaacacaagaagaattatatcgtttagggcgcgacaaaaaagtacgtgtacaagccgtttacggcggagcagatattggccgtcagatccgtggcttgaaagatcgtccacatatcgttgtgggtacaccaggacgtatgcttgaccacattaaccgccacacattgaaacttggaaccgttcaaacattagttttggatgaagcagatgaaatgttgaatatgggcttcttggaagatatcgaaaaaatcatttcacaagttcctgatcaaagacaaacattacttttctcagcaacgatgccgccagctatcaagaatattggcgttaaattcatgaaaaatccacatcatgtgaagatcaaagcgaaagaaatgacagctgacttgatcgatcaatactatgtccgcgcaaaagaatacgaaaaattcgatatcatgactcgcttgtttgatgttcaaacacctgaattaacaatcgtcttcggacgtacaaaacgccgtgtagacgaattggcacgcggattagaagcacgcggttaccgtgcagaaggaatccatggcgatttgtctcaacaaaaacgaatgagcgtattgcgttcatttaagagcggtcatttagatatccttgtagcgacagacgttgctgcacgtggattagatatttcaggtgtcactcatgtgtacaactatgatatccctcaagatccagaaagctacgttcaccgtatcggacgtacaggccgtgccggaaaaggcggtatgtctgtgactttcgttacaccaaatgaaatggactacttgcatgtgattgaaaacttgacgaaaaaacggatgacgactttacgtccaccaaccgaaaaagaagcattcaaaggtcaattaggtgctgcagttgaacaaatcgaaacaaaacttgcagaaaatggtctagataaatacctgcaaacagcagataaattattagaagaatattctgcacaagatttagttgcacttttgctaaaaacgacagcaaaagatccagctgatgcagtgccagtgaagatcacaccagaacgcccattgccaatgcagaaaaaaggatacaataaaaatggcaaacgtggtggcggaaacaaccgtaatcgtcgtgacggcggtaattatcgtggaaacaaatcaaaaggcggttatagcaaaaataataacagccaaaaagatggcggtaaacgtcacaatgataaaaaacgcggatttgtaatccgttcaaataacgattaa

SEQ ID NO: 2329 - DNA (genomic), 261 bp, Enterococcus faecium; double-stranded, circular
  misc_feature (B) LOCATION 1...261
  hypothetical: NO
  anti-sense: NO
gaatggtatagagggtggcgaaatatgaaaaaaatgaaaaagtataaaattagaaaatctggcaatagcgatgtaacaactatcccaccagaagtaaaagaattcatgggtgtgcagacaggtgacgcaatcagttatgtttttcaatctgatggttctgtacgaatgatcaaagcacaagaagaacctgatattgattcattagttgattcgatcatgaatcaatatgaagacgcgttaaaagatttggttgatttatga

SEQ ID NO: 2330 - DNA (genomic), 666 bp, Enterococcus faecium; double-stranded, circular
  misc_feature (B) LOCATION 1...666
  hypothetical: NO
  anti-sense: NO
ttatttcatagaaagcgaagtgatttatccatgtttacaggaataatagaagaaatcggtaaagtagaaagaatacagaaagatacttgtaactgtaaactatccattaaagcttcaaaaatattagaggatatacatttaggcgacagcatagcagtcaatggtatctgccttacagttacttgtttcactcgacaatcttttacagttgatgtgatgaatgaaacatggaacagaacggctcttagcctgttaagacatggaagccttgtgaatttagaaagagctatgcctatgaatggcaggttgggcggtcacattgttacggggcatattgatgggacaggcagaatatcgtctgtgcgtagagacaaaaatgcggtgtggtatcaaatcaatacgcaaagagaaatcttaaatctaattgttgaaaaaggttcgattgctattgacggtattagtcttactgtcgcaaaagtatcgaaagcagatttttcggtatccgttatccctcatactttggagcaaacaattctcaagaataaacaagtcggggatatggtaaaccttgaaaatgatatattagggaaatatgtgcagaaactcatagacaacagcaatgaaacagagttgtcgaaagagttgttatgccgatacggattttag

SEQ ID NO: 2331 - DNA (genomic), 2586 bp, Enterococcus faecium; double-stranded, circular
  misc_feature (B) LOCATION 1...2586
  hypothetical: NO
  anti-sense: NO
agtctacatagtctggataatacacagaaggaaaaggagattacacaacgcatggccaatttgattcgttcacttatcgaaaacgataagaaagaactaaaacgtttagatagcattgcaaaaaaagttgaagcatacgctgaccaaatggcagcattaactgatgaacaattacaggcaaaaactgctgaattcaatggcagataccaaaaaagagaaacattaaatcaattacttccggaagcttttgcagtcgtccgagaaagcacaaaacgtgtattggggttatatccacaccacgttacaatgaagggtggaatcgggcttcacgatggaaatatccctgaaatgggtactggggaaggtaaaaccttgaccggaacgatgccagtatatctaaatgctctgactggcgaaggggtacacgtagttaccgtcaatgaatatttagcaacccgtgactcgacggaaatgggcgaactttataatttcttaggattaacagtggggttgaatatcaactcaaaatcttcggatgaaaaacgcgaggcttataattgtgatatcacttatagtacgaataatgaattaggatttgactacttgagagacaatatggtcgtttaccgccatcaaatggtacaacgtccgctgaattatgccattgtcgatgaagttgactcaatcttgattgatgaagcgagaacgccgctgatcatttcagggcaagcagaaaaatccacagctttatatacaagagcagacaacttcgtgaaacgtttgaaagaagaagaagattataaaatcgatgtacaatcaaaaacaatcagtttaaccgaagcagggatcgaaaaagcagaagaaacattcggtttggataacttatacgacattgaaaatactgcattgacccatcacttggatcaagcattgagagccaactatatcatgcttttagatatcgattatgttgtccaagacggaaaagtactgattgttgaccagttcactggtcggatcatggatggacgccgttattcagatggacttcaccaagcaatcgaagctaaagaaggcgtagagatcgaagacgaaacgaaaaccatggcgacgatcactttccagaactatttccgtatgtacaagaaacttgcgggaatgactggtacagctaaaacagaagaagaagaattcagagaaatttataacatccaagtataccagattccgacaaatcgtccggttatccgtgatgatcgtccagatttgctttacccaacattacaaagcaagttccacgctgtcgtgcaagatatcaaagatcgctaccgcaaaggtcaacctgtgttagtcggaactgttgcggttgaaacatctgagttattatcagatatgctgaatcaagaacgtattcctcatgaagtgctgaatgcgaaaaatcactttaaagaagcagagatcatcatgaatgctggtcaaaaaggtgctgtgacgattgctaccaacatggctggtcggggaacagatatcaagttaggacttggggtaagagaacttggtggtctagcagttatcgggacagaacgacatgaatctcgtcgtatcgataaccagcttcgaggacgtgcaggacgtcaaggagaccctggtatgtcacagttctacttgtcattggaagatgatttgatgaaacgattcggttcagaacgaatcaaatctttcttagatcggatgaagatcggtgaggaagatgctgttatccaaagcaagatgctgacgaaacaagtagaatctgcacaaaaacgtgtagaaggaaataactatgacacacgtaaaaacgtcttacaatacgatgatgtgatgcgtgaacaacgtgaagtaatctataaacagcgacaagaagtaatcatggaagaaaaaagcttatccaagccactaatgaacatggtcaaacggacaatcagtcgtgtagtagatgcgcatacacaattagagaaagaaaattggaatttggaaagtatcatcgattttgccggcagtactcttgtccatgaagatagtattactcttgcagatatcgaaggaaaaacagctcaggagatcaaagagtatctaaacgaacgagcacaagaagtatttaataccaaagcggctcaactaaatggtccagagcaactgttggaatttgaaaaagtcgtgatcttgcgtgttgtggactctaaatggacagaccatattgatgcaatggatcaattacgtcagtcaatcggcttacgtgcttatggacagaacaatccattagtcgaatatcaaacagaaggctataagatgtttgaagatatggtaggcgccatcgagtatgaagtcactcgaatctttatgaaagctgagatccgtcaaaacgtacagcgtgaacaggtttctcaaggaacagcttctcactcagaagacggagatgccaaagaaaatagtaatactagcgcgaaaaaacagccaatccatgtgaacaaggtcggaagaaatgatccttgtccttgtggaagcgggaaaaaatataagaactgtcatggaaaaaatgcaaactaa

SEQ ID NO: 2332 - DNA (genomic), 600 bp, Enterococcus faecium; double-stranded, circular
  misc_feature (B) LOCATION 1...600
  hypothetical: NO
  anti-sense: NO
tatccgcatagacccggcanagtcacatttgncaggcaaggagtcttgcgtcctaaactgatgctcgtgggagaagccccagggaaaacagagattgatacgcatgttccttttagcggtcaagctggaaaagaattgatgcaggcactttcttcaactggcttaacacgagaagaggtgtatatcaccagtgctgtaaggagccgcccgtatcgcgtgactcatcggatcaataaacggacacaacagtcagaaactgtttatccaaatcggacacctactcgttccgaagtatttgcgcatgcaccaatattggattacgaactgatgaaggtccagccaaaattaattgcgacacttggaaacattggtcttcaacgtttacttggcaaagaatatacggttaccaaaaatcatggtcaactctatacagggcctgtcttacaattaacagaacaaaaggatgcctacgaatggtcagaaaaaaactatcgaattcttccactttttcatccagcagctattttctacaatcgctcccttgtacctgttatccatcaagactggcaagtactagcttcacttttacagcaagattaa

SEQ ID NO: 2333 - DNA (genomic), 246 bp, Enterococcus faecium; double-stranded, circular
  misc_feature (B) LOCATION 1...246
  hypothetical: NO
  anti-sense: NO
cacttaaataggaggtatatgatgaggaaatggctaattgaaaaaagagagcaacaaaatctaactcaagaaaaagtagctaaaagatcaggaattcagcgttcttattatagtatgattgagagtggcaagagaagtcctagtccatttgtagctatgaaaattgctaccgttttatcctttgattggactattttttttaatcaacaaagtaacaaagtgacacatggagaggtgatcaaatga

SEQ ID NO: 2334 - DNA (genomic), 579 bp, Enterococcus faecium; double-stranded, circular
  misc_feature (B) LOCATION 1...579
  hypothetical: NO
  anti-sense: NO
acaaaaaatagcataggagaaaaagagatgattgaaaaagaattagtgaccacacaaacagaagtttggcgagatcctcatcatacccatcgctatgttttcaaacgacaatgggcgatcaaaggaaaagaagcggaagataaattagcagtagtcattactattcgtccaacagatacagaaccatttacgaatgatttgagtatgttattaatcgaaaagaatatccgacaattaggatttactggttttattgctgtgaatcttttttcgtacacaaaagcgaaaagtcctcgggtatttcttcgaggaaatgatgaacaatctttggaaatattaacgactgtttttacagaaaagaaaatcaataccattatttttgcttgtggttcgattacagcgacgagtcaagtggcttatgaacaagcaaagactatttacgatcaattgagtgcgaaacaaaagaagatgaccaaagtattgataaatgcagaaggtaagttatcccacccactaagtattcatgttcgtaatgaatggcaattggcagatagtcaattattatttcaagaaaaataa

SEQ ID NO: 2335 - DNA (genomic), 1989 bp, Enterococcus faecium; double-stranded, circular
  misc_feature (B) LOCATION 1...1989
  hypothetical: NO
  anti-sense: NO
ttgaaaaatagttttttatttgaggagaattcacaaagtagaaaagaggattccatgatattattacaagccaatcagattgctcgccattttggtgcagaagtcttatttgaaaacatacatttagaaatcagtacaggcgctcgtgtcgctttagttggcagaaatggcgctggaaaatcgactttattaaagatcattgctggaattgaagcacctgatgaaggaaagatcgctaaaaataaaacagcgactctcggatacctcgctcaggacacaggacttgattccaatgaaacagtttggaacgagatgctgaaagcttttgaacaagttagacaaatggaagagcggatgcgcgagctagagattttcattagcgaaggtacgccagacacacctgcttatagttcttatttaaaagaatacgaccggctgcaacacgatttttcagatcgaaacggctatggttatgaaaatgaaattcgttccgtattgcatgggtttaaattcgattcttcattttatgatcagaaaatcgatactttatcaggcggacagcgcacacgtttagctttagctcgcatgcttttgcaacaccctgacattttgattctagatgaaccaacgaaccatttagatatcgagacactttcctggcttgagaattatctgcaaagctatactggtgcattattgattgtttcccatgaccgttattttttagataaagtagtcaatgaagtctatgaattaagcagaagaaaaatgcgccattacaaaggtaactattcgaaatatctagatttgaaagcagaacagttagcaagtgaatggaaggcttatgaaaagcagcaaacagaaatccataaattagaagacttcgttgctcggaaccttgttcgcgcctctaccacaaaacgagcgcaaagccgcagaaagacattagaaaaaatggaccggctggatcgtcctcaaggggatgaaaaacaagcaaactttctattcagtatagaaaagccttctggaaatgtagtcttgcaaatcgaagatgccgctatcggatatgataatgtcaccttatctgaaccaatcaatctagatatccgtcgtcaagaagcgattgctctagtaggtccgaatggtatcgggaaatcgacgttgctgaaatcaatcattcaccagatcccttttatccgtggaaaagaaacgctagggacaaatgtcaccatcggctattacgatcaaggtcaagctgatctgcatacaaacaagacgatcctagcagaattgtgggatgagcatcctaccactccagaaaaagagatccgaagtgctttaggtgctttcttattttctggcgaagatgtagaaaaaccaatccctctgctaagtggcggtgaaaaagcacgggttgctttagccaagttagcgatgaacaaagaaaattttttgattttggatgaaccaacaaaccatttagatattgacaacaaagaagtattagaaaatgcattgatcgattatgacggcacactgctttttgtttcccatgaccgatatttcatcaatcggatcgcgacaaaagtcgtcgaactctctgaaaatggcagcaaagtctatctaggagactatgattattatttagagaaaaagcaggaagaagaagaaatcgccgaattgttggcacaagatgagccagaatctgctcctgctcccacgaacaaatctgattattaccaaagcaaagaacagcaaaagcttatccgtagccttcaacgaaaaattactcaggttgaagaagaaatggcgcggatcgatgaatggatcgatcagttggaacaagaaatggtcgcgccagaaaacctggaagatcacgtaaaactcaatgagctgaaccaagatttagaagctgctagacaagatcaagaaacaaaattgacggaatgggaagaactaagcttggaattagaagaatatgaaaattaa

SEQ ID NO: 2336 - DNA (genomic), 282 bp, Enterococcus faecium; double-stranded, circular
  misc_feature (B) LOCATION 1...282
  hypothetical: NO
  anti-sense: NO
ctaacgaatagtgacatattaatttatataacaaaggagaaaaggaaaatggaagaacaaattttatcaatcttagaagaaataacaggaacagatgaagtaagaaaaaatcgtgatattgatctatttgatgaagggttgcttgattctttagcatctgtgcaattattagtcgagctagacggagagctggatatccaagtccctgtatctgaattcgagcgagaggattggagcacaccgaataaaatcattcaacaagcaactgcattgaagggttga

SEQ ID NO: 2337 - DNA (genomic), 402 bp, Enterococcus faecium; double-stranded, circular
  misc_feature (B) LOCATION 1...402
  hypothetical: NO
  anti-sense: NO
acgaagaataggagtgctcatatgaaccttacaacgatccatcatatagccatcattgtttcagattatcagaaatcacgtgatttttatgttaataaattaggatttgaagtaatcagagaaaattaccgcaaagaacgagatgactataaattagatctgaaactaggaagtgctgaattggagatttttggaattgctaatgcgccacaacgaccaaactatccagaagcttgtggcttgcgtcatcttgctttcaaagtagacgatattgaagaaacaattgcagaattgcagtccttagggatcgaatcagaaccgattagagaagatacctttacaggaaaaaaaatgacgtttttctttgatccagacggattgccattagaactgcacgaataa

SEQ ID NO: 2338 - DNA (genomic), 2160 bp, Enterococcus faecium; double-stranded, circular
  misc_feature (B) LOCATION 1...2160
  hypothetical: NO
  anti-sense: NO
aggaggaataggatggaagaatacaagcagacaatagaagaagtaaagaaggtaacagaagcagatccagatactgggttgtcttcacaagaagtggatgaacggcgaaaaaagcagggattgaataaattcgatgaggcgccgaaagaatcgatgatcaaaaaattctttcgaagcttgtccgattttacaacgatcatccttcttgtagcagcggtgatttccttttataccgcatttgctacagaacatggggatttatttgaaggactgctgatcatcgctatcgttgtgatcaactcggtattggcgattgtccaagaaggaaacgcagaaaaagcactggaatccttgcaagatatgaataaacaaacggcaactgtcatacgagacggcaaagtgaccactgttgagtcagagcaactggtagtgggtgatattcttgttttagagtccggtgatgctatttctgccgatgcccgtttgatcgaagcatcacaattacgtgtagaagaatcggcgttgactggagaaagtgaagcagttgaaaaagatgcagcatttattgctgaagaagatgagtcattaggtgaccaacttaatatggtatttaaaggatgtacggttgctgcaggtcgtgggaaagcgatcgtcactgccattggcatggctacagaaatgggtaagatcgcggatcttttgaacgaaaatactatgcaaaaaacacctttacaggtccgattgaatcagctaggcaaacgaatcagtatgatcgctttagcggctgcggctttagtatttgtgattggtgaactgcaaggagaaccactccttgagatgttcatgacttcgatttccttggctgttgcagctgtaccggaaaccttgactgttattgttacgttgacacttgcatacggtgtgcagaagatggcgaggaaacatgcgatcatccgacagttgccagcagttgaaacgctaggaaccgctaatgttatctgctcagacaaaacaggaacgctgacacaaaatgaaatgcgcgtccgccgggtatggagcaaagaagatgaagtaacgaatatcgaagattcaatgacgaacagcgcgatggaaatattgaaaatggctgcactatgtacagatgtgacggtcgagcaagaagatgacgaccttgttatcaaaggtaatccaacagaagtagccatcgtaagggctgttgaagagaattatcatacaaaggcagaattagaagaaaaatatccacgagtaaacgagcttccttttgattctgaacgaaaaatgatgacaacagttcaccaaatgggcgaaaaatacatctcaatcaccaaaggagcattcgatgttcttgctccgcgctttagttcaggcgatgtagaacaagcggcgatcgttaatgatcgctttggtaaacgggcactgagagtgattgctgttggttatgctacttatgacgaagaaccgcaagatatttcttctgaagcactggaaaaagacttacgtttgattggtctgatcggaatgatcgatccaccacgtccagaaagtaaaggagcaatcaagcgagcgaaaaaggctggcatcaaaacagtcatgatcactggagatcatgtggtgactgccagtgccatagcgaaagaattaggtatcttgaatgatccgtcagaagcactttcaggatcagaactgcatcaattatcagacgaagaattagatgcgcgtgtcaaagctctctctgtctatgctcgggtaacgccagaagacaagatccggatcgtcaaatcttggcaacgtacgggtgcagtcgtagcgatgactggggatggtgtgaatgatgcaccagcgttgaaagcaagtaacgttgggtgtgccatggggatcacaggaacagatgtggcgcaaagtgccgcagatatgattttgacggatgacaactttgcgacgatcgtaaacgctgtcagtcaaggacgttcggtttatcaaaatattcgtaaagctatcaactttttgctaagctgtaatatttcggagatctttattgttttgattgcgatgctgttaggatggggagcaccatttacagctgtgcaactactgtttgtcaatgtagttgctgatggacttccaggatttgctttatga

SEQ ID NO: 2339 - DNA (genomic), 237 bp, Enterococcus faecium; double-stranded, circular
  misc_feature (B) LOCATION 1...237
  hypothetical: NO
  anti-sense: NO
cgatatgatagcgttaatgaaatcaataaaataataacaaaagcggcaatgggtagcgaataccagatggctgcagcagacaaagcgactaaaacgacaacgatttgttccgtaccatatgcaatagatgataacgcatcagacgacaataatgccaaagcagcaaatcgggttaatttgtgctcatcattttcagcagattttaaaggcttacctactaacaacctttttaagtaa

SEQ ID NO: 2340 - DNA (genomic), 1521 bp, Enterococcus faecium; double-stranded, circular
  misc_feature (B) LOCATION 1...1521
  hypothetical: NO
  anti-sense: NO
aacgatgataggtatattggccatgctggttttagcaggtatgttaactgcttgcggggcaagtgggaaagccgagggaacagtaaagaaaaattgagcgtgatgacgaccttttatcccatgtatgattttacaaaagcaatcgtcggggatgaaggagaagtagagttattgattccagcagggactgattcccacgattatgaaccttctgctaaagacatggcaaagatccaagatacagatatctttgtttataatgatgaaaacatggaaacatgggtccccgcaatccaaaaaacattacaagaaggcaatgtccatacgataaaagcgacagaaggtatgcttttacttccgggaagtgaagaaggacatgatcatgaccatgaacacggggaagaaggccatacacatgagctagacccacatgtatggctagctccaagtttagcaatcaagcaggtagcaaacatacgtgatcagctgattgaagcttacccagaaaaacaggaagtatggacaaaaaatgcagcagcctataccgagaaacttcaagcactccatcagctttatcaagaaacctttaagcaagcaaaacaaagatcttttgtcacgcaacatgctgcattcaactatctagcgttagaatatggattgaatcaagtatcgattgctggtctttcttctagtgaagaaccgtctgcggcgagaattgctgaactgaaacactttgttaaagaacatggaatcaactatatttattttgaagaaaacgccaaagatagtattgccagaacgttagcaaacgaagcaggtgtatctttagaagtattgaatcctttggaaggattgacgaatgaacaaatagaaaatggagaaaactatctttctatcatggaagcaaacctcgaagcgttgaaaaaaacgacagagacagaaaacccgctagaagatactttgacccccaaaaaagaaaagagcgtctacaacggttattttgaagacgaggatgtacaagatcgctctctttcagattgggcaggaacttggcaaacagtagatacgtatgtagaagatgggacttttgatcctgtttttgaatataaagaaaaattgaatcaggataagacagcacaagaatataaagaatattatacgaagggctatcaaacagatattgcttcaatcaagatcagtgagaaagagatggcatttacgtttaagaatggaacaacgaaacgttcaaattatcgttatgtagggaaagaaatcttgacctacgaggcaggaaaccgtggcgtaaggtatctattcgaagcagaagataaggaaagtggcgcttttagatatattcaattcagtgatcacacgattgcaccggctgactccgaacattttcatttatatgcaggaaatgaaagtcaagaagtattgctgaaagaaatggagaattggccaacattttatccagatacaatggatggacgtgaaattgcacaggaaatgcttttgcactga

SEQ ID NO: 2341 - DNA (genomic), 921 bp, Enterococcus faecium; double-stranded, circular
  misc_feature (B) LOCATION 1...921
  hypothetical: NO
  anti-sense: NO
gttgcagatagcggacgtgggatgcctgtaggaatgcatgcttccggaataccaacagttgaagtgatttttactgtgctgcatgctggcggaaagtttggtcaaggagggtacaaaacttatggtggactgcacggtgtaggagccagtgtggtaaatgccttatcgaaatggctaattgtaacgatcgttagagatggagtagagtatcagcagaaatttaaaaacggcggtaaacctgacggtactttgaaaaagataggaaaaacaaaaaaagcaaacgggacgactgtccattttttaccagatgatacaatattcagtacaacgaaattttcatatgaaattttagccgaacggttaagagaatctgcctttcttctaaaaggcgttaaaatctctctttctgatcttcgtggagaagaaccagtcaaggaaatttttcattacgaagaaggaatcaaagaatttgttgattatctgaatgaagaaaaagatacattgacaccagttgtttatttttcaggagaaaaagaaggtatcgaagtagaggtcgcttatcaatacaatgacggttattcagaaaatgttttatcttttgtcaataacgttcggacaaaagatgggggaacccatgaagctggtatgaaagcggcgatgacgaaatcttataatgaatatgcgagaaaagttggtttgctgaaagaacgggacaagaatctggaaggtagtgatttcagagaacggttagctgctgtactttctatccgtgtacctgaaaatcttctgcaatttgaagggcaaacaaaagaaaaacttggtacgccagttgctcgtaccgtagtaaataacgtcatcagtgaacaaatgggcttttatttgcacgaaaatagcgaaatgagccagatgttggtccgttaa

SEQ ID NO: 2342 - DNA (genomic), 321 bp, Enterococcus faecium; double-stranded, circular
  misc_feature (B) LOCATION 1...321
  hypothetical: NO
  anti-sense: NO
aggagatgtagtcttatgatgttaaaaccttcaattgactcactattagatcgtgtaaattcaaaatattctctagtgattttagcaagtaaacgcgcgcatgaattggatgcaagtgcacagcctactctagattcttttgattcagtaaaaagcgtcggtcaagctttagaagaaatcgatgcaggaaatgtagtcaatgatccacatcctgaattaaaacgtgaacgtttgaagatggaagaagaggaacgtcaagcacaaaaagagcgtgaacaacacgaattggaatcacgtatccgtgaagagcaaaaaatgtaa

SEQ ID NO: 2343 - DNA (genomic), 555 bp, Enterococcus faecium; double-stranded, circular
  misc_feature (B) LOCATION 1...555
  hypothetical: NO
  anti-sense: NO
aaggtgtgtagaatgttattgaaagtagctataaaatgctattgtgtaaaaaataaaggaggaataatttatgaaaaaatagtaccaagaggagcatgcctattacttgcattatgtttgagcttaagcgcagttgggtgtcaaaaaagtaatgaaaacaataaaataaaagaaggacaatccataagttctgaagaggaaggcatgtcaattaatgcaaatggcaaaaatgaaacttttaagccatcagattatacattggaggcaaagaaagaatatgtttatgaatatttagggcttaaatttaaactctcagacaaatttagaaattatatagctgataaaaagatagcgatgttagatgatcaaagtcctatagataaagaactaaagtatgctattttgacatttgagaaaatgacagaagaacaaaagaatgcagttatagaaaagatgggcgatggatataaaaattggcaaaatgagcttgaaagaattgggactattggtatatttgaaaaaaatacatcagaagaaaaaaatctaaaattataa

SEQ ID NO: 2344 - DNA (genomic), 1014 bp, Enterococcus faecium; double-stranded, circular
  misc_feature (B) LOCATION 1...1014
  hypothetical: NO
  anti-sense: NO
gagagtattttaggaggaataaagatgaataataaagatcttgtcgcaaaagctgtctatgacgttgtcaaagacgatttgacacttgaacaagtcgaacaattactagaaaatccaaaatcagccgaacacggggatgtggcatttccagccttttcattagcaaaagtttaccgaaaagcgccacagcaaatcgctgcagatttagcagaaaaaatcgactctgccaactttgaaaaaatcgaagtggttggaccttacttgaactttttcatgaataaagaacttatcagcaaaaaagttttgcaaacagtagtgaaagaaaaagaacattatggggatagcaatattgggaatcaaggaacagtaccaatcgacatgtcttctcctaatattgccaaaccaatctcaatgggacatttgcgttcgacagttatcggtaattcgatcggtttcattatggaaaaaatcggttatcagccaatccgcatcaaccatttaggtgactggggaacacagtttggaaaactgatcgtcgcttacaaaaaatggggtacagaagaagctgttaaagcagaaccaatcaatgaattgcttcgtttatacgtccaattccatgaagtagctgaaacagaaccagaattaaatgaagaagctcgtgcttggttcaaacgtctggaagaaggcgataaagaggctattcaattatggcaatggttccgtgatgaatcgatgaaagaattcaataaaatctatgatctgctggaagtacgtttcgattcgttgaacggtgaagctttctacaatgacaagatggatgaaatcgtcaaacttttagaagaaaaacatttgctgaacgaggataaaggtgcagagatcgttgacctatctgcttatgacctgaatccagcgttgattaagaagtcagacggtgcgacactatacattacacgtgacttagctgctgcattgtaccgtaaacgtacttacgacttcaacaatctctatatgtag

SEQ ID NO: 2345 - DNA (genomic), 747 bp, Enterococcus faecium; double-stranded, circular
  misc_feature (B) LOCATION 1...747
  hypothetical: NO
  anti-sense: NO
ttaattagtagtaataagaaaggaaacagcatgcgtttagataaattaatagaagaaaaattagaaacgacacgcaaggaaatgaagcggctgtttgctttgaagcaagtgatgatagatggcacagtcgaatttcgacaaaatcgaaatgtagatagtttactgcatcaaatcgaagtagcaggtgaacacttagaaacaaatgagtcctattatcttctcaataaacctgaaaaagctgttacagctgtatcagatccagaaaagacgacagtaatcgatctgattgcaagtgccgatcgtttccaaccattatatccagtgggaagactagatagagatacaacaggactattgctgatcacttcgaatggacaattgggatatgaaatgctacttccagaaaaaaaggtttcaaagacttatcaagtagttgtgaacgaaagggtgacaccggcagacgtaacagcatttgaaaatggaatcgtattcgctgatgggtatcaatgtaagccggctgatttaaaaatactcaaagcagacaagcaccaaagtacggttttattgacgatccaagaaggaaaattccatcaagtcaaaaagatgttcttagcccaaggaaagaaagtgaccgcattgaaacggctaagcatgggaccattggaattagatgaacagctaggagtaggcgagtatcgatcgttgacattagcagagatgaaaaagttaagtatttattttaaatag

SEQ ID NO: 2346 - DNA (genomic), 465 bp, Enterococcus faecium; double-stranded, circular
  misc_feature (B) LOCATION 1...465
  hypothetical: NO
  anti-sense: NO
aaatatagtaggaaacgaggtgctgttatggaaagaacacttgttattatcaagccagacggcgtgagacgccatttagtcggaagcatcatccaacgttttgaagcaaagggactggccattgctgaaatgaagtttgaaactatgactcctgaattagcaaaagaacattatcagcacttgactgagcgcagtttttttgatgaactgatcgattacatgacttccggtcctgtcgtttatcttgtgctggtcggcgaggaagtgatcgatatcgtccgtaagatggttggagcaacaaaagctgccgatgctgttccaggtacgatccgaggagactacgcgctgccggggactgaaaacatcattcacgcttctgattcccgtgatgctgcggtaaaagagatcgcccgctttttcccgccattcgatataaacaaaccgtctgaaaaagcggcgaagtga

SEQ ID NO: 2347 - DNA (genomic), 417 bp, Enterococcus faecium; double-stranded, circular
  misc_feature (B) LOCATION 1...417
  hypothetical: NO
  anti-sense: NO
aagaggagtagaatgatggcagaattaaagaaaatgcaagattacgaatatgatttacctgaattggtggatcagccggaacaacaaatgcctgattcttcttcgaatcaagaaatcattcttccacaatcaccggcaaaacgattaaagcagatttctgctttggaaaaaattgctgtggcaagcgtggcgattgctattgttgctttatgtgttttaacagttatgctgcgcacaaatatcagcggagctgaaaaagaaatcacgtcaatacaaacagaaatcaatgataaaaagcaagaaaaaacgagtttagaacaagaaaaaaacgaactttctcgtactgaacggattaaacaaatcgcagaagaaaaaggattgtctattaatgacgacaatttaaggaaagtgaagtaa

SEQ ID NO: 2348 - DNA (genomic), 1164 bp, Enterococcus faecium; double-stranded, circular
  misc_feature (B) LOCATION 1...1164
  hypothetical: NO
  anti-sense: NO
aaaggcggtaggaaaatgaaaaaaattattgcaatcacatcctgtccagttggtattgcccatacatacatggcagcagaaaacttagagaaagcggggaaagcagttggcgccgaggtaaaagtcgaaacacatggttccatcggtattgaaaatgaattgactgcaagagatatcgaagaagcagctggtgtaatcatcgcagcagatactaaaatagataaatcacgattcggcggtaaacctttgataaccgtaggtgtgcaagaaggaatccaccatgcagatgagttggtgagagatattttagcaggaaaagcgccagtctataaaagtacggaggcaattatttcttccgaaaataaaagtgaatcagaaaatttaggtaaaaaaatctataagagtttgatgaatggcgtttcgtacatggtacctttcgtagttacaggagggttattgatcgcgatttctttaacattaggaggaacagctacacctgaagggatcaagataccagaaggaacgatttgggcaacgatgaatagtatcggaagtatcgctatggggttgatggttccaattctatctgcatttattgcgcaaagtattgcagatcgtccaggacttgttcctggatttgttggtgggatgttagcggcaaacggagcattatatggtagtgatgcgaatgcgggattcttaggcgggatcatcactggatttttagcaggattcattgctttaggaatcaagaaagtgcgagtaccgaaagctttacaatcgatcatgccaattattgttatcccaattttaggatcattggcagttggttttgtgtttatctatgttattggagaaccagtagctcttctatttagttcattgactcactttttagcagggatgcaaggaggaagtgaaattgttctagctatgatcttaggagcgatgattgcttttgatatgggggggccgttcaataaagtagcctttttgttcggatctggcttgattgcagaaggcaattattccattatggggccaattgctgtagctatctgtatccctccattagcattggggctggcatcattgattttaaaaaccaaatttacgaaaacagaacgagaagctggtaaggcgtccttagcaatgggactgtaa

SEQ ID NO: 2349 - DNA (genomic), 306 bp, Enterococcus faecium; double-stranded, circular
  misc_feature (B) LOCATION 1...306
  hypothetical: NO
  anti-sense: NO
caaggaggtagaaagatgaaagtgattaaatatttgattggactggcggcgattagtggtattttgctatttggactgaaatattatactgaaggaagttatggagaaatccctggtatacttgatcagctaaatccattagttgaaaaaggagaggtctatgtaaagacacaaaaaccagaggaagtaaatgaatatggtacagcaaggtatgtgcagaaagctgctgatgccaatgggaaagaacgaacggttgaatttaatggtctttgctgtgttaaaagaaaatcattatttgaaaattag

SEQ ID NO: 2350 - DNA (genomic), 1773 bp, Enterococcus faecium; double-stranded, circular
  misc_feature (B) LOCATION 1...1773
  hypothetical: NO
  anti-sense: NO
aataagggtagtgacattcagttggctaaaccttccactaataaattggagggaatagaaatgggaaaataccaagaattagcgagaaaaatcgtagaaaatgtcggcgggaaggaaaatatcaatggtttgacacattgtatcacaaggcttcgtttcaaattaaaaaacgaagaaaaagcaaatgatgagatcttgaaaaatatggacggtattgtaacggtaatgcgagcgggagggcagtatcaagttgtcattgggaatcatgtgccagtcgtgtttgaagaggttataaaagcaggaaaccttacttttgatgaggctgtttcaacagaaaaaatgagaccgtttgatatgcttattgatggaatatcgggctgtttccagccattccttgctatcctagctgctggcgggatgattcgtggactgacagcattccttgtcttcttaggcgcgtttgaccgcggttctggcacatttgttatgtttgataatatcggtgattctgtattccaatttatgcctgttattatcggtttaacagctgcccgtaaatttaaagtaaatgaattcgtagggatgttgcttggcgcagcattaatgaatcctagcttgtcgctggaagctttgagtggtgcagcagaagcaccactaacgaccatattttctggcactatttttgaagcacctatttatcaaacagtattcggcattccctggattgcgcgtaactacgcttcttctgtcattcccattatctttattgtgttgttagctagccaaattcagaaaccaattaaaaagttagtacctgagatgatcgcgaatttcttcgttccattcttcaccgttcttattacaatgcctttaggttttttactcgttggaccagtattcacattcgcaactgatattttaatggctggatttgaaacacttttagcactttcgccagttatttatggagcaatcgtaggcttcttctggcaaattctggtgatgtttggtctccattgggcaatcgtaccaatgggattgatgcaattttctgtgaatggttggcaaaatattatgacacctgttgcagtagtgtcttttggacaaactgcagcacttaccgcactctactttaagcttagaaatccaaaagacaaagcaattgcaataccagccattgtttctggtattgtggggattacagagccagctatttatgggtttacattaccacgtaaaaaaatatttatttttacctgtgtcggtggtgcgttagggggcgcgtatagtgggttaatgaatttaacttcttggaatcaaggtggactaggcatctttacaattcccaactatattagaccagatggtgatttaacagatgtgattaatgtattgattgggatcgccattgcgatggtggtatcctttacgctgacttttttcttttggaaggatgaagcaggtgaaacagatgatatacagaaaaaatcaggtaaagaaattgtaaaaacaccgatacaaggacaaatcgctccactaaatgcagcaaaggatgcagcttttgcacaaggaacactaggtcgaggaatcttgatctaccctgaaaaaggagaagtacgtgccccttttgacggaacagtcatgaccctgttcccgacgaaacaggcaattggaatggtttctgaaacagggctggaattgctgattcatgtcggattggatactgtgcagttggaagggaaatattttgaaagcttagtgcagcaaggataa

SEQ ID NO: 2351 - DNA (genomic), 249 bp, Enterococcus faecium; double-stranded, circular
  misc_feature (B) LOCATION 1...249
  hypothetical: NO
  anti-sense: NO
gacaatttcagaaaaaatggtattgctttcccgttttatacaagagatggaacagatgaaatttgccagaagctatcagcaaaatactttattgaagcaagaaatcaatcaattgaaaaagaaacaaaaagtatggatacaagaatacagcgaacaattgactcaagcaggcttatcttatccttcggaagtacctgtctttttacaaaaagccaaacaagccgaacagcagatgaaaagatacaatga

SEQ ID NO: 2352 - DNA (genomic), 1602 bp, Enterococcus faecium; double-stranded, circular
  misc_feature (B) LOCATION 1...1602
  hypothetical: NO
  anti-sense: NO
gttatattcagctggaacgatcgccaagtggtggttgttccagctttttttatggcagttaacctcttgaaaaagatagtaattatttatctatttttagatcctgtcataatgaaagggaggaataagatgaaaaaagaaaccnatgttactttggtcacagtgagtattttcattgcaacgttcatgacggctattgaaggtacaatcgtaacaaccgctatgccaacgattgtcggttcattacatggaatggaaatcatgaactgggtattttcgatttatttgctgacaaacgctatgcttactccgatttacggaaaacttgcggataaagtgggacggaaaccaatctttatttttgggacattattgtttattatcggttcgttattttgcggtttatctcaaaccatgattgggttgattgctgctcgtgcgattcaagggatgggtgctggggcaatgatgccagtagctttgacgatcatcggcgatctttattctattgaaaagcgagcaaaagttttaggtttgaatagttcagcctgggggattgccagtgtttttggaccgcttgcgggaggattcatcgttgaaacgatcagctggcactggatcttttttatcaatgtgccgatcggaattctattaattattttgatttggctatatttaaatgaaccaaaaatcatacatgagtctaaaccaatggatatttttggtagttttagtttgatggccatgcttgtctcattgctgttagggttccaattattaggagacgaaggaatgagtccgcttgtttctgctttgctgctaggtagtatcgtaatgttaggtatttttgtttttgccgaaaaaagagctaaagatcctgtcatcatgatgcatttattcaaaaatccactatttgttgtggtcaacttggctgcagcattggctagtggttttttgatgggaatcgatgtttatatccctatgtggatgcaaggtgtattagggctgaatgcagcaattggtgggctggtattagcaccattatcactagtctggatggtcggttctttccttgcaagcaagtggatgactcaaatgaaaactcattgggtcttgagaattggactactaatcgcagctattgggggcgcttggttgtatcttatgcctttcagaagtaactatttatggttttttgctatatcaacggtcatcggtataggcttaggtgtgaccatgactacctcgactgtcagtgcacaaaatagtgtatctcgtgaccagcttggtgtagcaacttcttttaatacgttagttcgaacaattggtcaaacagtcatggtttctatttttggtttattgataaatggggtaactaaacgagaacttgcagcagcaaatttaacaaatgatgcagatatcatgaataaactggtgaatccacaaacggctaaatatattgatgcggatattttgttaccattaagaaaaattctttatgatgggttacattccgtttatctagttggcttgttactcgtgatcattgctttggtcttaacgcttttcgttcatgaaaaaagtggtaaaataaaacagtag

SEQ ID NO: 2353 - DNA (genomic), 2211 bp, Enterococcus faecium; double-stranded, circular
  misc_feature (B) LOCATION 1...2211
  hypothetical: NO
  anti-sense: NO
gcgtggttcaggtacatccagtctttgaagaactcttccatgcctttgatacccgtccacctgttcaagagagaatggagtgaggggatgaaaaagaaactttttcggattgtgggaatcgtttttattagcatactcactctgatagttctattgagtttagttggtacggtagccgaggcgacagggctagttgatgatacagttgaagcaggaaatctatattccaaatattcactgaacaactatcaactagatttctttgtggatagctcttgggattggttgccttggaattggggtgatggcttagggaaaagcgtgatgtatggtctttatgccattactaatttcatttggacggtgagtttgtatttgtcgaacgccacgggttatgtggttcaagaggcttacaaattagatttcatttcggatacggctgaaagtattggaaagaatatccaaacattggctggtattactgaaaatggactccagacctccggattttattttgggtttctattattgatgattttagctctgggggtgtatgtggcgtataccggattattaaaacgagaaaccacgaaagcagttcgagccgtgattaattttgtgatgatttttctactatcgggttcgttcattgcttatgcgcctacctatatcacaaaaatcaatgactttagctcagatgttagtgaagcggcccttacccttggaaccgagatcgttgtacccaattcagaaagccaaggaaaagatagtgtggatttgattcgggatagtttgttttcgattcaagtccaacaaccttggttactactgcaatttgatgattccaacatagaagaaattggtgaagaccgggtcaacaagattctatctgtgagtccagatgaaaacaaaggcaaagatcgggaagaagcggtcaaggcagagattgaagacaatgacaatgcgaatctcagtattaccaagaccatgaaccgtttagggaccgtggtctttttggtattgttcaatattggcatttccttctttgtttttcttctaacagggattatgttgttctcgcaaattctcttcattatctttgcgatgtttctgccaattagtttcttattgtccatgttgccgacttatgaaagtttaggaaagaaggcgattattcgtttattcaatacgattatgatgcgagcgggtgttactttggtgattacgactgcatttagcatctccacgatgtttttcaatatttcggcaacctatccatttttcatggttgcttttctgcaaattgtgacctttgccggtatctatttcaaattgggcgacattatgagtatgttcaacctccagagtaatgatagccagtcaatgggaagacgcgtcatgcgaaaaccgcaaatgttaatgaatcgaaaattgcggcaactcaatcgaaatgtgggacgagctttggcttttggtggtggtgcagcagtcggaaataagttggcaaaggaacaatcaaaatccaaatttaagccatccggttcttctctacgaaagaattcacgattaccgaacgatcacgaaatactatctgacttaactaaggagaatccagtttcaaataataagaaacaatcccgaatgaatttggctgggagaaaaatcggcaaagttttggatacccaagctttggtgaaagataagactaaacaagtaaaggatcaggtaaggaatacgccaacgaatttgaaatacaatctccataaaggaatcgaaaagtcgaaaaaagcaccagaagaattcaagcgcggactgttccaagaaaaagcggatcgagtggatttgcgagaaaaacaacgacaacgaagaaatgcgaaaatggacgaaaaacgcaagatactgagtgaagcaacaaatcgtcagggaaaaagaagggcgaatattccaatagataaagcagctcaacctcagaaagatatgatgctgaaaaaagaagcaccaaagcggattgtgagagcaaatctgaatcccgaaatcaaacgaaaactaactagtcaagaaatcatttcaaaagggaaaagccaatcagcaagtaagaaaaattctttccaacaagtgaaacagaggtccactctgccaaagcagaccaatcaaaaagtacaaaaaagaatgaaccatcgtccaaaatcaaggtcaggtgagaaaaaatga

SEQ ID NO: 2354 - DNA (genomic), 294 bp, Enterococcus faecium; double-stranded, circular
  misc_feature (B) LOCATION 1...294
  hypothetical: NO
  anti-sense: NO
aagcattggctctacacggactgggattatatgtatttcaaggggaagatattcccaacaccacctagaatcgatacaaagaaattaaacatgctagagacgattctagaagctttcaatgagcagatgggtaaagatatgacccaaaccttaatcgaatatgttaatgagcagacagataaattagggctcttagctgataacgttgaaactattgaacagttaagctatgagcaatgtgccttgatggagcgagcaatagcagctaagagaaaagaattagataagaagtga

SEQ ID NO: 2355 - DNA (genomic), 867 bp, Enterococcus faecium; double-stranded, circular
  misc_feature (B) LOCATION 1...867
  hypothetical: NO
  anti-sense: NO
agaaaactcaggcaacgactagcaaggagtgacaatatgttagcacaaatcaatcgagttgcttttgagcttgtagggattcctatctactggtatgcattgatcatcgtatcaggtatcattatcgctatgtggcttagcagcagagaggctgttcgggtaggattaaaagcagatgatgtgacagattttatgttgtggggattgcctatctccattattggcgctcgcttatattatgttttatttgatcttccccagtatatagctgatccaatccaaatattcaatatccgttcaggaggcttagctatttatggcggactgattgcaggcgcgatcacgctgtatttttttactaaatatcattttatttctttgtggacttttttagatatcgctgcaccaagtgtattattagcacaggcaatcggtcgttggggaaatttcatgaaccacgaagcatatggaccagacacgacgcgaagcttcttagaaagtctgcatttaccgcaattcatcattgataatatgtatatcgaagggatctatcgtcaaccaacatttctttatgaatcactttggagtttgattggatttattttgcttttgtttttacgaaagaaaccacaccttttgaaaaaaggcgaagtccttttatgttatctaatgtggtatagtttcgggcgtttctttattgaaggattacgtacagacagtctttactttttaggtgtgatccgtatttctcaattattatctgctgtgttatttgtcggtacattgattctatttatttggcgcagaaaaaaaggaaatttaccggattatgaccgctcattaggaaaaaatcaacaaattatctga

SEQ ID NO: 2356 - DNA (genomic), 1179 bp, Enterococcus faecium; double-stranded, circular
  misc_feature (B) LOCATION 1...1179
  hypothetical: NO
  anti-sense: NO
actgaaatcagccaactatatttaggagtgacgcagttggacgcacgttatgcaattattttggcggcagggaaaggtacccgcatgaagtcaaaattatataaagttttacatcccgtttctggtaaacctatggtagaacatatcattaatcgggtcagtgaaacgaaaccagatgaagtgattacgatcgttggacacggagcagaacaagttaaagcacaactaggagaacgcagtaaatatgcgttacaagcagaacaattgggaacaggacatgctgttttgcaagctgcttctttcttggaaggaaaaaaaggaacaacgttagttatcagtggcgatacaccattattgactactgaaacgctgaacaatctttttgaatatcaccaaggaaaaaatgcaagtgcaacgatcttgacggcacaagcagaaaacccaacaggatatggacgaatcatccgtgaccatattgggatcgtagaaaaaatcgtggaacaaaaagatgcaacaccagaagaagctcttgtacaagaaatcaatacaggaacttactgttttgacaacgaagctttgttcgatgcgttaagcaaagttggaacaaacaatgctcaaggtgaatactatctaacagatatcatcgaaatcttaaaagaagaaggccatacagttgctgcttatcaaacggatgattttgaagaatcaatgggagtcaatgatcggatcgcgttagctaaagcaaatgagatcatgagaaagcgaattaaccagatgcatatggtcaatggcgtaagctttgtcgattcagcaacgacatacatcgatgcaggcgtagaaatcggtccagacacattgatcgaagcaggtgtacaaatccaaggaaatacagtcattggttctgattgtgtcatcgggtcacattcaaaaatcgtagacagtaggattgaggatcacgtcgtcattgaaaactcagtcattgaaagcagccatgtcaagaaacatgcagatgtgggaccttatgcacatttacgaccaaaagctgaaattggcgaaaacgtccatatcggaaactttgtggaagtgaaaaatgctcaaatcggcaaaggaactaaagtcggtcacttgacttatgttggtgatgctacgctgggagaagaaatcaatctcgggtccgtt

SEQ ID NO: 2357 - DNA (genomic), 270 bp, Enterococcus faecium; double-stranded, circular
  misc_feature (B) LOCATION 1...270
  hypothetical: NO
  anti-sense: NO
tctcaatggctggagacggtgctttgctcttcacgggaacaaggaacttataaaacgaatgtattagttcgcccattgaaaaattcagtaggtgcaggggattcaatgattgctggctttattggggcttacagccgtacgaaagatccaatcgaagcctttaaatggggagttgcttgcggaagcgcaacagctttttctgatgacttggcagctcgcgaattgattgatgagttgctgccagaagttgaaatcacaaaaattgattag

SEQ ID NO: 2358 - DNA (genomic), 786 bp, Enterococcus faecium; double-stranded, circular
  misc_feature (B) LOCATION 1...786
  hypothetical: NO
  anti-sense: NO
agacattccagcaatcaaaaattatacaaaacaaaagaagaacgttctgcagcattaaaacgtcacttggaattctttaatacacacccatacattgcttctccaattttaggggttacattggctctggaagaagaacgtgcgaatggcgcgcctgttgatgatgtagcgattcaaggggttaaagtaggtatgatgggtcctttagctggtgttggtgacccagtgttctggtttacagtacgtccaatgctaggtgcactaggtgcttcattagctatgggaggaaatatccttggaccaatcatcttcttcttaggttggaacattattcgttgggcattcatgtggtatacacaagaatttggctacaaagctggttctaaaattactgatgacctttctggcggattgttacaagacgtaacaaaaggtgcttcaattttagggatgttcgtattagctgcccttgtacaaagatgggtatcaatcaaattcttaccagttgtatcaactgtaaaattagataaaggtgcttacatcgaatgggataaattgccttcaggtggtgaaggaatcaagagtgcatttgaacaagttaataatggcttagccctttctcctgaaaaggtaacaacattacaagacaacttagaccaattgattcctggtttagctgcattaggattaacattgttatgtatgtggttgcttaagaaaaaggtttctccaatcgttatcatccttggtttattcgtagtcggtgttgttggacacgtcatctga

SEQ ID NO: 2359 - DNA (genomic), 546 bp, Enterococcus faecium; double-stranded, circular
  misc_feature (B) LOCATION 1...546
  hypothetical: NO
  anti-sense: NO
acagtatccagtcccatatggatcaaaacttctgctccttctgctgtttgcatgccaattgcatgcttggttgggaagacactcaagattttaccagaaagtggtgccgccacttctccggtggcaggaatgacagcaaagccatcacccatcatcttttgtgaaaagactggatcattcacatctgttaaagcaattacctcaccagttgctacagtgaataattctttttcgatacctaaaacatgtttctcttcattcttctcatttttatttgttgcctcaactgttggctctggaatatcagcgcctgattgtagtaaatcttcaatatccgatttcaacacatccgcttttggtccatacacggcttgcacacctttgtccttaacgatcaagcccatcgctccagcacgtttccattcttcttctgaaccgactttcccaggatcctcgacgctgacacgtaaacgagtcatacaagcatctacatccttgatgttttcttttccacctaacaaatggatgatcttaatgatttgttga

SEQ ID NO: 2360 - DNA (genomic), 375 bp, Enterococcus faecium; double-stranded, circular
  misc_feature (B) LOCATION 1...375
  hypothetical: NO
  anti-sense: NO
tacgtgtccagccaagctcttcacccctctaaaatgtcattcaaaaagactacccgatcaattgttacaataatatttcaaatattatttttaggtaacaacagacattttttgcggcttttaggcaaaaaaaaaccaaaaatagaacattctcttgaaaccttacttcgtgagcttctacttttgtttccttatattaaagccgaaacggacaatatttcgtttctgccttttcttcatcagatagtttttgcaacttcatatactacacttattttctataaaagtcaacacttcctggcgtttcttctgctttttcgcaacattttcttaatgttttcaattttatgttttcaattatctgacaattcttaa

SEQ ID NO: 2361 - DNA (genomic), 987 bp, Enterococcus faecium; double-stranded, circular
  misc_feature (B) LOCATION 1...987
  hypothetical: NO
  anti-sense: NO
atgcggtccagctgtggtagactatttacaagaaaatctttttgtataggtggcgaagcagcagtggcaaacattcgagatatcgcaaagctcacaggttattcagtttctactatttcacgtgtaatcaatggacatccatatgtagatgaggaaaaaaggaaagaaatacttgcggtcatgaaagaagtcgattatatccctaatgcaaatgccagacagttaagttatggaaaaacgaaaagcattggagtgattctgccttataccaatcatccgtattttgatcagttgatcagtgggatcattgaagcagcgtttgattatgattacaaagtgacacttttaccgacgggctatcataaagaaaaagagcgaaggtatcttgaagaatttgcagctaaagctttcgatggattgatcattacgtctcgtgccaatacactagatgatttattggcatatcaaaaatatggacctctagttttttgtgaagaaatcaagggaaaacaggcaagctgtgtctttattgatcgagaacaatcaattacagaaggtcttacttatttgaagcagcaaggtataaagcaattgggcatcacgttggggcgaagtggcaggctaagttataactcaaaaatcactttgcagctatgtcatcaactttttccatcttttgatgaatcacttgttttttgggattgtatagatgcagagaaaggaaaacaagcaggcttcttttttaaagagcttggagttgatggtgtctttacaaattcggatatggttgcagcaggcatcttgcaaagctatctgcaagataagacaccagtggtgattggacgcgataatttgctgatcagcgagcttcttggtttcccaaccatcgaccaccatctggaagcttgcggagaaatggcatttcaattgtttcttacagaaaaaaaggataaagtgaaaataccttatacgtttattcaacgatga

SEQ ID NO: 2362 - DNA (genomic), 966 bp, Enterococcus faecium; double-stranded, circular
  misc_feature (B) LOCATION 1...966
  hypothetical: NO
  anti-sense: NO
aagttgtggctcaacagacaccaagtttttgccggagcagatttagaaaatgtcttgaatgaagcagcgttagtagctgctagaagaaataaaaagaaaatcgatgcttctgatatcgatgaagcggaagatcgcgtgattgcaggtccagctaaaaaagatcgcgtaatcagcaaaaaagaacgcgaaatggttgcttatcacgaagctggtcatacgattgtcggattagtattgagtcgcgctcgggtcgtccacaaagtaacgatcatccctcgcggacgcgccggcggatatatgatcgctttaccaaaagaagatcagttcttgatgacgaaagaagatatgtttgaacaaatcgtaggcttacttggtggacgtacagctgaagaaatcatcttcaatgtccaatcaactggtgcttccaatgactttgagcaagcgacagctctagcacgaagcatggtaacagaatatggaatgagtgatcgtttaggtcctgttcaatatgaaggaaaccatcaagtgtttgttggccgcgactatggtcaaacaaaagcttactcggaacaagtcgctttcgagattgatcaagaagtacgaaaaatcttgatggaagctcatgataaagctcgagaaatcatcgaagctcatcgtgcacagcataaactgattgctgaaaaacttttggaattcgaaacattggatgccaaagcaatcaagtcattgtttgaacacggtgtgatgcctgaaggtactgagtcaaatgattatccaagcgaaaaagaagcgaaaacttttgaagaagcaaaacgtgctttggaagaaaaagacgctgaaaaacaagcggaagaaaaacgtgattttgaagaagcaaaacatgaactgaatgaggaaaataaagcagaacatgattcagattctcaacaatcagaagataatcattcagacgatcaatacaaataa

SEQ ID NO: 2363 - DNA (genomic), 1440 bp, Enterococcus faecium; double-stranded, circular
  misc_feature (B) LOCATION 1...1440
  hypothetical: NO
  anti-sense: NO
aaggagtggctaattatgttgaatattggagaaaaagaattttggtttgttgtaggatcacagcatttatatggggaagaagcactgcgagaagtaaagaaacatgcacaagaaatggtcgatgaactgaatgaaaatggccaattgccttatccaatccgccttcaagaattagcagttactgctgatacgatcacaaaaatcatgaaagaggtcaattatcgagaagaagtagcaggtgtgatcacttggatgcatactttctcaccagcaaaaatgtggatccgcgggacaaagcttctacaaaaaccattgcttcatttagctacgcaatataacgaaagcattccttggaaaacgatcgatatggatttcatgaatttaaatcaatccgctcatggtgaccgcgaatatgggttcatcaatgctcgattaaataaacaaaataaaatcgtcgttggctactggaaacgacctgagatccaaaaagagattgctgattggatggatgttgcagtagcctataatgaaagttttggaataaaagtggctcgttttggtgacaacatgagaaacgtgggtgtcacagaaggagacaaagtggaagcacagattcaatttggttggactgttgattattttggtatcggagatcttgtacaagtaatcgatcgcgtatcagacgaagaagtcgatcaattatttgaagagtacaaggaattgtataccttcgactatggtgattatgaagaaaagacatgggaggaacatgtaaaagtacaagctcagcaggaaatcggtattcgccgtttcttagaagaaggaggctataacgcttttacgactaattttgaagacctgtatggaatgaaacaactacctggactagctgtacaacgtttgatggcagaaggatacggttttgctggggaaggcgactggaaaactgcagcgattgatcggttgctgaaaatcatggctcgagggaaagatacaggattcatggaagattatacttacgagctagctagtggccaagaagcaatcttggaatcccatatgatggaagtagatccgacgcttgctgcgacgaaaccaagaatcgttgtttctcctttatcaatgggagatagagaagatccggcgcgtcttgtatttgatgggaaagcaggagaaggggtagtcgtatcgatggcagatttcggtacgcattataaactgctgatcaatgaagtagaagcctttgaaccaacgactgaagcacctaatttacctgttgcacgtgtgttatggaaaactaaaccgaatttccatgaaggtgtccattcatggattcaggcaggtggcggtcatcataccgttgtctcgctaaatctaacaacagatcaaattgaaacgtgggcaaaattagttgagttggaaacagtggttattagataa

SEQ ID NO: 2364 - DNA (genomic), 1464 bp, Enterococcus faecium; double-stranded, circular
  misc_feature (B) LOCATION 1...1464
  hypothetical: NO
  anti-sense: NO
acaacaaccagctattttaggagggaaagacgaatgaattttgaaacagtcattggactagaagtccacgtcgagttaaaaaccaactcaaaaattttctctccagcgccagctcattttggtgcagaaccaaacagcaatacaaacgtgatcgactggggttatccaggcgtgctgccagtaatgaataaagctgcgctggaattcgggatgaaagcagctttggcattaaactgtgaaatctctaaagatactcattttgaccggaaaaattacttttacccagataatccaaaagcatatcaaatttcccaatttgatcaaccaatcggtcatgacggatggatcgaaatcgaagtagaaggtaaaaagaaaaaaatccggatcgaacgtgtccatttagaagaagatgctggaaaaaacatgcatggtattggcggttattcttacgttgatttgaaccgacaaggcacgcctttgatcgaaatcgtttctgaagctgatatgcgttcaccagaagaagcatacgcttatctagaagcattgcgatcaattatccaatttacagaagtcagcgatgtgaaaatggaagaaggctctatgcgctgtgatgccaatatttctcttcgcccttatggacaagaagagttcggtacgaaagcagaattgaaaaacttgaactctttatctttcgtgaaaaaaggtttagcttttgaagaaaaacgtcaagcaaaagttcttctttcaggaggagaaatccaacaagaaacacgccgttttgacgaaacaacgaataaaacagttttgatgcgtgtcaaagaagggtctagtgattatcgttacttcccagagcctgatatcccgaaattcgtgatcgatgacgaatggattcaaaaagtaaaagctagtttgcctgagatgccagcttctcgtcgcgaacgctatatccgtgagtttggacttccagagtatgacgcaatggtattgacacttacaaaagaaatgtctgatttttttgaagctgttttggaaaatggtgcagatgccaagcaagcatctaactggttgatgggtgaagtttctgcttacttgaacagtgagaaactggaattagctgagacaaaattgacacctgagaacttagcaggaatgattcgtttgatcgccgatggaacgatcagctcaaaaatcgccaaaaaagtcttccgtgaattgatcacaaatggcggagaagcccaagaagtagttgaaaaaaatggttgggtgcaattatctgatccgaacaaactactgccaatcattaatgaaattttggataacaaccaacaatctgtcgatgatttcaaaaatggaaaagatcgtgcggttggcttcctagtcggtcaaatcatgaaagcaactaaaggacaagcaaatcctggtgtcgtgaataagctacttaaagatgaattagcgaaacgatag

SEQ ID NO: 2365 - DNA (genomic), 1044 bp, Enterococcus faecium; double-stranded, circular
  misc_feature (B) LOCATION 1...1044
  hypothetical: NO
  anti-sense: NO
gcgacaaccagaaataacagcgaaacagttatggctttcaggaaggcaagtgggtcgagatgtgattggctcgatgaccaatatccttttgttcgtctatatcagtgggtcagttccatcgcttcttttatatttaggaaatcaatggtcgttcaaagaaacgatagaacagcatttatcattggaatttttacgcgtcattgctggcagcttaggaatagtattatcgatccctatctcggtcctcttttttctgactgtaaggaggctgaaacgatgaatgtacttattatacttgttgggattttagcaatcagcgtgctacttattggcggtacgcaaggtatgtatattcttttaggcttattcatcaatttagggatctttttcctgttgttattcggttatcatcagaagtggccgatactggcattgtcggtcataggatttttattgattgctgtggttatcttattttttatcaacggttataatctaaaaatgcgtgcagcttttgtgagtatactgatctttttattttgtttcctactattgcttcctatcactgattttttagcaatccaaggttttacatcggtagaactagaagaattatctggcttagataagactttagcgattgattttagattacttacgagatcgttgcttctgattagtcttagtggtgctgttttagatgcgagtgtagcaatttctagtgggacattcgaagtatatcaggcaaatccgcaattatctttttaccaattgcgccattctagtttcgctattgctaaaaaaatattggcgtcaacagtaatgacacttctttttgcattcatgggaagttctttagcgttgatcctctggtttattgatttagacattccttttcagcaagtgatcaatgaaaaatcatttgttctagaatatacgatggctattcttaccacattgtccgcactacttgttcttcctttaacctgcgtgactacagcatatctctttacaaaaaagaaagaacaactcaagatggagtaa

SEQ ID NO: 2366 - DNA (genomic), 3660 bp, Enterococcus faecium; double-stranded, circular
  misc_feature (B) LOCATION 1...3660
  hypothetical: NO
  anti-sense: NO
tcgacttacagcttggccggcgcagacgacccagaaatccagtccgagcaagcaaaattaaaccggctctatgatgcgttcagcgcaaagtacgggcttcttaacagcagtggcaacaagctggcctttgagcaggattcctcatatccgctgctctgctctcttgaaatcatcaacgaggaggggaagctggagcgtaaagcggatatgttcaccaggcgcaccatccagacccaccgcgccgttaccagcgtggacacggctgtggaggcgctggcggtatctatcggtgaaaaagcctgcgtggatttgggctatatggcatccctcatgggcggccctgaaaaaatcccgcagattgtggaggacttaaaaggcatcatcttcaaaaaccccgccaccggcccctttgacctggaggacggcggcgcacactggcatcagggctggcagacggcggacgaatacctttccggcaacgtccgggccaagttagcgattgcccgcgccgccgctgaggaaaacccgcagtttgccatcaatgccgaaaagctggaacaggtgcagcccaaagacctgacggcatctgaaatcagcgtccgtatcggcgcgtcttggattgacccggagtattaccagcaattcatgtttgaactgctgcatacacctgtgtatttacaggacagaaaaatcaagctgcaatattcccctaccaccggcgaatggaacgtgcagggaaaaagcacagacaaccgggataacgtgcgcgtctatgctacttacggcaccaagcgcatcaacgcttatgaaatctttgagcagaccttaaaccagcgggatgtacggatatttgataagacagaagtggacggaaaggaggtgcgcgtcctcaacgaaaagcagaccgccattgcccagcagaagcaggaagccatgtgcgaaacgttcaaggactggattttcaaagacccggaacgtcgggaaaccctttgcaggcggtacaacgagaaattcaactgcatccgtccacgcgaatatgacggttcccatatccgttttgctgggatgaacccggaaatctccctgcgtacccaccaagagaacgccgtggcgcggatgctctatgggaaaaactcgctgcttgcccactgtgtcggcgcgggcaagacctttgaaatgattgccgccgcaatggagggcaagcggctgggtctgaaccagaaatccctattcgtcgttcccaaccacctgacggaacaatggggcggcgattttttgcgcctgtaccccggcgcaaaggtgctggttgccacgaaacgggactttgagcctgcccgccgcaagaaattctgcgcccggatcgccaccggcgactatgacgcgataattatcggacactcacagtttgaaaaaatccccctctccccggaacggcagaaagccgtcattaaggggcagattgatgaaatcgtcaccgccattgccgaagcaaaggcggaggacggcgagcgctacaccatcaagcagatggagaaaacaaagaaaaacctggaagccaagctgcaaaagctggcggacggaaagaaaaaagacagtgttgttacctttgaggaattgggcgttgaccgtctgtttgtggacgaggcgcacggctttaagaacttgtttttacacacaaaaatgcggaatgtggcggggattgcccagacggacgcgcagaaatccagcgatatgtttgccaagtgccgctacatggacgaaatcaccggcgggcgcggcatcgtgttcgctaccggaaccccggtgagtaactcaatggtagaattgtataccatgatgcgctacctccagtttgacaccctggagcagaacggccaccgccatttcgacgcatgggcggcagactttggcgaaaaggtcacggcgatggaattaaagccggagggcagcggcttccgctccaagacccggtttgcgaaattctataacctgccggaacttatttctatttggaaagaagccgccgacatccagaccgccgatatgctgaatctccccgtgccaaaggcggaatatatcaccgtcaccacggaacccagcggattccagaaagaaatggtggaggaacttggcgagcgtgcggaaagtgtgcgcggcgggcaggttgacccccatatcgacaatatgctgcggattacttcggacgggcgcaagctggcgctggatcagcggctgcaaaatccgctcctgcccgacgacccggacagcaaggtcaacgcctgcgtgaaaaatatcgtgcaggaatggcaggccagcacggagattttaggaacacaattagtgttttgcgacctcagcacacccaagggggacggctcattcaatgtctatgatgacatcaaggaaaagctgattgccaaaggcatccccgaagcgggaatcgcctttatccacgacgccaacacggaaacccaaaaggcagaactgttcgccaaggtgcggcgggggcaggtgcgtgtcttaatcggctccacggcaaaaatgggcgcaggcacgaatgtgcagaaccgcattgtcgcgtcccatgacctggattgcccctggcgtcctgccgatttggaacagcgggcgggccgatctctgcgccagggcaacatgaatgcgtcggtgaaaatgttcaagtatgtcaccaagggtacattcgacgcttacaactgggggctggtggaaaacaaacagaaattcatcggtcagatcatgacctctaaaagccctgcccgctctgccgaggatgtggacgccactgccctttcctatgctgaggtcaaggcccttgccaccggcgacgaccgtatccgcgaaaaaatggatttggatgtgcaggtttccaagctgaaaatgctcaaagccaaccacacctcccaacagtacgaaatgcaggacaaagcgctgaaatactacccgcagaaaatcgcggaaaccaagctgttaatcgaagcgctgacggcagatttgccaaccgtgcaggcccacccggtcaaggacgatgcgttttccatgactgtcatggggcagacctacacggagcgcaaggcggcgggcgaagcggtgattaaagcgtgtatgctgatggacgacccggaaaaaaccgtggatttgggcgagtttcgcggctttcccatgcagctaaggtgtgacggcagcaaattccgcgtcaccatgaagcagaacctgacctattccgccgaactgtctgacgatgcggtgggcaacgtcacccgtattaacaatgcgctggaaagcctgacggagcggttggacgcacaaaaagcacggcttgccacactggaaagcgaactggaaaacgccaaagaagaagccgaccggccattcccaaaagaagaagaactgcgggaaaaatccgcccgcttaaaccagcttaaccgggaactgtccaggccggacaaaaaggaggatgagcaggaggttgaagaaagccctgatttggaggacgccggaaaacccgcgccggttgtgccgatgcccgctgtggcggctggctataaaccctctatccgtcaggcaatccgtaantatgaaccgcccacgccggtacattccggcatggagcgcaccccgcgaaaggaggcggtgctgtga

SEQ ID NO: 2367 - DNA (genomic), 417 bp, Enterococcus faecium; double-stranded, circular
  misc_feature (B) LOCATION 1...417
  hypothetical: NO
  anti-sense: NO
agtatatacagtatacttgaagcaacgataaaaaaggagtttacgttcatgggcacattcacaccacttatcttgttttggtatatttacccggtaatcgttttgtttggttgccaatttcttgtaaaattattttcgttaaatcgtcgttttaaaataaaagcccctgatttggcgattccttttttgtggggcggtatgcatgcattgtctagaaatacagggacaatttctatcttaccgtttttctttatttctgttttgctaatgggaatttgtattgctgttttccaagcatattattatgaagaaattatttatccgcgttatttcaagatgacttggcgtttggtttttctgttgacaatcgtcttgtacgctgtcttgatcattgtgaacatactttcttacctatga

SEQ ID NO: 2368 - DNA (genomic), 297 bp, Enterococcus faecium; double-stranded, circular
  misc_feature (B) LOCATION 1...297
  hypothetical: NO
  anti-sense: NO
agggatcggcttatggccaaaggaccgcttattacgcgaagcgaacttcgcaagcgacaacaagcacaagcaagcgagtcattaaaaaaacagcgaaaagcagaaacagcttatcagcaagaagaaaaaaagattgccagcttttatcgtaaagaaagcaaaaagaataaaccaatcacgaaaacaaggatcagcgaacgggaaaagacgaccaaatggaactcttttttgatgaaatctcttattattgttatcctaatgttatgtgtggtttttttagcaatcgcatttatatag

SEQ ID NO: 2369 - DNA (genomic), 927 bp, Enterococcus faecium; double-stranded, circular
  misc_feature (B) LOCATION 1...927
  hypothetical: NO
  anti-sense: NO
ataaaacacaggaggattctcatgacaaatttgctctctcttttcttatcatctgcatcgcaaggggtcttatgggccctacttgcgattggtgtatacgtcactttccgtatcttggacattgccgacttgactgctgaaggaagctttcctttaggtgcagggatcgcggcagtaagtattacaaatggctatcatccattgacagcttgtcttctaggctttttagggggtgcggcagcagggcttgtttccggactgcttcacacaaaattgaaaattcccgcccttcttgcagggatcatcaccatgactggtttatattctgtcacatcccgtgtgatgggtgcgccgaacatctctttattgggtcagccaacgatctttcattgggtcgagtcattcggcataacaaaagacaacgctgtactgatcgtcggtctgctttttgctttgatcgttgtatgtttacttgttttgttcttacgtacagaaacaggacttgctattcgtgcaactggcgataatctggcaatgagcgaagcaaacgggatcaacacagataatatgaagatcatcggttatatgatttctaatggatgcattgctctttctggctccttgcttgcgcaaaacaacggctttgctgatttaaattctggtattggaacgatcgtaattggacttgcttctattatcatcgcagaagttttgttacgtaaccagccactatttctccgtctcttgactgtcgttttaggtgcggtcatttatcgttttattttagcgttagtcttcgaactgaatgttgaaccaagtgattcgaaacttgcttctgctttcgtgctagtgatctgtctttctttcccgcagatccagcaaaaattccatttacctcaaaaaaagaaaggcggtagtgtcaaatga

SEQ ID NO: 2370 - DNA (genomic), 231 bp, Enterococcus faecium; double-stranded, circular
  misc_feature (B) LOCATION 1...231
  hypothetical: NO
  anti-sense: NO
tggcagcacagtccacactcatatcaaaaatctgcgggcgaacgtgccggaaaatatcatcaaaaccatccgcggtgtaggttaccgattggaggaatcattataatggaaagaaaagggattttcattaaggttttttcctatacgatcattgtcctgttactgcttgtcgtggtaacggcaacactgtttgcacagcaatttgtgtcttatttcagagcgatggaagcc

SEQ ID NO: 2371 - DNA (genomic), 768 bp, Enterococcus faecium; double-stranded, circular
  misc_feature (B) LOCATION 1...768
  hypothetical: NO
  anti-sense: NO
tccccaaacagactatctattcatcaagcaattattctaatcaagaggtgtgaacagatgaaaaaagtaatagtggataccaatttctgggaagtatttcctgaagcaaccatcgaaatcttatccgtaaatggtatcgataaccacgtaacaaaagaaagtgaagaaacgtatcatcaattattgaatgaggcagcaaaagaagcaagaaattaccttacagaagaaacattcagccaaaacgaagtcattgctcagtggcgtcaggcatttaccacattcaagactaaaaaaggtgcacgttcttctattgaagctttactgaaacgtgcaaatcaagaacgggaatttttcccaatcaatccgcttgtagatatctataatagtatttccttgtcttttggcgtaccttgcggcggagaagatatcgaaaagatcgcaggaaatctgcatttaggaaaagcccaaggtggcgaatcattcctgcctttaggtgcagattccgatgctccggcacttccggaagaaatcatctactatgatgaacaaggagcgatctgtcgctgtctcaactggcgtgaagcccaaagaacgatgctgacggaagaaacacaagcagcggtgctggtcattgaatccatcaatgctgaacaagcggcacgtggcgcacaggcaatcgaagcgttgaaggaaaaaatcgatcaaacatttggcgtaactagtgttagacacacactaaccaaagatgaatcagaagcagaattataa

SEQ ID NO: 2372 - DNA (genomic), 513 bp, Enterococcus faecium; double-stranded, circular
  misc_feature (B) LOCATION 1...513
  hypothetical: NO
  anti-sense: NO
aaagaaaacagggtgaaagagtatatgaaggtagaagaaggtcaaagagaaaagttaaaaacagaaatggaaagattacatacttatatcactcaactaagccaaaccttctatgatccagacaaagaaaaagtgatggttaattacccgaacaattcagaaggtcgccaattagagcaagtgtaccatgaagttttcaaacatttattgacggtgaagaaagagctggattattattctttaccgattatcgatacaggaatattgaagtatgatgggaagaaggaacgatttatctttaaatctgttcgggaagatttgcctctttcagcagggatggatctagaggtcttggtagaagactattttacagaagaaaagcactgggttcgaacaaaattggattatttaccgcaggcagccggagggacacaggcaagcggttggtacatcactgaagacaaagagttagaactagaaggtgtaatggcgcgtattcgaaaaaaaaattaa

SEQ ID NO: 2373 - DNA (genomic), 1125 bp, Enterococcus faecium; double-stranded, circular
  misc_feature (B) LOCATION 1...1125
  hypothetical: NO
  anti-sense: NO
gaactgaacagtgtgttaggcggaggtgtggtgccagggtctatggtcttgattggtggcgatccaggtatcgggaaatccactttgctgttacaagtttctcagcaattagcagccataggcggaaaagtactatatgtatccggcgaagaaagcgcagagcagataaaattacgcgcggaacgcctcggaagtatcaacacagaattttatctatacgctgaaacagatatgaacgaaatcagtcgtgccatcgaacatatctcccctgattatgttatcattgattccatccaaacgatgacgcagccagacatcacaagtgtggcaggaagtgtcagccaagtaagagaaaccactgcagaactactcaaaatcgctaaaacaaatgggatagccatttttatcgtcggtcatgttaccaaagaaggctcgatcgccggcccaagaatgttagaacatatggtggatacggtgttatattttgaaggtgaacaacatcatagttttcggattttgcgagcagtaaaaaaccgatttggctcaacgaatgagattgggatttttgaaatgcatgagcatggattggaagaagtcgctaatccttcacagattttcttagaagaacgcctagacggtgcaactggctctgctatcgttgtggcaatggaagggacacgtccaattttggtagagatccaagcattagtcacacctactatgttcggaaatgccaaacgaacaacaacaggtcttgatttcaatcgggtatctctgatcatggcagtgctggaaaaaagagctgggttgcttcttcagaatcaagatgcttacttaaaagctgcaggtggggtaaaattaaatgaaccagcgattgatttagctatcgctgtcagtattgcttcaagctataaagaaaaaggaacacagccaacggaatgtttcatcggtgaaattggactgactggagaaatcagacgtgtcagtcatattgaacaacgagtcaaagaagtccaaaaactcggcttcacaaaagtatacctacctaaaaacaacttaggtaactgggaagcgccaaaaggaatcgagatagttggagtacgccaactttggctgaaacgttga

SEQ ID NO: 2374 - DNA (genomic), 2031 bp, Enterococcus faecium; double-stranded, circular
  misc_feature (B) LOCATION 1...2031
  hypothetical: NO
  anti-sense: NO
gaggtgaacagcgctgtgaactacaaaattagttatctcctgaaaacaccaagagaaatcagtctagaaaaagcagcagagatcatcgaagtaaatacaagcgaggcgatcaaacaattaactccttttgccgaatatgtggatgatacccgtatccgtataaagaaattccgagcaatcgactgggcagaaaaatttttggatattactcgatttgaagctgtgtataccgaacaagagcgaagagatcttctttatttgatggtttattcgactgcaacgtctgtttctgtttttcattttcaagattttcttcaggtttctaaagggacagtcctgtcagatatcaaaaagataagaaatgaattagaagtggaagattgtcagctgtcgtatactaggaaaactggttttaggctgctagggtcagaagcaatattaagaagagaagcaaaaaatcgcactgctcgtttgatgcagtcacttgctggaagatttgggctcacgtatttaaccgcaaccctttccattgattattacgccaaagttagagatttgctagataaaacgatttcactatcagatcttcgattcgcaccaaatcgaatggatgaattagcttattatttgagtttgacaaccattcgaattggaaaaacatccatggaactggtaaaagatgctgaactgttggcttctcttgcagtcactgacattagtcgacaagtattgactggccttggctattccgaacatcaaaattcggagattatatttttctctctttgcttagcatcgatcgttgaaggagatgtccaggagcctgcacttgattttttgctggaatgttcttcagaagtcatccatcgcatggaattcctgatggccgtagaatttgcttcgtttcgtgaattattgatgaatgtcttttatcacttggtccctgcctattttcgtatttcctattctttttatttacctaatgtgatgatcgatcaaattaagcatcaatatgcttccatctacgaaatgacaagaaaagcattacttccgttagaaagacgaatagggaagagcatccctgaagaagagattggttttttcactatactatttggcggagagatcagaaaagcggacgcagaagaaagaaatagaaaaataagagccgtgatcgtctgtccaagtggcattagctcttcattgatcttaaaaagtgaacttcagcaattattcccgatgatcttttttacagagactaattcagctgaccgcttacacgaggttgacgaaacttcttacgatattattttttctactgtacctctcacacttactgataagaaaaagtctctctatgttctgcatccaatcatgactgacttggaaaaaaatcagctgatcaatcaagtacaaagagattggctgataccaggattttcaatgccttctgcccaagaattgttgtcggcgctactgccttatatcgaattaaaagaaggcgtagacgaagaaaagctctatcaagtattaaatcgtaaaatgaacaaacttttagaaaagaaggaggatcaacgtcctatgctatctgaattattaacagaagaaatgatccaattatcggatcaaccaaaaaactggcaagaagcaatcacatttgccgcacagccgctattatcagaaaataaaatagaagaaagttatatcaaagctatgatcgagcgcgtggagcagtatggtgcgtttatccatattggcgatcacatcgcattacctcatgctcgtccagaagatggcgtaaacgaagtagggatgtctttgctgaaacttcaacaacctgtggatctgcttgataatccagcccatcccattagtttgttcatctgtttagctgctatcgataatgaggcacatcttcgggctttggcaaatttaacaaagctactttctaataaacaaaatcttcaagatttattacacgcatcaacaaaagaagaaatattagcgatcataagaaaaggagacgaatga

SEQ ID NO: 2375 - DNA (genomic), 531 bp, Enterococcus faecium; double-stranded, circular
  misc_feature (B) LOCATION 1...531
  hypothetical: NO
  anti-sense: NO
gtatggaacaggcgagccatcattgtatcggtttttgtgaaattgataaatttgctagacgtagttataaagcaattcatgatacaagtaaggaggtggaaatgcatgacatcacaagtgtatcagatgagtttattcaatccctcggaccagtggacatcctttgcggcggatttccgtgccaagctttttcaattgcgggaaagcggcaaagattttccgatactcgaggtactttattctttgaaatcgctcggttcaccactcttctccgacctaagcttttattccttgagaacgtccgaggattgctcaatcacgaaggaggggctacgttcgagacgatcctccgaacgctggatggattggggtatgacgtggagtggtaggtgcttaactcaaaggcctacattccccaaagccgggagcggatattccttatcggacattctcgagacgcatgtaccgaacaagtatttcctatcattggaccgtcttcaacatctgatcaaaacatcagaaatttggtaa

SEQ ID NO: 2376 - DNA (genomic), 855 bp, Enterococcus faecium; double-stranded, circular
  misc_feature (B) LOCATION 1...855
  hypothetical: NO
  anti-sense: NO
atatatgacagaagaaaggatggtggattggttatggacatccgttttgaacaagtagacttcacttatcagccgaatacaccatttgaacaaagagccttatttgacatcaatatgacgatcaaagaaaacagttatactgcattagtagggcataccggaagcgggaaatcaaccttacttcagcatttgaatgcgcttgttaagccaacaagcggtacagtccatattggagaacgagatattcagccggatacggataataagaatttaaagcccatccgaaaaaaagttggcatcgtctttcagtttccagaagcacagctattcgaagaaacggtagcaaaagacattgctttcggtcctaaaaactttggtgtcagcgaagaagaagcactagtcctagcaaaagaaacattagaacaagttgggctggatgaaagctatttggaacgttcgccatttgaactttcaggagggcaaatgcgtagagtagcaatcgctggtgtgcttgccatgaggccggaagtacttgtattggatgaaccaacggcaggacttgatccccagggcagaaaagaaatgatggagatgttttggcgtcttcataaggaacagcagatcactattgtattagttacgcatttaatggatgatgtagccaattttgcagattatgtctatgtgttggaaaagggacgaatcgttaatagcggggagccgcaagaggtctttcaaaacattgaatggctaaaagaaaaacaactaggcgtacctactgccaccgagtttgcagaagaattaatggctaaagggatgaactttgctaccttgcctttgacagctgagaattag

SEQ ID NO: 2377 - DNA (genomic), 207 bp, Enterococcus faecium; double-stranded, circular
  misc_feature (B) LOCATION 1...207
  hypothetical: NO
  anti-sense: NO
aagaaagacaggagtttgctgcgtatggaactatattttacccgacatgggaagacacaatggaatcaggaaagacgttttcaagggagcaatggcgattctccgcttttgccacaaagttacgaagaaatcaaagcatttgggaaaaaggtaaaatatgttccttttaaagcaatttattccagtacaggcaaagcgagcacgtga

SEQ ID NO: 2378 - DNA (genomic), 222 bp, Enterococcus faecium; double-stranded, circular
  misc_feature (B) LOCATION 1...222
  hypothetical: NO
  anti-sense: NO
ttattttgcaggaggacaatttatttacacaaaattattgacgctccctccaaatcgtcaattgttcttaataaagtagaatacaaatcattaatttgttgttttaattctccaacttcatcattagagctaacttttaaactcatttttttatcaagtttcatcattttatcagtaacaatttttatttcttgtatattattttttattgattttgcataa

SEQ ID NO: 2379 - DNA (genomic), 1077 bp, Enterococcus faecium; double-stranded, circular
  misc_feature (B) LOCATION 1...1077
  hypothetical: NO
  anti-sense: NO
ttattttgcaggaggacaatttatttacacaaaattattgacgctcccaagttgacagggaatcctaaaaacattcggctttttttatataatctttttaactcaacagagataagttttgtggaattgtatacgctacctataattataaaaacagaaaaaatgttaaaagatttaaaacagtattatcctctgtctgcttatgaaaaaaagaaattattccactttttagcaatcaacctgttggctgaacaagctgattctttagatattgctagcaatcagtcgctatttttttcggatataggattttaccacttaaaaggagtattaggagaaaaatccgttatttttatcaataagacactctcttggctttatcttcatgataaattggatcaaaaatacttgagaaaaaatgaagatgaaacaatcgaatggttgaatgaacgattcattgaaagttttgaaaatcagtttaatctgttgcgagaagagacgagccaattgatccgaagagagttaaccaaaatacattttaaacttttgcattacactattaataaagctgatgaatttccacttgatgtttctttttttagagaaaactatccagcattttattgctatttgatagagtatataaatgatctaacgtcaaaacgcaaagagttgcttcaagataaattttttctttttttcagttatttattattattgatcaatcacatacccattcaactgatttctgaaccagtaaagatcatcatcgatttttcttatggtgctgcctataatcaatttatcaagaaaaatttaagcttgtacattaatctgaacacggaagtgatagaggcaggaaagcctgagttcccggatgttataatcacgaataggaataatctatatgaagaaagtgcatctcaagtagtggtttggctcgatccgccaagagcagtagactgggggaatcttacaaagattttgttgactatccaagaagagaaatacaaagacagcaaaattgacaagcaaatagacgattttcctgaagaaatcatcgacaggatcgaatag

SEQ ID NO: 2380 - DNA (genomic), 216 bp, Enterococcus faecium; double-stranded, circular
  misc_feature (B) LOCATION 1...216
  hypothetical: NO
  anti-sense: NO
ttattttgcaggaggacaatttatttacacaaaattattgacgctcccaagtttttttgcgaaaactatttttatatcatatatatgtctaaaatctatattataaaagaaatgttgtttgatcagcttctcttcggtattagttcaaaacaaaacggcaaagtatatggagctactttgccgttttgtttctctaatactcaggtcagtttatag

SEQ ID NO: 2381 - DNA (genomic), 324 bp, Enterococcus faecium; double-stranded, circular
  misc_feature (B) LOCATION 1...324
  hypothetical: NO
  anti-sense: NO
ttattttgcaggaggacaatttatttacacaaaattattgacgctcccaagttgacagggaatcctaaaaacattcggctttttttatataatctttttaactcaacagagataagttttgtggaattgtatacgctacctataattataaaaacagaaaaaatgttaaaagatttaaaacagtattatcctctgtctgcttatgaaaaaaagaaattattccactttttagcaatcaacctgttggctgaacaagctgaatctttagaatatgctagcaatcagtcgctaattttttcgggatataggaaatttaccacttaa

SEQ ID NO: 2382 - DNA (genomic), 465 bp, Enterococcus faecium; double-stranded, circular
  misc_feature (B) LOCATION 1...465
  hypothetical: NO
  anti-sense: NO
ttgatttgcagaaaaaaagattttgatgaagcatatttggcagaatgcgtatgggcaattagcgaaaatgcttatccatatggctcaccttggacgaagatgcagtttttgacagatatccaacagccccacacagattatcttcttttagttgaagataaccaaatctgtggttttgtcgggtattcgaaagtaatggatgaagtcgaaatcacaaatatcgctgttgcagtttcagaacaaggaaaaggctatgcacggcatttactacatctgctgattgcggaacaaataaaagattcgctgcatgtttttttagaagtacgtctgtctaatgaagcagcaagaaaactttatgaatcagaaaagttccgtatattaggtaaacggaaatcatattatcgcaatccgacagaagatgcgatcattatgagcagaaagttaaaaacggagacgatgaaatga

SEQ ID NO: 2383 - DNA (genomic), 1797 bp, Enterococcus faecium; double-stranded, circular
  misc_feature (B) LOCATION 1...1797
  hypothetical: NO
  anti-sense: NO
aacacttgcagtttatttaccaagattgttaaggagaagattatggaggaacgaatacagaaaagttatcaaaaatatcatgcaaatgcttttcagacattgctgcatctttatcagggaaattattggcgttttgccatgtcaggactcttttttattatcaaacatcttccatcttggttaatgccgatcgctattgccaatgtaatcaatgcagcttcatcgaaagattcttctcagttgcaggccatttatttcaacgcttttttgatggcttgtctgattggtcaaaatatattgacgaattattttcatgtaaaataccatagcacttcgatccgtcaagtagaagctggactaagagcgacccttatcaagaaaatccaagaactatctattccttatcaaaaagaattgcaatctggacgaatccagtcaaagatcatccgtgatgtagaagctatccaaacgttgtcctctcaagtatttgtcagcggattaaatatcgctgtcaatttattcgtagctttaggtatcacgctttataaaagtcctgttgttttcatgtttttcttattgactgttcctctcgccgcattcgttactctctttttccgtaaaaggatcagacagtccaactcagacttcaggcaagaaatggaagagacttctgcaaaagtgatcgaagtgatcgaattagcaccgattgctcgagctcatgggttagaaaaacacgaaacaactcgcttaaataagcattttactcaaatctatgaaaaaggattccacttagatatcctgcaatctgttttcggatcagtcagctgggctagttttcagatatttcagctgatttgtttgattttcactgggatattagctttacaagggcgcatccaacccggcgatgtcgtgatgtatcagacgtatttcacgacgatcgtcaattccgtttctggaatgatcacgctgattcctacgatttcaaaaggcatggaatctatcacttctattggcgaactgttgattgctggcgatgtagaaacttatcacggtaagaaaaaaatccaacatttggatggaaattttcgttttgaggatgtttcttttctttatccggactcactcaaaccgattatcgatcatttttctctagaggtgaaagctggagaaacaattgcttttgttgggccatctggctctggaaaatctacactccttaacttattgattggatttatccagccgacttcaggaaaaatttttctagatgatcagcctttggatgaactggatatgcgaagtgtgcgaaattatttagccgttgttcctcaaaccactttgttgttctccgcttcgatcaaagagaacatcacttatggcttgaaaaacgtatcaaaagaacgtttagatgaagtcatcgaagctgcgcaactttcttcactgattgaccagcttcctgatggtctggataccttagtaggcgaacatggcaacaagctgtctggtggccaaaagcaacgtatctccattgcacgagcgttgatacgtcagccaaaaatcattttgctagatgaagcaacctcagctttagataaccagtcagagaaaaaaatccagcaagccctgaattacctgacagaaacacccactacttttattgtggctcatcggctttcaacgatcaaagaggcagataaaatcgttgtgatcgatgaaggaaaaatcgttgaaataggtacttacgaaaaactgttagctcaaaaaggctatttctaccgcttgaaaaatgaatga

SEQ ID NO: 2384 - DNA (genomic), 204 bp, Enterococcus faecium; double-stranded, circular
  misc_feature (B) LOCATION 1...204
  hypothetical: NO
  anti-sense: NO
agaagctgcagcattgtcttgacgcagctggataacagcataaggacgtttgccagttttaggatcttccaatccaactggtttcataggtccgaaaagcatcgttttgaatcctcgctgtgccattacttcaattggcatacatccttcaaaatatttttctttctcaaaagatttaagttctgccacttcggcattgattag

SEQ ID NO: 2385 - DNA (genomic), 345 bp, Enterococcus faecium; double-stranded, circular
  misc_feature (B) LOCATION 1...345
  hypothetical: NO
  anti-sense: NO
tcactatgcagtacttccaccatttccgtacggataaaccgagcagagtcagcaagcggcgacatggccaacgcaattgttggtaagattgtgtacacaaagccatcccattttgcgattggcaaaacttgtaatttgattgcaaagatatattgtaataaaacagcaaatacaaagtttggaatggaacgacctaatatcgctacgagtgtagaagatgtatctgcccatgtattttgcttcatggcagagatcgttcctaaaatcgtccctaggactgttccaaagatatttgcctgtaaccccaactgcaaggatgttcgattagccagaacacgaggttcg

SEQ ID NO: 2386 - DNA (genomic), 1131 bp, Enterococcus faecium; double-stranded, circular
  misc_feature (B) LOCATION 1...1131
  hypothetical: NO
  anti-sense: NO
aaaaaatgcagagaaagagtgaataaatttatggcattgactgctggaattgttgggttgcccaacgtaggaaaatcaactttgtttaatgcgatcacaaaagcaggagcagaagcagcaaactatccctttgcgacgatcgaccccaacgtagggatggtagaagtacctgactggcgtttgcaacgcttaacagaacttgtacatccgaaaaaaactgttccgacgacttttgaatttacagatattgctggaatcgtaaaaggcgcaagtaaaggagaaggtttgggaaatcaattcttaagccatatccgccaagtagacgctatttgtcacgttgttcgctgttttgatgatgataatattactcacgtagaaggacgtgttgatccactagaagatattgatacgatcaacttggaactagtgttagcagacttagaatctatcaacaaacgctatactcgtgtagcaaaagttgctaaaaccaaagataaagatgcagtggcagaactagctgtactggataaaatcaaacctgtactggaagaaggaaaatctgcccgaacgatcgaatttactgaagaagaacaaaaaatcgttaaatcactatttttattgacgacaaaaccaattctttatgtagccaatgtctcagaagatgacgtagcagatgcagacgcgaatcattatgtacaagaagtgcgcaactttgctgcagaagaaaatgcagaagtgatcgtggtcagtgctcgtgcagaagaagaaatcgcagaattagatgaagaagacaaagcggaatttttagaagctttaggaatcgaagaatcaggtttggatcagttgatccgtgctgcttatgatttgttaggcttagctacttactttactgctggggaacaagaagtacgtgcttggacattcaaaaaaggaatcaaagcaccacaagcagcaggaatcatccattcagatttcgaacgcggatttatccgtgcagaaactgtctcttttgaagacttggatcattacggaaacatgcatgcagcaaaagaagctggacgtgttcgattagaaggaaaagattatgtcgtacaagacggcgacgtaatgttattccgctttaatgtgtaa

SEQ ID NO: 2387 - DNA (genomic), 321 bp, Enterococcus faecium; double-stranded, circular
  misc_feature (B) LOCATION 1...321
  hypothetical: NO
  anti-sense: NO
cagaaatgcaggaaaaggtcacaagcttcaggaggtctctttgacttagaccagctggaagaagacattgcggaagcagaagcaaaaatggctgaacctggtttttgggatgatagcgaagctgctcaaaaagtgatcagtgaaaacaatgcaaataaagaaacttatgatcaattccattctcttgctgaagaactggaagaaatcgaattgatggtggagatgttgcaggaagaacctgatgcagccatgcaagaagaagcagaaacacgtatcaatgcgctagatgaaaaaatgaagacatatgagtattcaccacag

SEQ ID NO: 2388 - DNA (genomic), 342 bp, Enterococcus faecium; double-stranded, circular
  misc_feature (B) LOCATION 1...342
  hypothetical: NO
  anti-sense: NO
tgcccgtgcagagacagtagaagaaaaaaagacctttcatcaaccatttttgcaaaatcgttgtgttttcccaatgagtggaatgaagaaaaagacaaatttatgttttcaaataaggaaaaaatagtgtatattggcggtttttatcgtagccatcaggatgaaaaaatggcagaatcaatcataatgactactgaacctaaccgcacagtcgcaccaatccatgaccgaatgccgcttgtcttgactgaagaacaaatcgaaccttgggtaacagatatttcttttgcgcgaaaaatcattactcagcagatgcctgaattagtaatggagaaggtataa

SEQ ID NO: 2389 - DNA (genomic), 213 bp, Enterococcus faecium; double-stranded, circular
  misc_feature (B) LOCATION 1...213
  hypothetical: NO
  anti-sense: NO
tatactcgcagggtcttttcagacctgcgggttcaagaattaaaaagtggcattcgccatggaataatggcatttttagaaaaacatcttgcgggcaattgccggccgctcattgggtcagggttaaattccccggaatatatttcccggcgctggggtacaattaaaaagggtccccgaatgggggattgctatctgttaccgttgaaagga

SEQ ID NO: 2390 - DNA (genomic), 195 bp, Enterococcus faecium; double-stranded, circular
  misc_feature (B) LOCATION 1...195
  hypothetical: NO
  anti-sense: NO
atttttagcagatgctcatacaggaaccgtattagaaatttcaagaaaaaaaggtgcaacagattaatacgtcaaaaaagtgagagaacgaatacgcacccactattcaaaagagaggtatcatgtccttcttttgtagtgggtggttttttaaataaagctttccaaacatatattccagtattttctttttaa

SEQ ID NO: 2391 - DNA (genomic), 234 bp, Enterococcus faecium; double-stranded, circular
  misc_feature (B) LOCATION 1...234
  hypothetical: NO
  anti-sense: NO
ggagttagcaggagaacactatttgctggagaggttgtgacaaaaattttgtcacaacccttttgtttcgaaatgaagacaaggagaaaaccaatgaaattcatgacactcaacacgcatagctggcttgagccagaaccagagataaaattgccagaattagcagataagatcctgttagaagattatgaagtgattgctttacaagaaaatcaaccaattactggaatctga

SEQ ID NO: 2392 - DNA (genomic), 234 bp, Enterococcus faecium; double-stranded, circular
  misc_feature (B) LOCATION 1...234
  hypothetical: NO
  anti-sense: NO
agtcctagcagcattcgctcaatggggattagaacaggaggaagtgggatgaaaaagacaataaaaacagaagaagcatatattgaagtatttgacacacaagcatgcaacatgggcgtacacatatactcaaacactgatccagatatgtttgttgaaatatacttaagtcaaagagaatataaagcgctatacaagattttaggcgagtttgctaaggaggaaaaagaatga

SEQ ID NO: 2393 - DNA (genomic), 2127 bp, Enterococcus faecium; double-stranded, circular
  misc_feature (B) LOCATION 1...2127
  hypothetical: NO
  anti-sense: NO
atggctagcagtttatataatttggctttagatttcagcaaagaattaaactacaccaaagctattatggctcgtcaaggtgataaagggattacggtgacggttaaaccgtttctaaatggcttgcagatggatacgagtggcggaacatttactttaaaaggaacaacaccatctaaccgttacgtagataatgttgcaactagtgtaactagtgaagaagtcacgttttctcttgatggcacatttatgagtgaagcaggatattataaacactgctacgtagaatatagaaaagacaatcaaattttaacaacgcaagatatcatttttttctcactaggagtgtctgacatttcgcaaggccaagccgatgaatatgtttcgcaattagaagagttgattcgaaagtacaacgaaacttttgatgcttttatggctgaaatcaaaggtagagtggatagcttaaatcaacagattactgatttaactggtcaagctaaaacgctacaagacaagttagatgctctgaaagaagaaatttctaagttaggtaacttacaagtgatgtacagtaacagcatcgacttcggggactatgattattcggagaacccgaatttaatgccatatattacagaaccttgggttggacctttgttaggtaatggacatacagttaaagatagtgttaaaagggttataactcatactaaaactagaacagctaattccggcgacatattatcgcttggcttaggtattccgtgtacagcggaagctaataataggtatcttataaccactttacgaccatctacgacatacacattaagcgttactatgagtgtcggttcagattggactggagagaccaatactataggggttaggcttagatatttaaatgaacaaggtggtatagaactgcccattaatgcattaataccagcaaatgtagaacgcgataaaatggtcactcatacatttactggtataacaaaagataatgtaactagcataacaaactgttatgttgaaatattctcacttaatagtgaatataaaggaacggttagtgtcagctatgacgttaagttaaaagcacactaccctaacttactagatggcccttactggttaggtaaagttcctttaggcgagaatattgctgaccctacagttgtctttccacacaaaactagtgaatatatggtttatggtagacgcaatacagaaaactatatcgctgaccaaacatataccatatcaatgaaagcaactaaactaacagttcaatcgtttgccgtgtatattgctgctggccgcgttaaagtaggagacatgaagcctactgaggggttagctaatacatgggagttaacttttactgtaactaagcaacatatagatagtggggtaactaattatctggaaatataccaatacccgtcagctacaaaaggagctgttcaaattgagtggctcaaactagaaaaaggcaatactcgaaccccgaatattagtgagtataaatatcgtggtactggtatgcgtgattcaaacaatccaaaagattatgtttgggatctagcaccagaatatgtcgaagataatttggccacagatattaaaatttctgaaattactggtaaagcaaacaattataccgatgggaaagtatcggagattaattcgcagttgactgcttcaattaatgaagtagacaccacagctaaggatgctcaaacaaaagcgaatgctaatgcgactgctatagatgaattagacaataagatcgatgaacgcattaatgatacagctactaccacattaacagttacaaacgggaataccggatcagcaaagctttatcgtgaaggaaaaacagtttctatatattttgtggctttaaacggaaaaagcagtggtggaaatgattcaacgatactaacaattccagaaggctatcggccaccaattagttttgagcaactggttggctcgatagaccgttctactttgaacagtgctcagttatctattggtgcagatggagccattaaatggcgaagaaactcaagttatggatcggattatacctttgcaattacttacacgatttag

SEQ ID NO: 2394 - DNA (genomic), 225 bp, Enterococcus faecium; double-stranded, circular
  misc_feature (B) LOCATION 1...225
  hypothetical: NO
  anti-sense: NO
tattgtagcagttacagtgaagcaaaaataaaagaggttgtgacaaaagacgtgtcacaacctcttgataaacggtgttcaaaagccagtttctcggtagtaagtcaaatttatgcaaaaatgtggaaacccatgtttacaaaatttttcttactactcgaaacgaagcggctttatcacaacctcttgataaacggcgttcaatcagctgtccctcggtattag

SEQ ID NO: 2395 - DNA (genomic), 1035 bp, Enterococcus faecium; double-stranded, circular
  misc_feature (B) LOCATION 1...1035
  hypothetical: NO
  anti-sense: NO
agaagaagcagagcgcttagtgattcgaggattcctcggttctgtcttaacagcaatccctgtagaacaagttcggaaagaattagtcgaagtaatcgaagggaagttgaatggatgatcgatgctaaaaagctacgcaatgattttcctatcttatttcaagacgtcaatgatgaacctttagtttatctggataatgcagcgacgacccaaaagccaaaacaagtactccaggcattagcgtactattacgaacacgataacgccaatgttcatcgcggtgtccatacgttagcagaacgcgcgacccatgattatgaacaagcaagagaaaaagtacgggcgttcatccatgcaaaagaaacagcagaagtgctgtttactcgtggtacgacgacaagcttgaattgggtagccagaaccttcggcgaccgctatatcaaagcaggagacgagatagtgctctcttacatggaacatcattctaatgttatcccgtggcagcagttggcaaaacgaacaggtgctgtcttgaaatatatcgaactaacagaagaaggcttcctggatatggaggatgcagcgaaaaagattacggacaaaaccaaaatcgtctccattgctcatgtatccaatgtcttaggtgtcttcaatcctgttcaagaattagctgaacttgtccatgaaaacggcggggtcatcgtagtagatggtgctcaatctgccccgcacatggccattgatgtccaagcactagactgtgatttctttgctttcagcggacacaaaatgtgcggaccaacaggtattggtgttttatatggtaaacgaaaatggttagaagaaatggaacctgttgaatttggtggcgaaatgatcgattttgtcgaattatacgacagtacatggaaagaactaccttggaaattcgaagcagggacaccaaatatcgccggcgctatcgcattaggccatgcaatcgattatttgcaaaaactcggtatcgacaatatccatcgatatgaagaggactag

SEQ ID NO: 2396 - DNA (genomic), 999 bp, Enterococcus faecium; double-stranded, circular
  misc_feature (B) LOCATION 1...999
  hypothetical: NO
  anti-sense: NO
agatggagcagggaatttttccgcagtttgcgtgatgtcggtatttctgcagtgattgtttctgatccagctttgatcgaaatttgtgcgacagaagccccaggtctgccgatccatttatccactcaagcttcagcaactaattttgagacattggaattctggaaagaagaagggttggaacgtgtcgttttagctcgtgaagtttcaatggaggaagtggcagagattcgtaaaaatacggataccgaaatcgaagcatttatccatggtgccatgtgtatctcttattctggtcgatgcacattgtccaaccatatgtcgatgcgggatgcaaaccgtggcggatgttctcaatcttgtcgctggaagtatggattgttcgatatgccttttggtcaagaacgaaacagtttaactgatacaggcgaagtggaagaagaattctcgatgagtgcagtggatatgtcaatgatcgaacatattccagaattgattgaaaacggcgtagacagcttcaagatcgaaggaagaatgaaatcgatccattatgtatctacggtgtcaaatgtctataaagcggctgtagacagttatatggaagatcctgaaaactatgtctgcaagcaagaatggatcgacgagttatggaaagtagcacaacgagaattagctacaggtttttactacaatacaccaactgaaaacgaacaattattcggtgaacgtcgtaaaatcccagtatataaatttgtcggtgaagtattatcttatgatgaggcaacacagattgctacgatacgtcagagaaacttgttttctgtaggagatgaaatcgaattttatggtccaggattcagtcatttcagtcaaaccgttgaagttatgcataatgaagaaggcgaatccattgaccgagcaccaaatccaatgatgattttaactatgccagtcgcacagccggtgaaacctggagatatgatccgaaaacgtaaataa

SEQ ID NO: 2397 - DNA (genomic), 222 bp, Enterococcus faecium; double-stranded, circular
  misc_feature (B) LOCATION 1...222
  hypothetical: NO
  anti-sense: NO
aagtggagcagtttgttgccctggatggagctatctattgccttgagtggagcagttattcacctcactggagctatttatctgcaatactcaacttgtttaaattttttttcagtaactaataggagtcaatggcaatacgtacatccatgtattctaaagtggtacaaacaaggggattatccatcggttttctttcaaacgagcttagagttgccctga

SEQ ID NO: 2398 - DNA (genomic), 1170 bp, Enterococcus faecium; double-stranded, circular
  misc_feature (B) LOCATION 1...1170
  hypothetical: NO
  anti-sense: NO
caaaggagcaggcacatgagtagtttttttcaaaaacgtttagcaagacatcaaaagaaaatgatgaaatatatgcgttatgtattgaacgatcattttgttttagtttgtcttttcttgattggcggtgtgggattatattattctaattggttgaaaaccctgcagccaccgtttgcaattggagggctcataatctctgtattttggatgctctgtttattcgtgggtaagatggctacttttgcagaggcagcagatattgtttttttacttcctaaagaaaaagaaatgcaaacctatttggaacgagcttttcgctattcttgcatttttccgttgatctttttgatattggcatgcggattggccatgccattagtggtggttagtacggagcaatccttttcgatgtttttcgtctatctgatcatattatggagtttgaaattcagtcatctgcaaatcaagagagcagaattgtttcgactagatcaacaagttattcgttattggaaattaggctggtttttttcttctctgatctttttgtttctatcattttattggctaatatgggcaggaatagcaggtgcattagtacaggcaagtctatattactggtttttgtggaagcaacaagaaaaaggattggattgggagaaaatggtgcatgtagaagaacataggttgcatcagatctatcaatttatcaatttattcacagatgttcctgaaattacggcaaagatcaaaagaagacgctatttggatcctatattgactcatattaaaagagaatcaaaaaacacttatctttacttgtttgcaagaagattggcaagaggttctgattttagtggtctttatttccgattagtaattataggtgggttattgattgccggagtagtcgacttttattttagtctgattatcggtttcttatttttatatttgatcggtttccaactgttacctttagcgaaccagttccgctatatggttctcgttcagctttatccaatccataagaatcagaagaagcaggcgattcagtatctactcacatgggtattaattatcgcgtcggttatttttggtttgattgctgcagtcgtattagatgggcagcagcgatgggttccgctagcggcttatttgattgtt

SEQ ID NO: 2399 - DNA (genomic), 450 bp, Enterococcus faecium; double-stranded, circular
  misc_feature (B) LOCATION 1...450
  hypothetical: NO
  anti-sense: NO
tattttggcagcaaggaagggctgatttatgaagtattttttgcatttatgaatgatttagggcaagaagcgaaagcgttgattgcggaaaatcttccatttgaagaaacactgattgccatgagtgaaaacaaaatccgttatctcaatcgagtgaacaaacaattttatatcgatttgatgacatactatncnaaaaaagaaaaaaaagaattttctgacgcgatggatgcgtatacgcaagaaagtttcagtatcatgcttgatcttttccatcgaaggcggaaagaaggaaaagtggatttgaaatattcggatgagttcttgatcctctattttcaagcaatggtagaaggaatttctaagccggagatatacgccaaactgcttccatatacagcagaatggacagaagtcctgattaagggaatcgcaccgaaaaagatataa

SEQ ID NO: 2400 - DNA (genomic), 1044 bp, Enterococcus faecium; double-stranded, circular
  misc_feature (B) LOCATION 1...1044
  hypothetical: NO
  anti-sense: NO
aagagtaggctttatggtatgataaaagaaaattttaaaaggagtgtctcacgaatgaacgcttttcgatcttttcaggtaataaaggaacctgttttccatacagcaatcagtgatctgccatttactgagttggctgaaaatgaagtcttggtaaaaattgcctattctgatgtcaattataaagatgcattggcaatgagcgagtctggtcaggtgatacgaacatatccgatgactccagggattgatttatccggaactgtcgtccaaagtaacaatccacgtttttcaaaagaagatcttgtacttgctactggttttgggcttggcgtcacccatccaggcggttatagccaatatcaaaaagtaccaggagactggttagttcctctaccaaaaaatatgacgctgcgtcaagcgatgatccttggtacagcagggtttactgctatgttgtgtgtgaacgctttaatccgtcaaggtatgacctccgataaaaaagttgtcgttactggtgcttctggcggtgtaggcagtacagcgatagccctgttacataaactaggattccagtcaatcattgccttttccagaaaagaagagtctgtcacatggctaaaaagtctaggtgctttgcaagtcgtacgacctgatgaatttctgccagagacaacaaaagctttaggaaaacagcaaatcgactatgtcatcgacacagtatgtggcgagcagctaagcagtcttcttccattgatctcttataacggtgcagtagctttatgtggcaatgctgggggaatcaaactaaacgcgactgtcttgccttttattctgcgaaacatccagttgattggaattgattctgtcaatgtaccaatagatcaacgtctttctttatggcaacagatggcggatttgcagattgcagatgaactggtcgtccaagagattactctggatcaattgcctgaaacagcatctaaactacttgctggaacacaccaaggaagaacactagtaaatgtaggtgaccataaatga

SEQ ID NO: 2401 - DNA (genomic), 306 bp, Enterococcus faecium; double-stranded, circular
  misc_feature (B) LOCATION 1...306
  hypothetical: NO
  anti-sense: NO
aattttttaagaatagagggaaaaaacatgaattactggatgaacacaatcattaatcgattagaaacagcatatcaaacaagatttgatatgaaagcttctttagtctttttaaatgatgcgtatcaaaactcgatcgaattgatcaaagcagtggatgagaatccaacaaacgaatgcgaagaatttttaaatctgtttatgtctacaagagatttatttattcgccaacttgttgatcgctatccatccaattatcacgatgtagaagttcaaatacaaaaattaaaagcatattcagcttaa

SEQ ID NO: 2402 - DNA (genomic), 189 bp, Enterococcus faecium; double-stranded, circular
  misc_feature (B) LOCATION 1...189
  hypothetical: NO
  anti-sense: NO
attgttttaagcacactattaaacagtctaatatggcaattatcaacatctgaatataaggaaattttgaaggctcgtgcagactatatgttttgtgcgggcttttttcttgctttcttttttacattaccaaaaggtataggcggtattcccgtttatatatttcggcgtatgcagaaaggggggtga

SEQ ID NO: 2403 - DNA (genomic), 807 bp, Enterococcus faecium; double-stranded, circular
  misc_feature (B) LOCATION 1...807
  hypothetical: NO
  anti-sense: NO
aagagattaagaggaaataagaggaggaacatgatgactgagtcagtttatgtacatattgataccacaagtaatgctgttttaacaaaagggctgactgctactgactttgcaaacagtatcgtgcattttcctcaaaacttgctcttgcttgatccatctgcttctgctggagaatatgaatcccatacagggctgaaagtaatccgtggtacagaaaatattcagcgtttcttttcctcttctcgtaacaggcgtggattcgatgaattgaagtggatcgactttactgatttaacgatgctgaaagaattgacacctttagaaatttcagaattattatattttggtcatatgaaaacacatcttcattcgccgtttttttataaactacagaataattttgtatacttcgatcttaatgatcagctgaatcggatttattatcgctatttagatgaattttataggatttttgctagtaaattaagttcgatcttgtcagataagatcaatgtaaaaaaatcttttttcaaaaaagaaacacctgttgaaaaaatcagtgtggaattattgaaagaaatgcgtaatttgatgcaggaagggatcattttttcttttgatcaagttggtttgatcgatggtaaatatcgtatcccaatctatgtgattgaagattatatttggaaattaaaaggcacccggtatcgagaagaggaaatcatcgctactttaatctactctgtcaccgatcgacactggcaattggtagaagatgccgatctttcttatctgccattgaagtag

SEQ ID NO: 2404 - DNA (genomic), 1554 bp, Enterococcus faecium; double-stranded, circular
  misc_feature (B) LOCATION 1...1554
  hypothetical: NO
  anti-sense: NO
aaatggaggctatctgaaatgacaagagcattgatcagtgtatcagataaaactgggattgtagcattcgcccaaggtttgattgaacaaggagtagaaatcatttcaacaggaggaacaaagcatgcgttggataaagctgggatcaaaacgctttcgatcgaagaagtgacagggtttcctgaaatgatggatggccgtgtcaaaacacttcatcctaaaatccatggtggtcttttaggaagacgcgatctccctagccatatggaggcaatggaaacggaaaatatccaaccaatcgactttgtttgtgtcaatttatatcctttcaaagaaacgattatgaaaccagatgtcgaaatagcagaagctattgaaaacattgatatcggtggtcttagtatgctccgtagtgcagcaaaaaaccatgaatttgtcacctctgttgttgatccatctgactatgaagaagtactttcagaattacgtcagtatgggcatacttcactttctttcagacaaaaactagcggcaaaagtctttcgtcatactgcggcatatgatgcactgatcgctcaatacttaacggattgggtggaagaaaaagaaccggaaaaattgacacttacgtatgaacgaaaacaaacgcttcgttacggtgaaaatagccatcaagccgctgccttttatcagtccgctcttctggaaaaatattcgatcgcagcagcaaaacaactccatgggaaagaactttcttataataatatccgagatgcagatgctgcgctacggatcatgaaggaatatgacgagccaacggtagtcgccttgaaacacatgaatccttgtggtattgggacagcatctacgattttagaagcgtgggaagcagcgtatgaagcagatcctgtttcaatctttggtgggatcatcgttttgaatcgagaagtagatctgccaacagcagaacagatgcataagctgtttctagaaatcatcattgccccttcttatacacaagaagctttggaattactgcaaaaaaagaaaaacatccgattactgacagtagactttgcgcaggaagaaaatcaaaatcgagaagaaacggtctcagtcttaggtggacttcttgtacaagatcaagatctggcaatagaaaatgaagaagagtggaaagtcgtgacaaaacgtaagccgactccagcagaagcaaaagcattagcgtttgcttggagagctgtcaaacatgtgaaatctaatgcgatcgtactggcaaacgaacgtcagacagtaggaatcggagccgggcagatgaatcgagtcggttcagtaaaaattgcgattgaacaagcgcaagagaaaatggaaggtgcagttttagctagcgatgcttattttccaatggatgattcggttgaatatgcagccaaacatggtataaaagcaatcattcagccaggaggaagcatcaaagaccaagattctattgatatggcgaataaatacgatctagcaatggtctttactgatgttcggcattttagacattag

SEQ ID NO: 2405 - DNA (genomic), 255 bp, Enterococcus faecium; double-stranded, circular
  misc_feature (B) LOCATION 1...255
  hypothetical: NO
  anti-sense: NO
gaaataataagcgaaaggtggggaaacatgaaaagactgggtttgttttggctgattctgctattagttattgtggcattctacatggaaccagtcttgtttccgccaaaacttgaagtgaaggaaaactctgatcaacaaatatcaaaccaaatgacaacgtggaaataccaggagcttaaagcaactggtttttctacttatatcggaaaaccgatcgatcagctggaaaaggattttggcccaagcctatga

SEQ ID NO: 2406 - DNA (genomic), 882 bp, Enterococcus faecium; double-stranded, circular
  misc_feature (B) LOCATION 1...882
  hypothetical: NO
  anti-sense: NO
aaagtagtaaggatgggaaaagtgatgaaaaaaagaatgaagccgttaatctggccaattgctgtttccagtattttcttattgggacagacagcttttgcggaaacttctgaacctgctcaaacagaaccttcaacaaccataagctcttctggtgctgaaaacggtgcctcggaaacagaaatgacttccaatgtaccgacagataattcaggagaaacgatttcatcttcagaagatacatcaataaatagttctacctcttctgaccaaatcgatcatttgcaagacttggaaaataaaagaaaagaactcgaagaagcattagaagctgcaaaaaacaaattgaaagaagaccaagcagcaatcgatcaagatttagctgatcttaaaaataaagtgggaaatgaccgtgcacaacttgagaaaaagcttgccgaagcgaaagcaaaagcggaagctgtccaaacagatcttgacgggaagatccaacaagcaaaagaattcaatcagcaattaaatcaggttgctcaaacagcttctggaaagctaagtcaaactcaagcggatatcacagcggccagtcaagcaatccacggaaagatcagcgaagcacaaacagttgctaatgattttgaagcaaaaaaagctgacttagcagctagtttccaacgaataaaagatattttgcattcggcaggagaaaaatcagtgacctctggaagcacgacagaaacagttcagcaaacgacagagccatccaaatcaacaagtcagactttgccaaaaacaaatgaaaaaacagcttctgtcagttattccttagcaggggcgggtgtgttagtcgcagcagcttacggaatcatccgcaaaaagaaataa

SEQ ID NO: 2407 - DNA (genomic), 516 bp, Enterococcus faecium; double-stranded, circular
  misc_feature (B) LOCATION 1...516
  hypothetical: NO
  anti-sense: NO
attttttcaagtacttgtcatttgaggataaaaacaagtagaataaataataacaacaatggagaaagtaggaaaacgaacatgttaccgaatattggctattatgtgcagtccatcgatcaaatcgtcaaggaaacagaagcaatcggagaaggaatgcatccgaaatatgaagtgatcagaaacgcaattgatgaaggaaaaacaagtgaactggacaaatcgactcttgaagagatcatcctgttatttgaagaaggaacaaaaaaatatcgggcaatgcttatgaaagtcagtactttgcgtccaccagcaaaagcaatgggcattcataaaaattttgaaaaagcttatctttcatatgtagcaggctgtgaagaaatgatccaaagtatcgatcttgaatcaggggtagatgaagatctattcaatacatctgaagcaaaacaagaccaagcgacagaccaattgacagctgccatccaaaaaatgactaatttgttgttgaaaaaataa

SEQ ID NO: 2408 - DNA (genomic), 204 bp, Enterococcus faecium; double-stranded, circular
  misc_feature (B) LOCATION 1...204
  hypothetical: NO
  anti-sense: NO
ttagtttcaaggaggataatcatgaatatcaaggatttaatggtcaaagaagcgatgatcatggatttgcaagcgactgataaaaaaggcgcaatcgatgaaatggtccaaaaaatgtttgatgccggccggatttccgatatcgaaacatataaagaaggaattttagccccgcgaagcacaaacttctacaggtcttggtga

SEQ ID NO: 2409 - DNA (genomic), 1332 bp, Enterococcus faecium; double-stranded, circular
  misc_feature (B) LOCATION 1...1332
  hypothetical: NO
  anti-sense: NO
agaaattcaaggaatataaaaggagagtcatacgtggaacaaattcaaatcatcgattcgaaaaaccatgtgggagaaacagtaacaatcggcgcttgggtcgcaaataaacgatcaagcggaaaaattgcatttttacaattaagagatggaacagcctttttccaaggggtggttgtaaaaagcgaagtgccagaagaagttttccaaacagctaaaaatctgcaccaagaaacatctgtgttagtaactggagaaattcgtgaagacagccgttcaaaattcggttatgaaatcgggattacaaatgtggaagtagtaagcgagagccacgattatccaatcacaccaaaagaacacggaacagatttcttgatggatcatcgtcatttatggctacgttcttcaagacaacatgcgatcatgcaaatcagaaatgaaatcattcgtgcaacgtatgaattctttaatcaacatcattttgtcaaaatcgatccgccaatcttgactggttcagcaccagaaggcacaacggatctattcgaaacaaactactttgatcaaaaagcctatttatctcaaagtggccaattatatatggaagctgctgctatggctttcggaaaagtcttttcattcggtccgactttccgtgctgaaaaatcaaagacacgccgtcacttgattgaattctggatgatcgaaccagaaatggccttcactcaccaagaagaaagtttagaagtacaggagcaatatgtagccttcttagtacaaaatgttttagatcattgcgaatacgcattggatgtactaggacgagacaaagaagtcttaaaaacttatacaaaattgccattccctcgtattacttacgatgatgcaatcgaattactgaagaaaaatggatttgatgacatcgaatggggcgaagattttggttcacctcatgaaacgttcattgcgaattcattcgaacaacctgtctttatcctaaactatccaaaagccatcaagccattctacatgaaaccacatccaacaagagaagacgtggtgatctgtgcagatatgatcgcaccagaaggctacggtgaaatcattggcggaagcgaacgggcaacggactatgatttcttgttagaacaaatccgtgatcacggtttggatgaaaaagaatattcatggtatcttgatttacgtaaatacggttctgttccgcactctggttttggtctaggtcttgaacgaacagtcacttggattgctggtatcgaccatgtgcgtgaagctattccattcccacgtttgttgaaccgaatttatccataa

SEQ ID NO: 2410 - DNA (genomic), 690 bp, Enterococcus faecium; double-stranded, circular
  misc_feature (B) LOCATION 1...690
  hypothetical: NO
  anti-sense: NO
aagaattcaagaaaattttatggttatcgtagagtcactttagcgttaagatggaaaggatatacaatcaatcataaaacagttaaaaaattaatgtcccaaatgggacttacctgtcaaatccgaataaagcgatataaatcttataaaggaacagtaggaaaaattgccaagaatgtgttaaaacgaaatttttcagtagatacacccaataaaaaatgggtgacagacgtcactgaattcaagataaaaggaagaaaaatctatctatctcctatacttgatttatttaacggagaaataattagttatagtatatcaactagtccaacatataaactgattgaagaaatgcttcaacaagcaattaaaaaaaagggaactgagggttcactgattctacattcagatcaaggatggcagtatcagatgccacaatatcaaaaaaaattaaaagagaataacattattcaaagcatgtctagaaaaggaaattgcttagataattctgtaatagaaaatttttttggtgtgcttaaatcagagtttttttatcgagaaaaattccgatcaattgagatatttcaaagtaaattaaatgagtatattaggtggtataataacaaaaggataaaactaaagttaaatggactatctccagtagaatatcggaaacagtccattaaatag

SEQ ID NO: 2411 - DNA (genomic), 2376 bp, Enterococcus faecium; double-stranded, circular
  misc_feature (B) LOCATION 1...2376
  hypothetical: NO
  anti-sense: NO
gtcagttcaagggggagtaagaaaatgttagtttcatataaatggctcaatcgttatgtagatttatcgaatgtaacaccaaaagaattagcggataagatgtctgtgacaggaatcgaagtagagggagtaacggttccagaagaaggcttgaaaaaaatcgttgtcggtgaagtcaaggaatgcgtaccacatccagattctgatcacctttctatttgtcaagtcgatattggcgaagacgaactgtctcaaatcgtttgtggagcgcctaatgtgaaggttggaatcaaagtgattgttgcacttcctaactcacgtatcgctggtaatgtaaaaatcaaaaaaggaaaaatgcgtggccaagtatcaaatggcatgatttgctcattacaagaaattggctattcagatagtgttataccgaaagaatacgctgaaggtatctattatatgccacaagaagctgtaaatggcgatccagtttttccttatttggatatggatgattcgattattgaattatctatcacaccgaatcgtgcggatgcattgtcaatgcgtggcgtagcttatgaagttggggcaatttatcgtcagactcctacattcgatgacgaaaagctggtagaatcctcacgtcctgctagcgataaaattcaagtggaagttgaagataaagaagcagttcctgcttatcaaatcagaatcattgaaggagtaagaatccagccaagtcctcaatggctgcaaaatcttttgatgaacgaaggcattcgtccaatcaacaatgtagtagatgtgacgaactatattttgcttttattcggacaaccactacatgcatttgactacgacaaattgaaatcaaaagagatctttgtccgccgtgcaaaagaaaatgaaacattagtaacactagatggagaatctcgggaattgacaactgacaatctcgtcattactaacggcaaagaaccagttgctttagctggtgtcatgggagggttagactcagagatcacgaatgaaacaacaacagttgcactagaatctgctttatttgatccaatttcgattcgtcgtacagcaaaacaatttaatttgcgtagtgaatcctctgcacgttttgaaaaaggaatcaaccatgcgactgttggagaagccagtgaggttgctgcagcaatgatcgtttctcttgcgggtggggaagttctacaaggcgcggtcaaaggctcagagatcaaagcagaagacgtatcagtgaagatttcacttgaacgcatcaatcaatatttaggaacatctcttgtcgttaaagaagtaaatgagatttttgaagcacttggatttagctatgaagaaaaggagtatgtttattccgtagtagtaccaccaagacgctgggatatccaaatcgaagcagatattatcgaagaagttgctcgtatttatggatacgaccagttgccatctacacttccaagtggagaaacggttgctggaagcttgtcaaaagaacaagaaactactcgtaaaattcgtacaatctttgaaggaagcggattgagcgaagcaatcagttatgcattgacaacagaagaaaaatcaagacagtttgttataaatgaaagtaatattacacgtttggactggccaatgagcgaagaacgttctgtattacgaatgaatttgatcagcggactattagatgatatcagttataacactgcccgaaaaaatacagagattgctttatatgaaattggtcgggtgttcttccaagaaaatgatccacgtacacatctgccgcaagaagtaaaacatgcagcaatcgctatttctggtatttgggaagaaaaagattggcagacgaaagctcaaaatgtagactttttcaccatcaagggtcttttagaaaacttatttgaacaactaggcatcactgaagatgtccattatcaaacagtgacagaaatgaaggaaatgcatcctggaagaactgctgcgatttaccttggcgaaaaatttattggttttgtcggtcaagtgcatccaacgattacaaaaagttatgatattccagaaacatatgttgctgagtttgatttatctgctatagtggaagctgctcaaaaagggatcgttttcgaagcagtgacaaaattcccagcagtcagccgggacatcgctttgcttgtaaaagaaactgtgacaaatcaggaattaacagaagttatccgttctgctgccggaagatttttaacagatatccaattatttgatgtctatcaaggagaaaacattgaaaaaggacataaatccatggcgtatagcctgacattcgttcaacccagaagcaacattgacagatga

SEQ ID NO: 2412 - DNA (genomic), 1233 bp, Enterococcus faecium; double-stranded, circular
  misc_feature (B) LOCATION 1...1233
  hypothetical: NO
  anti-sense: NO
cttttctcaagtacagggaggaatggaacgatgccaaaaattaaaaatatttaccaagataaaaagacaaaaaaatggttcttccgagcgtatctaggtatagatgaaaatggaagaaaggttcagaagactaaacgaggttatgcttcacaaaaagatgccaaaattgcttatgacaagtacatggaaacacatgattttaacaagacaattcctaatcaactgtgttctaccaatcaaatgactttcgaagagttttacaaggataggtttgtaaaatggtacgagagacaggtcaaaagtcaaacatatgagaatgcgcaattcattttcgaaaagcgtatgcagtttttctatcattttcgtgttcgagatattacaagtcacgatattgaggattggttatttgaactaagccagacagagtcacgtaattcacggaaaaaagttaatggcgaaacgttatcaaaatcttatatcaatcggattcgagggcacctaaaaattgtattggatcgggctgttaaagagggggtgattgctaaaaatcccgttgaagatgtttcttcgcttccttctgagaataagaaagttgagttttgggaacacagtgagtttcaaaaagtgatgaatgaattgaaggatgataagattcaaacccaccatcggaagattgtgtatgaaatgctcttttatactggcattcggattggagaacttgaagctttgtcttggtcgaatgtagattttgagaaaaacacgataacgattgagaagacattgatttataatacaaaagatgattggtacttttcgactcccaaaactaaatgtgcttatcgaacgattgggttggggaagaagctttccttaaaactcagacagtggtatgacttgcaaaaacgtattggaaattttgaatatgttgctcagttggacggaacatttacgccaccttattcttttgcgaactggttaaaagaagctgctaaaaaagcgggtgtcaaaccgattaagcttcacgcgctacgacattctcatgttgcatttctaattgagcagaatattcaaccgctatctattcaagaacgattgggccatgcgaatattcaaatcactttaggaacttacggtcacttatatgcaaagtcagatcaacaagtggtaagtgcgattgataatgttcaagagggcgctattctttcaaaaaatgacaatttattaccagtctga

SEQ ID NO: 2413 - DNA (genomic), 1605 bp, Enterococcus faecium; double-stranded, circular
  misc_feature (B) LOCATION 1...1605
  hypothetical: NO
  anti-sense: NO
gtggtctcaaggagagagatcatgatcatacaagcaatttctattaaaaaaacaatcggcgggaatccattatttgaggatttatcctgtcaaattgaagctggtgaaaaaattgccttagtcggtatcaacggaactggcaaatcaacctttttacaaatcttgaccggcagagaaggtgtcgacagcggtgttatcagtcgcaaaaaaggcttaaagatcgggacggtcgaacaagaacttacagtttccgaagcgaccgtcaaccactacttgctccattctgccgctgagatacaggacctcaaacagcaaatgagtcgctacgaagcattgatgacagaaccagatacaaacttagagaagtgtctggcccgttacggtgagctgcagcatcgctttgaagaactaggcggttacgtattagaagaccggattgcagcgatcttgcaaggcttagggattccacaccgtcaggaagcacggttaacagaacttagcggaggcgaacgagttaaagtcgctttagccaaaattttagcagccgatgccgatttacttttactcgatgaaccgaccaatcatttagatcttaacagtattcgctggttggaaaactatttacagaatacaaaaaaatcggttctggtcgtttctcatgatcggcaatttctcgatcaagtcaccacaaaaacatgggaactggaagaaggtgcattgattgagtatcccggaaactacagccgttttcgagtcttgaaagaagctcgcttggctgagctgacaaaaaattacgaactgcagcaaaaagaagtccagcggttgaaagtcatgattcgtcgttttcgtcagtgggcacatgaaggagacaatgagtccttcttcaaaaaagccaaagaactggaacgccgcctggcgaaactgacactcgtcaaaccgccacctcccccgaaaaatcggctgcaaagcttgtctaatggtggaaaatctggcaaagaagttttcatcattcaaaacttgcaccagcagtacgctgatcaagtactattcaaagacagcagttttgcagtctatcgtggagatcatttagccatcatcggcgacaatggtgcaggaaaatcaaccttactcaaattattactcggtgaggaaaagccttacggtggcaccatcaaattaggtagtagcttgcaaatcggttatttgccgcagcagctgcagtttgccgatcccgatagccgtttgctggcttacgccatcacattgactggaaacgaagaagtcgctcgacggcaattagccaaaagtggcttttatcaaagcgatgtgggtaaacggatcaaagatttatccggtggtgaaaaaatccgtttggcgttgctgaaactctttttagaaaaaatcaacgtcctgattttggatgaaccaaccaatcacctcgacagctatgctcgagaagaaattgaagaaatgctgcaagactatcaaggaacgctcctagcagtcagccatgaccgctactttttgcagcaacacttccaagaagcactcgttattgatcaggagcagatcagccgccagccgctcggccaactgattgactag

SEQ ID NO: 2414 - DNA (genomic), 291 bp, Enterococcus faecium; double-stranded, circular
  misc_feature (B) LOCATION 1...291
  hypothetical: NO
  anti-sense: NO
atatcctcaaggtatacagcgcacaacaaaaagaaaaaaggaaacgcagaagcatttcctttcagtgatttaatgaaaacaacacgatttgacttagagcctttttatttgaattcattttcgctttatccaacttcatttgatcatttgattactcggttaaatacttttgacatgagtatcaatgaaacattcattaattatggttgcttatttcttaccgcttttctggccaatgctaatccgccgattattccggcattatcacctaattcgggcgtaataatgtag

SEQ ID NO: 2415 - DNA (genomic), 291 bp, Enterococcus faecium; double-stranded, circular
  misc_feature (B) LOCATION 1...291
  hypothetical: NO
  anti-sense: NO
aattgctcaagaaatgatggctcattaaaattcaatttttggaggaaatacatggtaagaaaagtattattgtctatggattccaagaatattgatgcttatcggcgttatcgatttgcaaagcaaatgagattaaatgggagtacattagctgatattgctgcaactttacatgttagtattgacacagttcatagagtattaaaacgggatcctgattgttgttttatcaaggtcaatactggaagaagtagacgtttagcaaaacggcataatagcttggccaattaa

SEQ ID NO: 2416 - DNA (genomic), 618 bp, Enterococcus faecium; double-stranded, circular
  misc_feature (B) LOCATION 1...618
  hypothetical: NO
  anti-sense: NO
acgaaatcaaggaggaactctattatgaatttaattcctacagtcattgaacaatcttcacgaggtgaaagagcttacgatatctactcacgtttattgaaagaccgtatcatcatgttaagcggccaagtaacagatgatcttgctaattcgatcatcgcccaattgcttttcttagacgctcaagattctgaaaaagatatctatctttatatcaattctcctggtggttcagttacagcaggtatggctatttacgacacaatgaactttgtcaaagcagatgtccaaacaattgttatgggtatggctgcttcaatgggaagcttcttgctgacagctggtacaaaaggtaaacgatttgctttaccaaatgctgagatcatgatccatcaacctcttggcggcgctcaagggcaagcaactgaaatcgaaattgcggcacgccatattttgcaaacacgcgaacgcttaaacaaaattttagctgaacgcactggacaaccgcttgaagtgattgaaaaagatacagatcgtgacaactatatgacagctgaacaagcaaaagcatatggattgatcgatgaagtcatggaaaacagttcttcattaaattaa

SEQ ID NO: 2417 - DNA (genomic), 1149 bp, Enterococcus faecium; double-stranded, circular
  misc_feature (B) LOCATION 1...1149
  hypothetical: NO
  anti-sense: NO
gctggatcaagatataagggggaaagaaacatgaaaatcgcaaatttcggtgtagaagaatggctaaataaatgggaaaagaaagcggtatatgatattgcacaaagctcgatcgaagcattgacattagacgaactcgttggcttagatgggactagcgtaagtaaatttttcgaaaaacgcaaaaacgaaccattggactatggctggatcgaaggatcagatgttttcaaacaagaagtcgcttctctttatcaaaccgtcgatccggaaaacatcttacaaacgaatggagcgactggtgctaatcttttagctctatacgcgttagtggaagcaggagaccatgttgtttcgatgcttcctacttatcagcaattatatgacatccccaaatctttaggtgccgctgttgactttgttcatttgaaggaagaagaagattggcagtttgatttagaacagctagaagccttagtcaaacctgaaacaaaaatcatctgtttgaatagtgcaaacaatcctacaggcacattgctagatcggaaaactttagaaaaaatcgcagaaattgctcgtacagtagatgcatatgtattgatagatgaagtatatgcgcctttaacggataaaggtgaattcttgtcgatcgtagatgtctatgaaaaaggtatagcaaccaattccctatccaaaacctactccattccaggtattcgtattggctggacagctactggacctgagttggcagaagtttttcgaaagtatcgagactacacgatgatttgcggcggagtcctgtcagatgatcttgctgtacatgcattgaagaataaagaaaaaatattggcgcgaaacaaaaagatcattacagagaaccttgtgattttaaaacaatgggtagccaatgaaccgaaagttgaacttgtcgctcccaattacgtctctacttctttcattaaattagccatcgaagaagatgaccagacattttgtatcaatttattagaagaaacaggagtactattagtaccaggaagtgcctttgatttaccgaagcatgcccgactaggttactgttgtaaaaaagaaaccttggaaaagggattattcctcttatctgagttcttgaaaaaacaggcctaa

SEQ ID NO: 2418 - DNA (genomic), 399 bp, Enterococcus faecium; double-stranded, circular
  misc_feature (B) LOCATION 1...399
  hypothetical: NO
  anti-sense: NO
acaacgtcaaggataattggatgtgctataaatatggctcgtattgcaagagtaaatattcctcgtgataaacgtgtagtagtttcacttacttatatctatggtattggtaacactactgctaaaaagatcttagctgatgctggtgtatctgaagatgttcgcgttcgtgaattaacgaatgaacaaacagatgctatccgtgcagaagtagataaattaaaagttgaaggggatcttcgtcgtgaagtgaacttgaacatcaaacgtttgatggaaatcggttcttaccgtggaatccgtcatcgccgtggattgcctgttcgtggacaaaacacgaaaaacaatgcacgtactcgtaaaggcccagctcgcgctatcgctggcaagaaaaaataa

SEQ ID NO: 2419 - DNA (genomic), 1257 bp, Enterococcus faecium; double-stranded, circular
  misc_feature (B) LOCATION 1...1257
  hypothetical: NO
  anti-sense: NO
atcaggtcaaggactagtttggaggcgaaaaacatgaaaatcggcttttttaccgatacctactttccgcaagtcagcggagttgctacatcgatcaaaacattaaaacaagaattagaaagacatgggcatgaagtctatatttttacaacgaccgatcctaatgcggataagttggaaaaagatgtgattcgaatgccaagtgtaccatttatttctttcaaggatcgaagagttgttgttagaggcatgtggtatgcttatttggttgccaaagaactagaactagatcttattcatacccatacagaattcggagcagggatacttgggaagatggtagctaagaagttgaaaatacctctgatccatacttaccatacgatgtatgaagactaccttcattatatcggtaaaggaaaagtgatcaggcaatcccatgtaaaatacttgtctagattatttgcaaatcatacgacaggtgtagtttgtccaagtgaacgtgttattgatacattacgcagctatggtgtaatagcaccgcttcgcgtgattcctactggtatcgacattgaaaaattcaaacgttctgatatcactcagcaggatatcagcaaattaagggagtcactaggtcttcaggaaaaccatttgatgattctttctttaagcaggatttcttatgagaaaaatatccaagccttgattaatgggtttcctcaggtcatctccgcttatcctaacgccagattagttatcgtaggaaaaggaccttatgtagaagagttagaggaattgatctcagaactgcagttagaagaatttgtgcagttcacaggagaagtggacaacaatgatgtagcactttattataaagcggcagattattttgtcagtgcttctacttcagaaacacaagggcttacttatacagaagcgatggcagccggaacaccttgtgtcgtggaaggaaatgcttatttgaaccgattgttcgatcatccttcattagggaaaacttttgaaaccgacgaagactttgcaccagcacttattgattatatttccagtgaagttcctaaagatccaaaagttttagaagctaaactttatgatatttcatctacacatttcggcgaagctatgatcgaattttatcaagacatggttgtttatcatgaagaagagatgcgaagaaaagaagaagaagactcgattgaacgaatcaaaataaaattaaattcatttaaaagataa

SEQ ID NO: 2420 - DNA (genomic), 543 bp, Enterococcus faecium; double-stranded, circular
  misc_feature (B) LOCATION 1...543
  hypothetical: NO
  anti-sense: NO
aaaaatgggctgaaaatcatgagtgaagaagttgggatcatcttgcgggaagcagtgccaggagatgcaaaagacattcttttgatgatgggacaagttaataaggagacagaatttttagttttggatgaagcagaactcctgttaccaccagaaaccttagaagaagagttggattatatatacgaaagcaataataatttattgctgcttgcaatctatgaagggacgattattggaacagcatctgtcaaggcagacagtcaatttcgtttgtctcacgtgggagaagtcggtatcagtattctgcaggaatattggggaatgggactaggcactcttatgctagaagaaatcatcagttgggcgaaggaaatgggtgtactttttcgattggagcttgacgttcaagttcgtaatgaaagagccgtacacctttaccgaaaaatgggcttccaaatcgaagcggtcatgcctagaggggcaagaacagatctaggtgaatttttagatgtatataaaatgagttatttgattgaatag

SEQ ID NO: 2421 - DNA (genomic), 1362 bp, Enterococcus faecium; double-stranded, circular
  misc_feature (B) LOCATION 1...1362
  hypothetical: NO
  anti-sense: NO
aaaattacaaggggattggacaaaaaaatgaaatttgagcaaaatttttcacaaaaacagcagcagacacagaaactagccatgacgcaacagttgcaacagtccatccaagttttacaatataacagtgaggagctgttggcattcgttgagaatcaagcaatggaaaatccattggtggaagttgttgagccggaatggcagccagattacataaaagcttcttcatcttcttatgaaggagaagagacaaattacctaaatcagattcctgatacaaaagggtctttatttgattcattgatcgaacaagtccatttgaattaccgagatacttttttgaggaaaatcgttctttatcttgtagaatacatcgatttgaacggatttttgacgattagtttagaagaagccggaaaagagattggagctacgcctatccaaatgctcgatgcgttgactctgattcagcaattagaaccagctggagtaggtgcacgtagtttgcaagaatgtctcatgcttcaaacagaacgagatgattatgcgccggaattagcttatatcgtgttggaagaatgttttgaggaactggtggagcgaaaatggaaagaaatcgcacaacgtttttctgttgatctacatgctgttcagcagatattcgactatttacaaacgttgagtccaagccctggccggattttcgaccgtagcagcgaatttaacattattcctgatgtccgggtattagtggacgacgataaaaatgtacaagttatctcaaaccgaaaaaatcagccaaatatacgctttcaagagagttacttcaaacaaatgtcacaacaagcagataaagaaactgaaaattatttaaaagaacggaaacaggaattcgaatggttgaagaaaacgatcctacaacgtggggatacaattttgcgggttgctcaagtcattgtttcccggcaaaaagctttctttatcgacaaggaacgtccaatcaagcctcttacgttaaaggaagttgcaactgagatagatgtgcatgaatccacggtcagtcgtgcagtcaacgggaaatatttggaaacagacttcggtgtatttgaattaaaaaaatttttcactacacgaattcctacgaatagtacagaacagacagaagacctttcagcagatacagcgaagaaaaagctgcaggaattagtcgatcaagaagacaaaaacaagccgttgtctgaccagaaattggttgaattgctgaaaaaagatgagatagcgatctcaagacgaacagtagcaaaatatcgtgatttattaggaatcccgagttcatcaaaaagaaaacgttatgataactaa

SEQ ID NO: 2422 - DNA (genomic), 663 bp, Enterococcus faecium; double-stranded, circular
  misc_feature (B) LOCATION 1...663
  hypothetical: NO
  anti-sense: NO
gaggaaacaagaatgaagatagcaccatccattttgagtgcagattttgccaatttacaaagagacattgagttagtggaaaaaggaggcgcagattacatccacgtagatgtaatggatggccaatttgtcccaaatatcacattagggccaaatattgttcaggcaatccgtcctgttactaaattaccgttagacgtccatctgatgatcgttgatccagaaaactacattccagcatttgcaaaagctggagcagatatcattactgtccacgtcgaagcaactcctcatattcatcgggcacttcaaatgacaaaaagcttaggagttaaagctggagtagttatcaatccaggaacaccagtctccatgatcaaacatgttttgcctttggctgatcaagtactagtcatgactgtcaatcctgggttcggcggacaaagctttattgaagaaacagtagaaaaaattacggaactcgctgatctacgtagagagaacaattggacttatgcaatcgaagtagatggcggaatcgttccagaaacagcaaaaatctgtaaagatgcaggggcggatgtcttcgttgcaggatcatatatctatggagccgaaaatccagtcggacaaatcgaacgattaaaagaggcattagactaa

SEQ ID NO: 2423 - DNA (genomic), 1818 bp, Enterococcus faecium; double-stranded, circular
  misc_feature (B) LOCATION 1...1818
  hypothetical: NO
  anti-sense: NO
acctctgcaagtgactattgtcatttgagaggtttttcctgtatgtttataacaaagaggaggtgtaagcaaatggacttaaataaacgacaactccaaattcttgtagtattaagaaataagaatcattggataacaagcgaagaattagctgaagctttaggtaccaacaagaaaacgatccaaactgaaatcaaaaatatgcttgctatctacgagaagaaaatcattatccagtcaaataaacgttcaggttattttttagaatcaattgaatctgaaactaaacagcaaatcatacaagaggtgacgaaacataaaatctattccagcatggatttccgagcttcaactattgtgacgtacttattgtttcaaaaagggtatgtcagtatgcaaaagatagcagacattttctttctttcaaaaacagccgtatcattacaaataaaaacgattttgcgttggatcgagcgcaatcctaaattagaactggaagtttcgtcgacaaaaggactaaaaatcattgctgaagaaaattcaaaaagaattttcttatctcttgttggaacagaaacggtgatccaacacgcaaggtttcctcaacaaatcagtacaattttttccaatatcatgccgactgtccaaaagacattaaaagaggttcttatatcatataattatattgtttcaggagaggacttcatacgattttctcggtatctcgttttgaccattcttcgaagagaagaacttttagaaaaaacaaacaggtatacattatttattccgatggtagagaccctcacaaaaaagttatcatcagaactaccctattctttttccaatcaagaaaaacaagcaattgaaaatcgactattagagttaaattatttgatgattaatgatgaaaaaaacaaagaaatagagaagaatctaagagcatttgagcaaacgattattcgttttttagatcttcctgtttcgttattgttccatgaaacagaatttttgctaacccatatcaaacaaatgaaaacgaggatggatgccggacataataccatgaatcattttgtacaaaagatcatctcccgttatcctttagaaatttatttaattcggcgtttcttcccaatacattttcaattacgtcccaatttagctgaaagcgcttattttgttttgtatcttgccgaagcgttgaatccttttcgaaaacaaggggagatactgattgttagtaaccagccaattagtattttgaatacactaaaaaaacagattcaacaaagtatgaacatgtggatcaaagaatgccggatagaaccagtgtatcttttcaaaaatcaatcaaacaaaataacggaatatgatgcaattttgactactgagcaagagcttatttttgagtgggatgatttgatttatctacctagtgttctagatgagtttgaatcttgggagatttatcagattttgcgtgaaaagctgaccatagttgaagaaaaaaagaaaacaaaactgcttgatcattactacaaagaagaaaatcaaataaaaatccataaaaagatagattccattcagcaactaatctctcctagttctgacctagttatgcttccgttaaatgccgagactttgttgtgctgtcttatcaaaagccaagtagaaacaaaaatcacagagtatcagcttgagataccacttatacatcagcaaaggaagatcaagcgtgttttttttgtctcctttgactataagagaaacgatatacttgttttctttcaagcagtgagtgatttgctcggctaa

SEQ ID NO: 2424 - DNA (genomic), 651 bp, Enterococcus faecium; double-stranded, circular
  misc_feature (B) LOCATION 1...651
  hypothetical: NO
  anti-sense: NO
acggatgcaagttgccttaggtaccggggaaataatagattgcaagctgctttatacaaacaaatgcaaaatctgctatcccctcccggaaagtgtggatattcaggaggcgaaccaatgagaaaaagtatgggcattactgtttttggatgcgagcaggatgaggcaaatgctttccgcaccttatcaccagattttcatattatccctacgctgatcagtgatgcgatatcggcagacaacgcaaaattggccgctggcaatcaatgcattagcgtaggccataagtccgaggtttccgaggcgacaattcttgcgctgagaaaggtcggggtaaaatacatttctacccgcagcatcggctgcaatcacattgatacgactgccgccgagagaatggggatctcggttggcacagttgcgtattcgccggacagcgttgcggattatgctttgatgctgatgctgatggccatacggggtgcaaagtccaccatacacgccgtggcgcaacaaaatttcagactggattgtgtccgggggaaagagctgcgggatatgactgtgggagttattggaaccggccatatatggcaagcggtcgtcaaaatgctgcggggatttggatgccgtgtgctagcctatggataa

SEQ ID NO: 2425 - DNA (genomic), 705 bp, Enterococcus faecium; double-stranded, circular
  misc_feature (B) LOCATION 1...705
  hypothetical: NO
  anti-sense: NO
aggggagcaagaaatatgaaagattttcaattgggggctgccacctatttaaaaagtgtagccattcgggtgaaagaccgagataaaatgattgatttttacaagaacgttgttggctttgatttgaaaagagaagaaaacgaattagccattttaggaacagaagaagctggaagtgaaatgttgctgctggaagaaagtcctagagcgaatgatcacatgggggtgatcaaaaagctgaaccgtttttcattgattatccctagcacagaagaaatggcagatatcctttgtcgtatccgtaaaatgaattatccaatcaaagaagctttagaagatcatggacgtatggggattttggtcgtagacccagaagagaatgaattggaaatttaccatgaagagaataagaacgaccaaagagaaattccagaaacaatggatcaagaagcattattaagaaaatctgaagaaaaattcagtaaactatcaacaggttcttattttgaaaaaatccatttaaatgttactaacttaacaaaagaacgccaatttcttaatcatgtacttggtttgaaggtacataatgaagaagagggcatccatgtattgaatgaaagagatttccattttgggtccacagaccctaaatgngagatgtgcaatgcgcccagaagattcacattgggttccgccccccgacac

SEQ ID NO: 2426 - DNA (genomic), 1140 bp, Enterococcus faecium; double-stranded, circular
  misc_feature (B) LOCATION 1...1140
  hypothetical: NO
  anti-sense: NO
gggggagcaagaatgaaagaaaaaaactggctcgattatcttgacgcggtaaatgatttttctttaagtaaaggcgaacctgattggatgagaaccttccgtcaagacgcactagcgaaagcagatgaactgccattgccgcatatcgatcgggtgaaattccatcgctggtcgttatttgatgtgaaagaaacacaaaccatcagtgaaacaggcacgattccggcatttgatgcaatgaaagacaatcctgtgcttgtccaacaaggttcatggacgatttttgaacaactgcctgtggaattagcagaaaaaggagtcatttttaccgacttgttcactgcaatgatcgaatatccagaactagtccaagaatattatatgaaaaaagcagtaaacatgaacgaagaccaattgactgcactccatgtagcttttatgaacagcggtattttcctgtatgtgcctaaaaatgtcgtgatcgatgaaccactcgagtccttattcattcaagatggcgcatccgatgagcacttcttcaagcatgtgttgatcgtggcagatgaacatagtgaattttcttatctggaacgtttccagacaaccaaagaacaagtagcaaaatcatcaggtaatatcatcgtggaagtcatcgctaaagctggttcaaaaatcaaatattcagccgtagatcaattaggagaaaatattacttcttatatgaatcgccgtgggcacattttacgagatgcttctgtcgactgggcaattggtgtcatgaatgacggtcatgtgatcgctgactttgactcagatttagcaggagaaggtgcacacgcagaagtcaaaatcgtggcaatcagctcgggcagacaaatccaaggaatcgatacacgagtaaccaataaagcccctcatacgatcgggcatattttgcaacacggagtgatccgagaaaaaggaacattgacctttaatggtatcggccacatcttgaaaggggcaaaaggtgcagatgcccaacaagaaagtcgtgtcttgatgctttctgataaagcacgtggtgatgcgaatcgtattcttttgatcgatgacaaacgaagtaactgctggacatgctgccagtgtaggacgagttga

SEQ ID NO: 2427 - DNA (genomic), 327 bp, Enterococcus faecium; double-stranded, circular
  misc_feature (B) LOCATION 1...327
  hypothetical: NO
  anti-sense: NO
ctgttggcaagatcaagaattgctaaaattgaacagactaaaaaggataaaaaaatttctaaaaataaaacaaaattctttaaagctgaagatgttaagaggatagcatggtctgtgaaaacatttgatgaagatcgttatgttaaagtttcaatgaatggtctatttgtacagcttggtaacttcagtaattttaaaacgattgatgaactttatccggaaataagaaatattgtggatagtaaaggtttaatcgtggctaaacggaaatcaagaaactctggtcttgcttactgtaaaaataaagggatcatgattccggcttaa

SEQ ID NO: 2428 - DNA (genomic), 414 bp, Enterococcus faecium; double-stranded, circular
  misc_feature (B) LOCATION 1...414
  hypothetical: NO
  anti-sense: NO
gaggaggcaagtagtatgaaagagccagatacaaatgcaaattatgagccagacgaactagaggagacgaacgcggatcaggatacaggacaagaatcgtcttctttttacgatatcaaagaaaaagcaagcatgaatctttcccaattattagaagacttacaggcttttgaaaaagctgtccgcgaagaagatatccctgagatctaccgtttatacaatggccgattgaatgaagaattaaaaagaagctcaaatgaaaatcacgagatcgatcaattgctgatgcgtaagatccatgatcgttttttacaggaatttccttttatggaacaagtagaaaacatctcgccaacgatgagctattacaaaatcggcacttattaccatgatcggcccacggtccggtattga

SEQ ID NO: 2429 - DNA (genomic), 966 bp, Enterococcus faecium; double-stranded, circular
  misc_feature (B) LOCATION 1...966
  hypothetical: NO
  anti-sense: NO
agttatcaaagaagagctaccattgatcaaccaaatcaaagctggtatgaactatcaatttataagaaaagaaggaagataaaaatgagcaaaatcaatttagagaacctaacaacggaacgcagaaaccaagaaacttttggattagatgagatgagtatttctcaagccgttcaactaatgaacaaagaagatcagaaagtggccgctgcggttgaaaaagaactgacaagtatcgaaccagtgattgctaacacgattgagtcctttaaaaaaggtggacgtctgatttatatgggagccggaacaagtggaagactaggtgtgttagatgctgctgaatgcgtaccgacattcggtgtagaaccggaaatggtcataggtctaattgctggtggagaagaagcaatgactgtagctgtcgaaggggccgaagattcttatgagctagggcaagaagatctaatcaagctgaatttgacaaaaaatgatatagttattggtatcgcagctagcggtcgtacaccatatgtgatcggtggattagattacgcaaaatcgatcggtgctgtcacaggaacgatttcttgcaataaacaagccgaaatcagtaaacacgcggatttcccaatcgaagtcgatgcaggtccagaatttttgacaggctctactcgattgaagtcaggaacagcacaaaaacttatcttgaatatgatttctactatcagtatgattggtataggtaaagtattcaataacttgatggtcgatgtcaaaccaacaaatgaaaaactaatcgaacgctcaaaacgaatcatcatgcaagcgacagaagctgattacgaaacagctgaaaagtactttgaagaagcagatcaaaatgttaagctggctatcgtcatgattttgacaaatagtgataaagaggaagctcaagcaaaattatctgaagcaagcgcattttaa

SEQ ID NO: 2430 - DNA (genomic), 1122 bp, Enterococcus faecium; double-stranded, circular
  misc_feature (B) LOCATION 1...1122
  hypothetical: NO
  anti-sense: NO
attaaccaaagaactttggtaataaagaaaaagagagagaaagagatgtttgaaaacaaaaaaatcaaaatcaacgtaagtgacttccagaaagtatcagctgtaacggctgttatgatgcaaacgatattgagctttgctttggcaaacagccacagcgcaacaaatacagcttttcttggtaccttttacgtcatcgttaaatacacagcaccaatgtttatttttgcaattgtttataatatggtaaaaacaagtcagcatttgtcttattgggaatttttgaaagaaaagttttttgaactagtcgttccgtatcttctatggacgacggcttatctttggctatttccagcagtccaacaacaaactccgtatacggatactgcaagctttttactgaaatatgtcacaggtgatggagcgcctcatttatggtataccgttatgatgctgcagatccaattgttcatgccgttttttgtttggctcggttacaaagtatttgctaataaaaaatatgtatggccagtattgattggttcaacgattttatatgtcgcatggtatctgttctatcaaacacaagtattgactgggccttatcatgacagctggtacttattagatcggtttgttgctagtttcatgatttatggggtagccgcatttgtttatcacgaaaaagtctatcaatatttggacagagtacgttatcttttcttacctgttgccttagttatcgcgttcttttctgtccgttcattgctcgcacatccaggagacttgagctttgcgaatgcaccttacttgaatacgatccaaagtttatacagtttagtcatcatctttgctgtcttcataggcgcttccaaaatgattgtaaacgattcgccaaaattgccattgttcaaatggttgtctgtttatgcttatcgtacgtatttagccaatgtatttgttttccaagtactgttattattgtttaaagatagttggctgcagttaccttcaggagtcatgattcttgtagcttatctaatgacggcaagttgtgcatttgctttaagctggttacttcatatcatttgggtagctatcaaaaaaggtttcagcaagtaa

SEQ ID NO: 2431 - DNA (genomic), 363 bp, Enterococcus faecium; double-stranded, circular
  misc_feature (B) LOCATION 1...363
  hypothetical: NO
  anti-sense: NO
tcgtgccaaagcaatcaaaagaaaattgcgaatcacttagatcgaaagtttactcaaacaaaagcattgtcagcggttgtcacggatttaacttatgttcgggtcgggacaaattgggcttatatttgtttgatgattgatttattcaatcgtgaaattattggccattcttgcggaaataaaaaagatgcgcagcttgtaaaaagggccattcaaagcattccttactcacttcaagaaatcgaactcttccatacggatcgtggaaaagaatttgataaccaaaccattcagaatctcatgaatggtttggttatcaaattcctttccacggtctgtatgaaaaagcttgacgtctgttaa

SEQ ID NO: 2432 - DNA (genomic), 1770 bp, Enterococcus faecium; double-stranded, circular
  misc_feature (B) LOCATION 1...1770
  hypothetical: NO
  anti-sense: NO
atggcacaaagaacgatctattgcggattagtttccgaacaacaattagaacaaacagttacattaaaaggatgggtacaaaaaagacgagaccttgggggagtaatctttatcgacctacgtgatcgtgaaggaatcgttcaaatcgtctttaatcctgaaatcaacaaagaagcatgggaaatcgcggataaatgtcgcagtgaatacgtgatcgaagtgactggggaagttagaagacgcggagaaaatgcagtaaatcctaaaatggccactggtgaattcgaagtgattgcaagtgaaatcgtgattttgaatcaagcaaaaaccccgccatttcaaattgaagatgatcaagcaatcagtgacgaaatacgtttgaaatatcgttatttggatctgcgtcgtccaaaaatgactaaaaacatcaaattaagaaatgcgacaacaaaagcgattcgtcattatttagatgataatgactttctcgatatcgaaacaccttacctagggaaatctacaccagaaggcgcaagagactacctagttccttcacgtgtccatgctggacatttctatgcgttgccgcaatctcctcaattgtttaaacaattgctgatgaatgctggattcgaccgttattatcaaatcgttcgttgtttccgcgatgaagatttacgtggagaccgtcagcctgaatttacgcaagtagatattgaaacaacgttcttaacagcagaagaaatccaaacttacacagagggattgattgcgaaggtaatgaaagaagttcgcggtatcgaagtcacattgccatttcctcgtatgacctatgatgaagcaatggctcgctacggcagcgacaaaccggatacacgttttgatatggaattgatcgatctaagcgatacagtcaaagaagtagaattcaaagtcttccaaatggctcttgaaaacggcggtgtcgtgaaagcattgaatgctaaaggcgctgcagatcgctactcacgaaaagacatggatcagttaggtcaatatgtaggacaattcggagctaaggggcttgcatggctgaaagtagaagaagacggattgaaaggtccaattgctaaattcatgggagaagcaacagaagcaatcattaaagcaacagatgcaaaaccaggtgacttgctgatgtttggcgcagataaaagtgaaatcgtcgctgctgcattaggtgctatccggacacgtttaggaaaagaattaggactaattgatgaatcgaaattcaatttcttatgggtaactgattggccacaatttgaattttcagaagaagaaggtcgatatgtctctgctcaccatccattcacgatgccaaaagaagaagatatcccgttattggctgaagaccctgcaaaagtctatgcagaagcttatgatatcgtcttgaacggttatgaactaggcggaggttctatccgtattcatactcgtgagcttcaagaaaaagtactagaaactctaggctttacaaaagaacaaatggaagaacaatttggtttcttgttaacagctttagattacggattccctccacatggcggtattgcattaggattggaccgttttgcaatgttattagccggagaagataatattcgtgaagtcattgcctttcctaaaaacggaaaagcagcagatgtgatgagtgatgcaccaagtatggtttcgcctttacaattgttcgaattgaatattgatgtaacgaatatagaagaatag

SEQ ID NO: 2433 - DNA (genomic), 183 bp, Enterococcus faecium; double-stranded, circular
  misc_feature (B) LOCATION 1...183
  hypothetical: NO
  anti-sense: NO
agaaaacaaagactcatatcttacctgttagaagagtgttttcctgtagaagagaacaacccaagtagcagcctagtcgtttctatccttttttgttatgcactctttttgacatttactccaccaataacgaagggtacaataaaaagtaataacaaacaaaaggagtacagaaatgattga

SEQ ID NO: 2434 - DNA (genomic), 843 bp, Enterococcus faecium; double-stranded, circular
  misc_feature (B) LOCATION 1...843
  hypothetical: NO
  anti-sense: NO
gaagaacaaagtcaaacaaaaattgacttttatgttaaaggagtaattcatatgctgaaaaaagaaagacaagaacaaatcattacattattagagaaagatttttatttaactaattcagaaatcgctaacaaattaggcgtatcagaaatgaccatacgccgagatgtcactgaattagcaaaaaaaaataaagtaaaaaagctatatggtggcgttgaacgaaaggaaccttataatcgagaactatcgactcaagaaaagattgatacgaatgtagccgaaaaaaaatatattggtcaagtcatgaacagtatgattcccgataattctactatttatgtcggtgctggaacaacgatcctatatgcacttcctttcattcaaaagaaaaatctatttgtaattacaaacagtttgattgctttcaactatttaaagaatcatacaagttatcggattttacttactggtggcgaattttctcctattacagaagagttcattggggaagttgcagaaagatcttttgaaagtttgaatgtcgatatctctttcgctgcaacaaacggcatatttgataacaatgtgacaaccgctcaatttattgagggaaatattcagaacgcagcgctcaatgcagcaaaaatcaaatgcattgttgcagattattcaaaattaaataaatcagacgtctatacttttagaaaattaaccgattttgattatctaataaccgataatcatttatcagaacaggatttcaatcattattcaaaatacttaacaatattaaaggagcccaaaaatgatactgacaatcacgatgaacccatccattga

SEQ ID NO: 2435 - DNA (genomic), 198 bp, Enterococcus faecium; double-stranded, circular
  misc_feature (B) LOCATION 1...198
  hypothetical: NO
  anti-sense: NO
cctatgcaaagtagacttgacaaactgattgtagttatactagacggctgtcgctacgacacagccgtcgcccagcttgggttcatgaatcatttagttgagcaccagcaagcaagcttattgaaggtaaaaagtgagctgcccagcaattcacgtccgttatacgaagtactgatgaccggcgttcccagcctatga

SEQ ID NO: 2436 - DNA (genomic), 1437 bp, Enterococcus faecium; double-stranded, circular
  misc_feature (B) LOCATION 1...1437
  hypothetical: NO
  anti-sense: NO
catacgcaaaggagccgctgcgaatgccgtacagattgctgcagctttaatgcagaaaatagcggaggtggcaagatgagtaatacgctgaaagtagcgaaattcggcggaacatcgatgtctcatgaagagcaattcaaaaaagtccgtacaattgttctttcagatcccaatcgccaagtgatcgttgtttctgctttaggcaaacgtacgtcagatgatgacaaagtaacagacttactttatttgatttatgcttaccttcagcatcatgttgattggacacccctttggaaaaggatttgtgatcgtttcattcaagtaagagatgttcttgccctgcagttacctattgaagatgaactagcacgcatacagaaacaactggaagacgaaaagataactgaagattatttagtaagtagaggtgaatatctgactgctcaactgatggctgagtatcttggttaccagtttattgacgcaaaagacctgattttctttgactatgatgggaaaatcgatcaggaaaaaacagcacaggaaatcacaaaagcatttaaaagatatccgaaaatggttgttccagggttttacggggcgaaccctgcaggaaaagaaaaattattgggccgtgggggaagcgacattaccggcgcgatactggcgaagatgttgcaagcggaaagttatgagaattggacggatgtttcaggaatcatgatggctgatccgcgaatcatcgatcatcctaaaatcatcgaggaaatctcttttagagaactgagagagatggcttatatgggggctaacgttcttcatgaagcagctgttttcccagttcaagaggctgatatccccatccaaataaaaaataccaatgatcctttcgctcaagggacaaaaatatcgaatcacgaaatagaaaaggaaaatggactgacaggaatagctggacgcaaggattttctttccatcactttattcaaacgtcatatgtccgatgaaatcgggtttatctggaaagcaatgagcatttttgctaaacatgagatatcaatcgaacatattccttcagggatcgacaatatcggagtgatcgtctcagcagaagcgattgccgataagttatttctcatcacgaaagaattaaaagaaacacttggcgtggaagaaatcgtcgtgatcgaagacttagctttgatctctgtcgttgggggtccgcataaagaattgattggattatctgggaaagtgttatcgatattgaacaaattagaaattcgcacatcgatcttatcacaaggagcacaggagttgaatctgatcatcggtgtaccgaataatcaatatgaaacagtagtgaagggtatctatgaagggatggtgaatacggatgctgaaagaatatcgaatggcactccatcaaattcctga

SEQ ID NO: 2437 - DNA (genomic), 699 bp, Enterococcus faecium; double-stranded, circular
  misc_feature (B) LOCATION 1...699
  hypothetical: NO
  anti-sense: NO
gaaaagcaaagattttttagttggaggacaagaataatgaaaagatcgtataagacagtagctgtaatcctattaatcgtcttattagcaagtataggtctattttttagaaagacaccacaaaaaatccaagtatgtggagaagaacgggattcatggaatctactactagtcaatgcaaaacataaaatacctcaaggatacactgtggagttacaaaagctatccaacgatcaagcagtagacaagcgtatatatcctgacttacagctgatgcttgatgcagcaagagcagaaggaatctatccgaaaatcgtttcaagttttcgaacgacagaagatcaagaaaaaatcatggaagataaaattgccgcctttcaagaaaaaggctattccaatcaaaaagcaaaagaagaagcagcaaaatgggtagctgcaccaggcacaagtgaacatgaattaggattagcagtagatatcaacgctgagtcaagtatttctacagacaaagaagtgtatgaatggttagcagataacgcgtatcaatatggttttatcttacgctatccatcaaacaaagtgcatattacgggtgttggttacgaaccatggcattatcgatacgttggtaaaaaagcagcaaaaaaaataaccgaggcagggataacattggaagaatatttagggaaaacagaataa

SEQ ID NO: 2438 - DNA (genomic), 477 bp, Enterococcus faecium; double-stranded, circular
  misc_feature (B) LOCATION 1...477
  hypothetical: NO
  anti-sense: NO
cttgggcaaagaaattcttacacgaaaatatatattctgagttgtttccttcatcgagccatttatacaaatgaagatgctttggtaataaagaaagaacaaggatttacaggtacagagaccaaaagcttattcttaaaagataaaaaagataataactacgtatatctgacttttactacgaaacaaacggatttcaaagcattagggaagatcgtcggtaaaaggctttctattgtttcatcagaacgcatggaagaacaaacgggacaaaagcagggcgctgtttctccgtttggttatgaaaaacagattccgattattattgatgaagagctcttatcaaatgaaaaacttgtttttgcaccaggtagaccagatcaaacgatggtcatccaaacggttgacttaaacaaaatcatccagctacttgagatgccgatatttttgatgccggcaaacgaaaaaaacaattaa

SEQ ID NO: 2439 - DNA (genomic), 216 bp, Enterococcus faecium; double-stranded, circular
  misc_feature (B) LOCATION 1...216
  hypothetical: NO
  anti-sense: NO
acgactaaaagaggaagacgagtgttctacgaacacaaagatcgatacggatctccagggatcactcaaaaactttacgatgaaggaatcgaaatcaataaacgtgttgtagctgttcttatgcgtgaaatgaatttatgcacaagaggatttcatcgacgcaaatcttctcatggtagagaaaaaacaatcaaagaaatggtaaaaaaatgttga

SEQ ID NO: 2440 - DNA (genomic), 1926 bp, Enterococcus faecium; double-stranded, circular
  misc_feature (B) LOCATION 1...1926
  hypothetical: NO
  anti-sense: NO
gaaaataaaaggaggaacaaacgattggaacattatgaagcagatgcgtatgacgtgatcgttgttggcgcaggacacgccggttcagaagctgcacttgctgctgcacgtatgggatcaaaaacattattactgacaataaatttggacatggtagcattcatgccatgtaatccttctgtaggcggaccagctaaaggcgttgtcgttcgagaaatcgatgcgttaggcggagaaatgggtaagaatatcgataaaacctatatccaaatgcgtatgttgaacacaggaaaaggcccagctgtccgagcattgcgagcacaagcagacaaacatgcttattcaacagaaatgaaacatacgatcgaaaaagaaccaaatttgacgctaagacaaggaatcgtcgaagaactgatcgtcgaagatggtgtttgtcatggagtagtgacgtccacaggagcgagctaccgggccaaagcagttgttattacagccggaacagcacttcgcggagaaatcattatcggtgaattgaaatattcatcaggtccgaataactctcaaccttctattggactagcgaatcatctaaaagaacttggctttgctatcgaacggttcaaaacaggaacaccgcctcgagtaaaatcaagtacgatcgactattctgttacagaagagcagcctggtgacaaagagccgaatcattttagcttcagcacaccagatagtgcctataaactagatcaggaatcttgctggctgacctatacaggtgagacgactcaccaaattattcgagacaacttacatcgtgccccaatgtttacagggatcgttgaaggggtaggcgctcgctattgtccatccatcgaagataagatcgtgcgttttgcagacaaaccacgtcatcaattatttttggaaccagaaggcttaaatacggaagaagtctatgttcaaggtttatctacttctttaccagaggatgttcaagtcaacatgcttcattctattgctggattagaaaaagtagaaatgatgcgtacaggatatgctatcgaatatgacgtagtagagccacaccagctccgtccgacattagaaactaaagtcgttgaaaatctttatacagctggacaaacaaatggtacaagcggttatgaagaagcggctggacaagggctgattgccggtatcaatgcagctttgaaagttcagggaaaagaacctttagtgatcaaacgaagtgacggttacatcggtgtcatgatcgatgatttggtaacaaaaggaacgaacgaaccttatcgtttgctgacttcacgtgctgaataccgtctgcttttacgtcatgataatgcagatttgcgattaacagaaatgggtcaccgtgtaggcttagtaaaagaagatcaatacaagaattatttgaagaaaaaagaagcagttgaacaagaaatcaaacgtttgatgaatgtacgaatcaaaccaacagaagaagtccaagactttttagcaacgattaatgcggcaccattaaaagatggtgtactagcaagcgactttttaagacgtcctgagattacttatgcagaacttctacggtttattccagaaaatgaagaattgacacgaaaagaaatcgaacaagtagaagtccaaatcaaatatgaaggctacatcaaaaaagccatggaaaaagtagaaaaattaaaacgcatggaagcgaaaaagattccagaaaacatcgactacgcagcaatcaacggattagcaacagaagcaaaacaaaaattgcagaaaatccaaccagaaacaattgcccaagctagccgaatcagtggcgtaaaccctgcagacctaagtatcctaatggtctatatcgaacaagggaagattgcgaaagtcagtgaaccagcgtaa

SEQ ID NO: 2441 - DNA (genomic), 270 bp, Enterococcus faecium; double-stranded, circular
  misc_feature (B) LOCATION 1...270
  hypothetical: NO
  anti-sense: NO
agagataaaagtcttgtggtgaccgcttcactccacggtattcaaaagccagtttctcggtattcgtacaaaaaaagaggctgtgacaaaattcttgtcgcagctccttatttcttgatgcaggacagctttttcacaacttcttccttaaacggtgttctcctgccaactcctcggccacaagtcacaatatttataaaacatgagaagctgttttttgaaattgttccttgtggctcagagttaaacggcaggctcaagacctcttga

SEQ ID NO: 2442 - DNA (genomic), 402 bp, Enterococcus faecium; double-stranded, circular
  misc_feature (B) LOCATION 1...402
  hypothetical: NO
  anti-sense: NO
ttgagtaaaaggaaaaggagagatgaatctatgaaaatggctcacacatgtgttcgagtgaaagatcttgaagcatcaatcgaattttatcaaaaggcatttggttttgaagaaagccgccgccgtgattttccagaaaacaaatttacacttgtttatttgacacttcctggggatgactatgaattagagttgacttacaactatgatcatggtgcgtatgatctaggagacggctatggtcatatcgctatagcagctgatgatctagaaaaattacacgagcaacataaagctgccggtcttgagattactgacttaaaaggattacctggcactgcgccttcttactactttgtcattgaccctgatggttataaaatcgaagtcatccgaggatag

SEQ ID NO: 2443 - DNA (genomic), 876 bp, Enterococcus faecium; double-stranded, circular
  misc_feature (B) LOCATION 1...876
  hypothetical: NO
  anti-sense: NO
attatcaaaagtgaggtatacatgatgaaatcaaattttttgggatatgtaattgcaatcaacatgtttaaagggggagttggtaagtcaactcttactcagctaatggctgatattctatcggctagaggctttaaagttttagttattgatgttgatccacaaggaacagtaactaaaaagtttcaaagacaatatgatttaaaagttgttgggaaaatgacattgtttgaagcagtaattaatatgtctttcttagactgcatttctcctgttaaagaaaacttagatattgtgcttggttcagaacaaatgtcaaggtttaccaaagtattaagagatatgtggagaagtactggttttactgatgaaggtgaagaagtcttttggaatttgtttaattatatgatcggtaatgataatttaagagatcaatatgattttattttgtttgacactattcctacagtttcagaatttacagataacgtttacgtggcgagtgattttttagtaattcccacgcaaactgagcaagattctatagacaacttgcatagtacggttactaattatcaaactgctgtaaaagaagtaaacggagatttagaaattttaggtattgttccatatctagtggatactaaattaaaaacaggattagaacttttatcagaacttcaagaagaatatggagacttagtttattctcatattgtttcagaacgaggcgtaattaaacgttggggtagagaaggactaaataaatctatcccacattctaaaactgcttatagcatgtatgtagacattgtagaagaaacgttagtacgtttagaaaaagctacaggagaaaatattttagaacgtgtttag

SEQ ID NO: 2444 - DNA (genomic), 303 bp, Enterococcus faecium; double-stranded, circular
  misc_feature (B) LOCATION 1...303
  hypothetical: NO
  anti-sense: NO
acaatcaaaagcaccattctaagaggtggaaaattgaaaatcgattatctagaactgatcaatgaaatagcaagttacaaaactggtgaggaaatagagattctgagagacgtttatgaacaacttgatgaagctggaatcgaacgaattaagaatgatcgttcaagttggagtaaactcagatactatttcgcactttatatcgatgcaacacaattaagaaatttagcttatacaaaattactatttgctgattgcgttaaaggattgcaaaaacatcttagtgaacttgagcaggtgtaa

SEQ ID NO: 2445 - DNA (genomic), 303 bp, Enterococcus faecium; double-stranded, circular
  misc_feature (B) LOCATION 1...303
  hypothetical: NO
  anti-sense: NO
acaatcaaaagcaccattctaagaggtggaaaaatgaagatcgattatctagaactaattaatgaaatagcgaattataaaaagggcgaggaattagacgtcctgagagacgtatatgatcaactcgaagaagctggaattgaaggaattaagaatgatcgttcgagttggagtaagctcagatactatttcgcactttatatcgatacaacacaattaagaaatttagcatataccaaattactatttgttgattgtgttaaaggcttgcaaaaacatcttaatgaacttgagcaggtgtaa

SEQ ID NO: 2446 - DNA (genomic), 201 bp, Enterococcus faecium; double-stranded, circular
  misc_feature (B) LOCATION 1...201
  hypothetical: NO
  anti-sense: NO
gtatccaaaagtttatataaaatagaaaaaacatataatgaaacagcgttaaaagttatttttggtagttttaatatattcatttttagttgtataaaaatatatcataataaaaacaacaaaaaaatgtctggaaaatcgaacataaaagtgtctgatttgaatatcccagcagcggaagaagaaaaacaaaatcgataa

SEQ ID NO: 2447 - DNA (genomic), 2706 bp, Enterococcus faecium; double-stranded, circular
  misc_feature (B) LOCATION 1...2706
  hypothetical: NO
  anti-sense: NO
gctagcaaaagcaatttagagagaagggaagaaatattgactgaatctattaattggagaaaactaaatgtgcaatggttaaagtataaatggccaatcatagtttccctaataatcattctatttatggcctatccgcaacgagtttttgcgttgccgtggattacagacaataaagaggtattaaaatttttaacaaaatatcaagattatcttcagtttactaaaggtggttttggaagcattgtcgttcaaagtttatcgtgggggctgattagaggtgcatattttgtttgtaaatcagcagaaaaccttgttccacaatcgctaagtttgtttagctttgttgaaagcagtagtttaggtgctgtttatcaatctgtattaaacacggtggttgtaggattaatgatcctttcattgatgtttgttggttacaagatgattactggaaaaggaacagtggatttaaaatcggttggaatgaacgtagtgatgtctatagcattaatacttttaatgccaaccatgatttctagtggtattcaatttgctaaaacattttataaggactctactacgattacaaaagctgatgggggcgttgcttggtcattgattgaggacggtgtaactgatttagtatatatcaataaaaacgatgcttatgatcggttgggtaaagatggcgtacaaaaaaatgcgttaaaagaaaagaatttcttttcctacgatttcagtgaagtaatcacagttgatacagctaaagatttagaagatgataataaaaaagctgaatatcttcaatctaggttgacaccagatggcgaaggaaatatgcaagccgttaagattgatgatggttggatgtcgatgttctctgatagtttcaaaggagggtactacaggtttactaaaaatacttttgcattgactttaggattactttcgttagctgtagcctatgtttttagtatttttatcatagtcaccgctattttagaactggcatttaagcgtgtgttaggggttcttgtttttgcaacagatattgagacaggacagcgttcaaaagttgttctatcagatattctacagtgctatttgactgtaggctttcaaggatttggattatccatgtttgcaatgtttgtttcctatttaggaacaggcggagggtcttccgttaatccgtttattaaggctgtagcttatgtatgtgccgtttttgttttaatcaaaggcagtggaacagtcatgagatactttggtgttgatattggactcaaagaaggctatgggcaacttgcttctgcttttggaatgggtgcaatgctgtttagaaaaggatcaaatggatttaatcgtgccaaaggaagcggaaacggaaatggatcagacagcggagaaggagaagatcgaaaaccagaaaagaatttcggtgaaactctatcaaaaaaagctggcaaaactggaagagctttgggatatgcccatgaacgtggattatcaggtttagcttcagatggagctacaatggctagtgaaagagcaacaaaaccatttaagagtatgcgtgatatggctaatgatactaagaataagttcaaagaaggtttagatgatggtacagtgtccgctattaataaaaatagcaaacctatgttagctaaaaataaagaagatgaaactggaaaatacgctgattccatgccaacacgtctttcggatagaaaagatggtgctaaggttgaaaatgccgatagaattatgtctagttctgaacgtatgcgtgaagcaatgaaaaataatgctgaatcgaataataatcctgtaagtgcaattcagcaaaaagttcaacaagatattgaagaacgtaaaaatgctatgcacggtcaagctaagtctgctgaagaattaattaatcagaagcgacaagaagctaaatacacgcctgaagcaatgaatcgtgaggaaatgttaaggaaacgtgtagaagggcgtacaggaactaatacggacgaaaaagaagcgttgaccaaagaaagaatccaagaagctaaaaactcaaataccggattagaaaaattggtcaaagaaaatctacaaaattctacaagtagtcaaggtggtcgatcagtagatgtccgagaaaatattcaaggttcattgaatggtcatgtcggacggaatgttgatgtaagagagaatttacaaagttcttcaaatggtcaaggtactaagacaattggtgttcgagaaaatctgcaaagtagcagtacaagtcaaccaaaaacagtagatgttcgagaaaatgtacaaaattctacaagtagtcaagggtttaaatcagtggatgttcgagagaatgtgcaaggtagcagtgcaagtcaaccaaaaacagtagatgtccgagaaaatgtacaaagttctacaagtagtcaaggattcaaaacagtagatgttcgggagaacgttcaaaaagatagtggagaaatgaaagaaaaaacacaaaaaatcaatatcgttgaagacagaaagtcagcgaaaaaatttgattcaaatcatgaaacagtgattattgatagtgaaatccgtgaaaatgataagggatcaaaaccaagacgaagattcacttatgaagacaacgaattattcagagatacacttaatgatcctaatccacttttcgataatttaaattaa

SEQ ID NO: 2448 - DNA (genomic), 1152 bp, Enterococcus faecium; double-stranded, circular
  misc_feature (B) LOCATION 1...1152
  hypothetical: NO
  anti-sense: NO
aaaagggggctggcgcacatgaatgatcgcagcgaaaaattccgtaatttattagtgcctgtactttcagttgttttaggattgatcttaggcgcgatattgatggctgcttttggttttcagcccatccaaggttattcttctatgctagatgcagcccttggttcgcaaagagggataggtgaaacgttaaggcaagcaacgccgttgatttttacagcattaggtttttctgtagctaactcagctgggtttttcaatattgggctttctggacaagcactttgcgggtggatcgtcagtgtctgggtggcacttgcgtttccagatctgccaaaagttgttttgcttccgttatgcgtgatcttaggtgccttagctggtgcgatggcagcggctgttccaggtttacttcgagcattttttggaacaagtgaagtgatcgtaacaatcatgatgaactatatcttattatacgtaagcacatttgctttacatgaagtgatgcctgaaagctatcgctcaagtttggactcttccaatatgatcagtcaaaatgcctcactgcggttaccatggttaacacaagcttttggcggctctcgcgtaaactcaggattatttttagcaatcatcgcgcttattttcgtttggctgctgatgaagaaaacgactttaggatttgaaatccgttctgttggattgaatccttttgcttctgagtatgcaggaatgagtagtaaacgtacgatcgttttgtcgatggtcatttctggcgctttggcagggcttggcggtgtggttgaaggattaggaacgtatcaaaacttctttgttcaaacgacttcgctatctattggatttgacggaatggctgtttccttgcttggttctggatcagcaatcggtattcttttatcagcgatcttgttcagtattttgaagatcggtggacttggcatgcagacaggagcaggtgttccgtttgagatcgtcaatgtatcgattgctttgattatcttctttgtcgggatcaacttcctgattcgtttcgtcatggctaaagtcttccaagggaaaaaacaagaagagatcgttgcgacaatagaatcgaaaccaacgaatcaaaaccatgaagggggcgaactataa

SEQ ID NO: 2449 - DNA (genomic), 393 bp, Enterococcus faecium; double-stranded, circular
  misc_feature (B) LOCATION 1...393
  hypothetical: NO
  anti-sense: NO
aaaagggggctattaatgaatattgatgggatttataatgaatcagattttaaaaaaggcatagtagatattgatagaaaagagtatttatttcctgatgaaataggtttatttaaaattgtaggtgaaactgtctgtaggtattgggggaagaaaggaaatataattttacttgttgatacgattgagggaagaaagttaaaattttcgttttggagtaatacaaaatattgttgtgaacctgtacctaaaagggaagtagatgtggctaaagaaagtgtacgatttttacctgatcgatcaaaaataactttaatttgtgaacggacaagtaatgctaaatttacaagaattagagatatactactttcgactacaagtagtcagtcatag

SEQ ID NO: 2450 - DNA (genomic), 342 bp, Enterococcus faecium; double-stranded, circular
  misc_feature (B) LOCATION 1...342
  hypothetical: NO
  anti-sense: NO
ttattaaaaagtaaaggaataatttcaatgaaagtcgttttccatattgatgaattagaaaaatggtcagaaacagggaaaaacgtaaaaaacctgataaaagcttctccagaaacgacgattgtcgtatctgtaaatggcatcgcgattaccggttatctagactctgccaatgcagaattcttagatttgcaaggagtcgtttttcacgcttgcgccaatgctatgcgtgctaatcatatttcagaaagttctttacctgaacaagtaatcgttgtaccagcaggtgtccttgatttagttgaactgcaatcccaaggttatgcttatatcaagccttag

SEQ ID NO: 2451 - DNA (genomic), 1437 bp, Enterococcus faecium; double-stranded, circular
  misc_feature (B) LOCATION 1...1437
  hypothetical: NO
  anti-sense: NO
cgtctaaaaagaaaaaagcgactgcggcaaaacagcggccagccaactcctgctcttttgtcgcttttctttggcttttttcatatgatacagaataagaaaggatctgtaaaaatggcacaaaaaacaacaactgcaactgcagttgaggaaaagaaaaaagaaggtttttggtccacaaaaatcaccggcgtaagtttgccactttatttgatcatggtccttgtcctgatcattgcaatggctttagggaaattaccgacgaatatgattggaccaatcgcagttttggttattttcggtaatttatttcattttatcgggacaaaaatccctatcgtcaaaagttatttgggtggtggttccgtttttgcgatcttcgcttctgctgcgattgctacatttgggatcttacctgaatatgtagtgaaatccacagaaaactttgtcagcaatatgggcttttgggacttttatattgctgccttgattactggtagcatccttggtatgaaccgtaatctattgatgaaagcttctgttcgttttattcccgttgcacttatttcaatggtcgtctccttttttgccgtaggactcgtgggcatgcttatcggaaatggttttgcaaattccgttttatacatctcattacctgcgatggctggtggtgttggagccggagccgttcctttatcaacgatttatgcaaatgttttaggtacggatgcttcttctatcatttcccgcctgattcctgcgacagcaatgacaaatgtcttagctatcatcggtgcagcattagttgctcgtgctggacaatcaatgccaaaattcaacggcaatggtaaattaatggaaaaaggcgatcttggcgatggaaaacctcgaactgtgaaaccttccattccacagttaggtgttggtttgatggtatcattgactttcttcatcttaggacaaattggtaactattttgttcctaaagtccatgcttacgcatttatgattattatcgttgtcatctgtaaaatcgccaacctattaccagagtattatgaagatgcagctatcatgttcaataacttgattgtcaaaaacttgacagcagctgttcttgccggtatcggtattgcgttgctgaatctgaatgtattagcttctgctttgacatggcaatttgttgtcttatgtctgacaagtgttatcgcgatttcagttgtttcaggatttgtcggtcgtttgtttggtttatatccaattgaatcaactattactgctggcttatgcaacaactcgatgggcggaacaggaaatgtagccgtcttatctgcagctaatcggatggaacttattgcttttgctcaaatgggcaatcgacttggtggtgccatcgttttgatcatctctggtttcttgatgcaattactttcttag

SEQ ID NO: 2452 - DNA (genomic), 1359 bp, Enterococcus faecium; double-stranded, circular
  misc_feature (B) LOCATION 1...1359
  hypothetical: NO
  anti-sense: NO
attataaaaagatttgaaagaggtgagaaaatgattggcgaagataaattattgatgactatccagctcacagacttaaatgaagaagaaaaaaaacaggaaataagcgattgggctattttgacacgtctgttgatccagccaacatttatccgctctttcacacaacaagcggatccgtatgatcttcgaaagcttcaagaaaaaataatgctagcatcggtaagagacgaaagttggttagttgtaggaaatgacgagaacgaatgtagttttcgcttggaagataatcaattattgataaaaaatgtattgtctatctctgttttcaaagaaaagcaatttttgattcgagacttcattcagaaaaaaatgattgctcatggggtgttcgcctatatgcgagcttatagcgagtttatctatcacaatacaaaacagatctctcaacggctattgtttgagaaaaaggatgaaatcgaacatttacctaaaatgaaacaacaaaacggggaagtagtagtcgattgcaaccaatttccaggatacgatcttttttaccaaggtttatgtttcacttcgtgttgggaaatgtattatagtcgctattatcatcaaatcatccctaaaccgatttttctcgacatccaacaagtagaaaaagtgaaggaattagaaaacgaagtcatatgtatccagctttatcgagacccctttaactggcaaaagccaaacaatcaaatgtttcaatcctattttagggaccagcttgggtttgatcatcttgcttgggacaatggtgtcggtttattgaaaccgccattcgttgaatacatttacactgaccatacgatccaatctgtccagtatcagaatgcacaaatgcaacctgttcctaaaaagaatgcttcattttttgtaacaaaaagttatgatatccaacaaggagattataaagaaaggcgtgttcgcggaacactaaatgctcaggcgtattttccttgggttgacgagaatcgatcacgcatgatgtgctataaagttatcgatccgactgttgctttggataatggaatcgaagcttattgttattatattagggaatatctagaagtagaggtaacagatgaaaaatatcaagagtatcttttatccttaagaatctatgttccttcagaatccctgtcagaattaccgttaaaggaaatcaaacatagactctctgatgttaccttcaaacgaataaagaaaaagcggcgaagtatccaattcgatgtcaagaaaggtgagcagcatctgcgtgtgcaatttttagattaccgagaattagaacaattgattactttacaaaaaatatga

SEQ ID NO: 2453 - DNA (genomic), 792 bp, Enterococcus faecium; double-stranded, circular
  misc_feature (B) LOCATION 1...792
  hypothetical: NO
  anti-sense: NO
gaaataaaaagagaggagacaagagaaatgatcgatctacattgccatatcctgccaggaatcgatgacggagcagaaaacttagatgccagtatcgccatggctgaaaaagcgattcaacaaggaatcacacatattttatgcaccccccatcacaataatggaaaatacagcaatgaaaaatcacaagtcatttctctagtcgcttcgttacaagcagaattagagaaaagacaattgcctttgacgttattggaaggacaagaagtacgtattaccggaacactgatcgaagacatccaccgagatgaaattttatttacagatttagatgatacatatcttctgatcgaatttccgacactggaagtgtcgttatatgcagaacggctcttttttgagttgttacaactaggaaagacaccagtgatcgtccatccagaacgcaacgcgcattttcgtaaagacccgaatcatttgctgccattcctagatatgggatgcttggcccaactcaccgcaccaagttatgtcggtgtatttggtaaagacatccagaaaacagccaaaacgatggtcaaacataacctcgtgcaaatggctgcctctgatgcccatggggtctctaaacgtaccttttacttaaaagaatgttatgagcaaatcgccaaggactttggtaaggaaaaagtagcacagatgaaacaagtcgcaaaggacctgatcaacggggatgagatcagttatccagtctatgaagaggtaaaaaagaagaagtttggtttattttag

SEQ ID NO: 2454 - DNA (genomic), 231 bp, Enterococcus faecium; double-stranded, circular
  misc_feature (B) LOCATION 1...231
  hypothetical: NO
  anti-sense: NO
cgaataaaaagggtgggttacgggaagtgtttttcgtctcgccctttttgttttaaaggcaataaaaataaaaagaaagaaggaataatcatgtttaaacgcgtacatctgatcgtcatggattcagtaggaattggagaagcaccagatgccgataagttcggtgatgttggttctgatacattaggacacattgcgaaagaagcaggattgaacgttccacttttataa

SEQ ID NO: 2455 - DNA (genomic), 192 bp, Enterococcus faecium; double-stranded, circular
  misc_feature (B) LOCATION 1...192
  hypothetical: NO
  anti-sense: NO
tcctcaaaaagagcatttgccacttacaattttgacataatatttggtaaaataattcacggcagtagaaatttcatgtataataaacagagttacgaagatgatagtaaggaggagttgttttgtcaggaaacaaacaacacccaagcaaagacaaaaaagaagccagtaaggcagctacagcagatataa

SEQ ID NO: 2456 - DNA (genomic), 1797 bp, Enterococcus faecium; double-stranded, circular
  misc_feature (B) LOCATION 1...1797
  hypothetical: NO
  anti-sense: NO
aactcaaaaaggaacggaggagtaagtatgactgatctaataaaagcaagtaaatttttctatcactatttgaagcggtacaaactctcctttttctttatctttatcacagtgatcattgctacctatctacaagtaaaggcacctcaatacatcggggaagcttttcaagaattagctaattacgtaggaggcttgatgcaaggcgtagacgataaaagcaaatttgtttctgtaatatggaaactcttgctgttttatgtactagctagtgcagccaactttatctatagtattttgttcacacaagtagtagggaagtcaacgaaccgaatgcgtatcggtctattcaacaaattggaaaaattgacgatccgtttctttgattctcatcaagacggtgaaattttaagtcgttttaccagtgacttagataatattcaaaatagtttgaaccaagctttgcttcaagtcatcacgaatgctgttttacttgtcgggatcttgatcatgatgttccgccaaaatgtagagttagcttgggctacaattgcttccactccagtagccgttttgatagctgtcttgattatccgcaaagcacggaaatatgtggatcttcagcaagatgaagtggggaaactaaatggttatatggatgaaaaaatcagcggacaacgtgtcatcatcacaaatggcttacaagaagaaacgattgaaggattcttagagcataatcaaagtgttcgcgaagcaaccttcaaaggacaagcttattctggtctactatttccgatgatgcaaggaatgtcactggtcaatacagcgatagttatctttttcggcggctggttagcattaaatggtgatttggaacgttcggtggcattaggcttagttgtgacattcgtccagtattcacaacaatattaccaaccactgatgcagatttcatctggatacagcatgatccaattagcgattacaggggcaagacgattgaatgaaatatttgatgaaaaagatgaagtcaaaccagaaaacggtaaagcatttgatggtgttgaaaaaggtcttgcgttgcagcacgtagattttggttattctccagaaaaactagtcttgaaagatgtctcgatcaatgtggacaaaggagaaatggttgctcttgttggtccaacaggatcggggaaaacgacgatcatgaatctgctaaaccgtttttacgatgtcaatgatggttcagtagtcatcgatggaatagatatccgagattatgatcttgatgcattacgtagacatgtaggaatcgttttgcaagaatctgtattgttctccggaacgatcaaagacaatatcacattcggcaaaccggacgcttcagatgaagaagtcatcaatgcagcaaaacaagcgaatattcatgacttcatcatgacgttagaaaaaggttatgatacagagatatccgaagaaaataacttattcagtacaggtcaaaagcagttgatcagtattgctcgaacgatcatcacaaatccatctttattgattttggatgaagcaacaagtaatgtagacacggtaacagaagcaaggatccaaaaagcaatggatgaagcaatcaaaggaagaaccagctttgtgattgctcaccggctgaaaacaatcttgaatgcagatagaatcgttgtcttgcgtgatggggaagtcattgaagaaggcagtcatcacgagttattagcagaaaatggattttatgcggaactttatcataatcaatttgtatttgaataa

SEQ ID NO: 2457 - DNA (genomic), 456 bp, Enterococcus faecium; double-stranded, circular
  misc_feature (B) LOCATION 1...456
  hypothetical: NO
  anti-sense: NO
aaatcaaaaaggaaaggatgtcgttttatgaaaaaagcagttattatttgtgcactagggataggttttgttggaggaaacgctatgtcatctgaagtggaagcaaattcagttcacggtgaaatctattacaaatctttaaagccaggagagattcattttgatgctaaaggtaatattattaagtcaaatttaccagtagaccgggaaatttctagaacagcaattaatcatagctctggaagatgggtttattatagtgatacaacttgtacgagaaaaacaggtcattctaaccactatagtcgtgtctataatcgtcacggtgcaaaagcgaaagttggaaactctattcgatcagcaaatgcaacaaaaggagtatgggcctatgcaagtgcgacaggaaatagaactgacacattctcatgttggtacaatccaaccggttggtattaa

SEQ ID NO: 2458 - DNA (genomic), 1536 bp, Enterococcus faecium; double-stranded, circular
  misc_feature (B) LOCATION 1...1536
  hypothetical: NO
  anti-sense: NO
atgaaaaaaagcaggttagagtattctttaataaattcttctatatcaatgtttatatatattttaaggatagtaatacaatttgtaggtagaagtttttttatttatttcttaggagcgaaatatttaggattaaatggtttatttacaaatatacttagtttcttgtcgttggctgaactaggcataggctcttctattatttattccctatacaaaccattagcccaaaaggatgaaagtaaagtaaaggctttaatgaatttgtataagaagacatatgaatttattggtatttttatcggcatagtaggagtattgattattccgctgttacctctatttattaaaaatagcacagacataccacatatgtatcgatattatgtattatttttattaaattcagttcttagttattttttcacgtataaaagatcacttgcaatagcagatcaaaaaaattatctggttgcgattaatgattttgcctttttattctttatgaacattgtacaagtaattgctttgtacttttattctaattttactctatttctaatagtgcagattttgtttactctattttctaatataaatatttccagaacagttgacaagagatattcatatttaaaagagaaagatgtagtttctctagataagcaaacaaaagatgaagtaaagaaaaatgtcataggtaatatgtcctcaaaaataggcggggttattgtaatggggacagataatatattaatttctacatttgttaatttaacagctgtaggaatttattctaactattcattgattgtcacaagtgtgcaaaatttatgtaagcaaattactaattctatcacggcaagtgtaggaaattttgctgtatcaaataaaaaaaaggattcatttgagctatttaaaaaacatttttttatcaaccactcactaatctttttttcttctatattgttattgactttaatgaatcccttcattagcttgtgggtaggagccaaatacatgctacctatgtcaacgactattttaattgttttaaattatagtgtacaggtttatagaaatacatccttcgtttttatagagtcatttggtttatattggtctcaacggaaaaagcctataattgaagcaggtgtaaacttgttattatctttgcttttgttaatagtttttgatatgggaatcaatggagtacttatagggactatcggatcgtctctaggatttgtgatttggtatgaagcatttatcatatataaaacggtatttgagaaacgttttattcatttctttttaactttctggcgaagttttatagaattaataatttcggcaatagtcgtttttctattaaatgaatatttagcaaatggaggcagtacgttccttcaatttataactaaaaccttaataactatagtaacaacatcgatattatatttgttattatattttagaagagaagaatttacatttatcaaaaaaattctttttaggtatattttaaaaaaatag

SEQ ID NO: 2459 - DNA (genomic), 912 bp, Enterococcus faecium; double-stranded, circular
  misc_feature (B) LOCATION 1...912
  hypothetical: NO
  anti-sense: NO
atgaaaaaaagatttttagcacttgccatcgtactaggcactggcttattgtcaggctgtacgaatgccggtgaaaaaacagccgttagttataaaggcggtacaatcagcgaacaagaagtaatggatagcttgaaaaaaatgcaaggagcagattccgctgtgcaacagttgatcgtttatcaagtatttgaagataaatatggagatgacgtatcaaccaaagaaatcgattctcaatatgatcaaacaaagaaacaattgggtgattcatttgattcacaattgaaatctgcaggttacacagaacaaacattcaaagacagtatcaaacaaagtctagcctttcaagaaggtctaaagaaacatatcaaattgaccgatgaagatttaaaaacggcttgggaatctttccatccagaagtggaagctcaaattatccaagtagcaagtgaagatgatgcaaaagatgtgaagaaagctgctgataagggagacgatttctctaaattagccaaagacaagtcaactgatactacgacaaaagaagatggcggaaaagtgaaatttgattccactactacaacggttccggcagaagtcaaagaagcagcctttaagttgaaagatggtcaagtttctgatgtgatcacttctaccaatgcttcaacttatactacggaatattatgtggttaaaatggtgaaaaaccaaaacaaaggcaacgacatggataaatacaaaaaagaattgaaagaaattgcaacagacacaaaattaagtgacagtaccttccagaataaagtaattggcgaagtattgaaagacgctaatgtaaaaatcaaagacaaagactttgaaaatgttttgagtacattcacttcagattctagtacagcaagtagtaaataa

SEQ ID NO: 2460 - DNA (genomic), 1245 bp, Enterococcus faecium; double-stranded, circular
  misc_feature (B) LOCATION 1...1245
  hypothetical: NO
  anti-sense: NO
aagaaaaaaaggaggaaatttttaatggtgaaatttatccatgcggcagatttacatatggatcggtcatttgaaggactgacaactcttgataaaactgtacaggaaaaactattgaagacgaatctgaccgttttatcaaatatcattgaacaggcaataataaataacgttgattttgttttacttgcaggagataattttcatcaaaatcgtccttcattaaaaatacagaaacatttttcagaacagatgaaacggttagaaaagaaccatatacctgtatttataatattcggaaatcatgatttctatcaaaaagagcggtattggttctcctttcctaaaaatgtccatttatttacatccgaaacggtagagacaaaaaaaataacgataaaaagtggagaaactgtctctctcagtggatttagttatcgtcaaccgtggattcaaaaagacaaagtgatggaatttccttctagagaactcacagattaccatattgggttgtaccacggggaacctggcgtctctcaaaaaggaaactatgctcctttccaaccctcaaagatgcaagaaaagggatacgattattgggctttagggcatatccatgtgccaacggtcttaaatgaaaagcaaacaattgtttatccaggtgcgcctcaaggtcatactaaaaaggaacaagcttctacatctattctactagttgaattaagtaaaggaagttgccaaatacatccgattaaagtagcagaggtctattggaagacaaaggaaatatcattgaggaaagcaagaacgacaaaagaggtcattgttcacattcgtcagcagctttcaaaagtagaggatggatttagtttaattgagataaaattaaaagattatgaccatctcaatacagatgttttggaacggatacaatcaggagagctattagactatttgttagaggaattctcagataggataaatgatttctttatttggcgtatttctctcatagagaatactttttatacgaagaccccacttgctgcttctgctaaattgatggaacagttatttcaatactatcagacacctcaagatttccaacaaattttaaatgaagtatatagtcatcaagaagcggctagaatattgagcgaactgccggaatatcaagaagaaacacttgaaaaagccaagcagctgcttaatcaagattttttatttgaggaggatcaggaatga

SEQ ID NO: 2461 - DNA (genomic), 1476 bp, Enterococcus faecium; double-stranded, circular
  misc_feature (B) LOCATION 1...1476
  hypothetical: NO
  anti-sense: NO
agagaaaaaagagaggtaaatcaaatgaaaaaatctttaaaacttgcatcagcagttatattaatgtcccaactccttatagcaacacctttccatgtgttggcaagcgaaaattcaacatacaaaattgcaaaagaaagaaccgagacgactgaaatgagtaattccgatgtaacagcagagagtagtgaacttttgacaacttcatcaagtgaaagtagtacgacttcaaatgccgagtcttcaacaacttcatcaagtgaaagtagtacgacttcaaatgccgagtcttcaacaacttcatcaagtgaaagtagtacgacttcaaatgccgagtcttcaacaacttcgtcaagtgaaagtagtacgatttcaagtaccgaatcttcaacaacttcaagtagtacaagtgaaataacttcttcgaaagtgacaaaaccaaaccatatagaatcttcaaaaaaggaagcgccaaaaacggaaggacaaacaaaaactttttcgacaccacagcaaatagaatcaacagaatctttccaatcacaaccaatactatctggtaatgaagaaattcattttgacaaaaatgaatctgtagaaaattttattatgaaaattggtgagtctgcgagaaaaattggtcagaaatatgatttatatgcttctgttatgattgcacaagcgatcttagaatctgccagtggtcaaagccagttagctcaggcaccgaattacaatttatttgggataaaaggaacttataatggaaactttgtcattatggtaacaaacgaagatttgggtaatggaacgctttatacgacccaatcaaaatttagagtgtatgaaaactatgaggaaagctttgaagattatgccaaattattaactaagggaattagtggaaataaagatttttatgcaggagcattaaaagctaatagtaaaacatatcgagaagcaactaaattccttacaggacggtatgcaacagatacacaatactatttgaagctaaatgaattaattaaaacctacgatttaaccaactatgataaagaagttaaaggtccacaaatgagtaagactggataccaagtgcctattcataattattcaataaccagtttgtttggaaatcgtggaaatgaatttcaccgaggacttgatatggcagctacacagggtgagccgattcatgcagttaaagctggtaaggttgttaaagcagagtttcactactcttggggaaattacgtggtgatacaacacgaagatggatcaaccgcgttatatgctcaccagcaacaatacctagtaaaaactggagataatgttttgcaaggacaaataattggctatgtaggaagtactgggaatagtactggcccacaccttcatttggaaatttgcaaagatagtagtctttctcagagcatgttagttgatccgaaaaccttattattcggagactaa

SEQ ID NO: 2462 - DNA (genomic), 231 bp, Enterococcus faecium; double-stranded, circular
  misc_feature (B) LOCATION 1...231
  hypothetical: NO
  anti-sense: NO
cttagaaaaagatgtgatccgaagcggttttcaaaatttgcaaccaggaatgaattactatcccttttatcaagaagcgcaaacacgccaaattgccgattggttgatcggcatgaacgcaagccctttgtatacgttaaatttacaacagaagggcgtacaaggtacattttcactaggacgtgttcaaacgcccaccttataccttatttttcagcgccaggaagctag

SEQ ID NO: 2463 - DNA (genomic), 1419 bp, Enterococcus faecium; double-stranded, circular
  misc_feature (B) LOCATION 1...1419
  hypothetical: NO
  anti-sense: NO
aaaagaaaaagaggtgctttgatgaaaaaatatcaatttccagcaaatttttggtggggttctgcagcaagtggcccacaaacagaaggaaggatttcaggcgatggaaaaggagagaacatttttgattattggtacaaaaaagaaccgcaaaagttctttgatcaagtaggacctgaaaaaacctcgcaagtttatacgaagtatcaagaggatgtacagttgatgaaacagactgggcataattcatttcgaacatctatccaatggagccgtttgatacctgatgaatctggaacaatcaacgaagaagccgttcgtttctatcatcgttattttgatgagttgattgaaaacggtatcgaaccctttgtgaatctgtatcatttcgatatgccgatgtatctgcaagaaaaaggcggatggttgaaccgagaaacggttgaagcctatgaaaaatatgccaaaagttgttttgaattgtttggttcgaaagtaaaaaaatggtttactcataatgaaccaatcgttccagtcgaagcaggttatttatatcgatggcattatccagaagagtcagatatgaaaaaagcgatccaagttggctatcatgaagcgttggcttcagcgttagccatcaaatcttaccatgaaatggagcaaggtggtgttattggtatcatcttgaatctgacaccaagctatccaagagacgaatcaaaccctgaagatgttaaagcagcgcaaatagcagatgcgttcttcaatcgttcattccttgatccagctgtaaaaggcgagtttccaagtgaattgattgagatagtaaaagaacttgatctcatgcctgtgatccatgcagaggatttgacggttatcaaagaaaatacagtagatcttttaggtatcaattattaccagccacgccgggtaaaagcaaaagaaacaccaatcgatactaaaaacggtccaatgcctgaggattatttcgacaattatgaaatgcctggtcgtaaaatgaatccttatcgcggatgggagatctatgaacaaggaatctatgatattttgatcaatgtacgagatcattatggaaatatcgactgctttatttctgaaaacggtatgggtgtagaaaacgaagcacgatttatcaaagaagatggcatgatccacgatgattatcggatcgaatttgtccaatctcatctgaaatatgtccatcaagccattcaagaaggtgccaattgtttaggctatcatatgtggacatgtatggataactggtcgtggaccaatgcatataagaatcgatatggctttatttcagtagacttagcacaagatggaaaaagaacaatcaaaaaatcgggtcattggttcaaagacgtatcagataaaaacggatttgaggcttaa

SEQ ID NO: 2464 - DNA (genomic), 438 bp, Enterococcus faecium; double-stranded, circular
  misc_feature (B) LOCATION 1...438
  hypothetical: NO
  anti-sense: NO
tctggaaaaaggagaacaaaaatgagccttaaagaatttgctgaaaaaagtctgctcaaaccttgggatgtttttattattttgcttttgactgttctttcttttttaccagtcatgatttttggtcttcagcaaaacaccgcaacagcagaaaaagaagcggtactgcgtgtggatggcacagaaatcaaaacattccctttgatggctggagaagagagcaacacatatacttacaaagatgaacacggagattataacttgatcgagatagatggcgatcgagtacggataaaagaagcagattgcgatgaccagatctgcgtacgtcgaggctgggcaacgaaaaatggcgaaaccatcgtctgtttgccacataaattagtgatcgaagtccgttcaacagatggaggtgacgaagacagtctgatttattag

SEQ ID NO: 2465 - DNA (genomic), 222 bp, Enterococcus faecium; double-stranded, circular
  misc_feature (B) LOCATION 1...222
  hypothetical: NO
  anti-sense: NO
ggaggaaaaagaatgaagatttatgtagtaaagtttggaaataaattttacagaagtgatgaacgttctataggggctaacaaattatccattgtagacatactccaaagtgcgagatggtttgatagcctcgaagaagctaaccaagtttcacgacgacttggtggattaacgcaagtatatgaactggtcactgtcgatcatgaggaggtagaaagatga

SEQ ID NO: 2466 - DNA (genomic), 213 bp, Enterococcus faecium; double-stranded, circular
  misc_feature (B) LOCATION 1...213
  hypothetical: NO
  anti-sense: NO
aatttgaaaagctattttctcttttgtttctctaatactcggatcagaacgctgatttcacattctctttttcttacatcttatctggtgcatgaagtcctagcaaacgaaggtcttctttcaataatacagtcactgcataaactagagctaagcgtgcttctttttgttcatcatcagctaaaatcttcgtatgagcatagtatttgttga

SEQ ID NO: 2467 - DNA (genomic), 444 bp, Enterococcus faecium; double-stranded, circular
  misc_feature (B) LOCATION 1...444
  hypothetical: NO
  anti-sense: NO
gtcatgaaaagcttcgaccgaaacgatccaatacaagccaaacactatcgacaagtgaaggctttatctcgacttctgatcaaacgacaggacacgcttgtttatgataaatggacaaaatggcgtaattttggttgggcctatttaaccgaaagtgaagtcgtagaacgtctactttctacttctgatgaactacgaatagcttatgcttactatcaagaaattcttcaagctttttatgacaaagaagcggacatcttctttcagcttgtaaaaacaatgcccaagtcggttccaagagaactgcatcatataaaaaaagcgtttataaactatgaatccggcattcgtttagccttagagttgccttactcaaatggcaaaatagaaaatctgcatacccacatcaaagcattgaaacgaatagcttacgggttaggatga

SEQ ID NO: 2468 - DNA (genomic), 291 bp, Enterococcus faecium; double-stranded, circular
  misc_feature (B) LOCATION 1...291
  hypothetical: NO
  anti-sense: NO
cacgtgaaaagaaagaaagcatgctatactcaattcaaaaagggagaatctagaaagaatatgccgatatcgtttgtaaaagatagagaggaaaaaggaaagtgtgtccgagaaatattactagacttgcctgagtggtttgggcttcctgaatcaacggaaaaatatatcgaggaatcaagtaaactacctttatggtgtgaaaaaagaaaagaagaatatttaggctttatcactctttcacagacaagtgaagatactgccgaaatctattctattgtatgggaataa

SEQ ID NO: 2469 - DNA (genomic), 975 bp, Enterococcus faecium; double-stranded, circular
  misc_feature (B) LOCATION 1...975
  hypothetical: NO
  anti-sense: NO
aaaacgaaaagtcgtgagttgcggtatagttttatgtataaaaacgaggagaattttatgagcaacgtcattatcaaagcaacaaacgaccaacttagtcaaatgaaagcatactatcgctcttatttgttaaataaacagattccttatactagctttgctgcaaaaaaagacgggacgaccattaccgcttatacatccggaaaagtgatgtttcaaggtacgaatgcagcaatagaagctgataaatggggggaggcacaggataaacaagccaagccagcaaaaacagcctcttctttgccaaaaaatatcagtcaattatccgttttaggtagtgatgaggtcggaaatggcagctattttggtccgctaacagtatgtgctgcttatgtgaaacgtgatcagcttgcagaattacgtaaacttggtgttagagattcaaaagagttaaaagatagccaaatcatccagcttgctgacatcttaaaaaaaaccatcccctataaactgcttgtcttatctccagaaaaatacaatgagatccaaccaaaatacaatgccgttcggatgaaagtcgctttgcacaatcaagcgatccatttgctgctaaaaaaaatcgagccagaaaaaccagaagcgattttgatcgatcagtttacgccggaagcaaattttaaaaaatatgcgcgtttagaaaaaaatcaattacaagaaaaactgtacttcgttactaaaggagaacaatatcatttagctgttgctgctgcttctatcatcagtcgtgccagctttttggaagagttacacaaagcatcagctgaagctggaatcacccttccatcaggagctggaacgaaatctgaccaagtagcggcaaaactattggagaaaggcggcatgcctatgcttgaaaaatatgccaaacttcattttgccaatacagaaaaagctttgaagctgctaaaaaaataa

SEQ ID NO: 2470 - DNA (genomic), 627 bp, Enterococcus faecium; double-stranded, circular
  misc_feature (B) LOCATION 1...627
  hypothetical: NO
  anti-sense: NO
aaacagaaaagagggaacaaaatgacctacatttttgaaaaaggaacaagtggcaagcatttgatcttacttcatggcacaggtggcgatgaacattctttactggatatcgctcactttcttgcaccaaacagtacattgctttcttttcgtggcacggtccaagaagatgggatgaatcgttttttcaagcgtaatggattgaatcaattcgacctggacagtttggaaaaagaaacagataaactccatgaaaaaatcaaagaaatcagcgaaaaagaactgataccgttaagtgactggctgcttgtcggctattcaaatggcgcaaacatcgctgctcatttattattggagcgtgagaccgagctaaataaagggttgtttttccatccgatgtctctaggtgttcatcaaagccgttccacattagaggataaaaccgtctggatttcttatggtgataacgatccaatcgtttcccctgcttcctttaaagaattggccgatcaattcgaaacacgccaagcaaatgtgactattcagctaactgtaacaggtcatcagttgacgatggacgaaatcaagcaagcgagggaatggacagaccacctcttaactaaataa

SEQ ID NO: 2471 - DNA (genomic), 924 bp, Enterococcus faecium; double-stranded, circular
  misc_feature (B) LOCATION 1...924
  hypothetical: NO
  anti-sense: NO
tcttggaaaagcagcagctatatcgattctattgttcatcattattgcagcggtcgtcttgctctcacgaaagaaggtggacttgaaatgaaaaataaaaagagcaggaaaatcttattttacgcgacgattttgttgctattagctgtcaatttgtttccatttttgatcatgctgatgacatcattcaaggattcacaagaagcaattgcaacgacacaaactatttttccgaaagaatggacttttgaacattatcaggatattttcaatgctgagatttttccattcatcatgtatttcaaaaatagtttagtgatctccttgatagcctccgtaactgcagtagtgattgggatcagcggggcatacgctttgtcaaaactacgcttcaaagctcgctcgaaaatcaatgctagcttttacaccgtttatatgttttccggtattttgatcgttgttccattatttaaaatcatttccggtctaggtttgtatgataccaatacagcactgattatcacgatggtcgttcaaacacttcctactgcgatattcatgctaaaaagttattttgacacgattccgactgatattgaagaagcagcaatgatcgatggtcttagccggatccagatcattattcggatcattataccattggctatttctggaatcatttctgtcttcgtttattgctttatggtttcgtggaatgattatttatttgcttcgattttcctgtcgacctccgaaaaatttactttaccaatcggtttgaacacattattcagtacaccagactacatttggggacgaatgatggccgcttcattggtgaccgctttaccagtcatcattatgtatgcgttatctgaacgatttattaaaggtgatttagtcgaaggcggcgtaaaaggataa

SEQ ID NO: 2472 - DNA (genomic), 3540 bp, Enterococcus faecium; double-stranded, circular
  misc_feature (B) LOCATION 1...3540
  hypothetical: NO
  anti-sense: NO
aggaggaaaagcatgtctttacaatttattcttggaaacgggaaaaaagatcaccgtcaagtcttgatcgacgaagcatccgcttggctcgaccaggatgcaagtaaccaagtatttttccttgttcccaactacagcaaattcgaacaggaacaagaaattttagcggagatgcgaagaagaagcggaaaaaaaactttcagcacaacaaacgttcaagtatttagtttttatcgtctggcttggtatttgctgcaacagacaactcttcttacaggaaatgaattatcagaatcaggatctgcaatgatcttgcgacagattttagaaaaaaatgaggaagaattaacaatctttcgcggagaaatcaataaaagagggtttattcgtcaattacaagaactctacagtgaattgcgtacaggaaatattcaaccagaagacctgatgcttttatttggtgattcacctaatgcagaagaccagcaacttaaaatgaaagacttgaagctgattttttcagcttatgacagcgaattgactcaacgtgcactaacaaatgaagatgcactatctatactagcaaattatatgcagacacaagatttcaacaacgtcaaatttattgtcagtggtttttctcgaatcaatggtcaagagtatcaattactgcaggcaatgatggaaaaggggcaattggttgtcgatttattgctggatcgtccttatacagcggatcttccagaagtacttacgctctttcatgagactggaaagctttatttccgtctttttcaaagtgcaagagaacggaaagtccctatattagtggaccgatttgcaccagagcagactcgtccgacagagcttcaactgctgcaaacaatgtgggaagagacatctagccaaaagaaagcggcagtacacaaaatagggggacaagagcatctccatttgtgggaagctgaaaatccaactgaagaagtccgacaattagctgttgaaatcagacgactagtcagtgaagaaaactaccgttatcgtgatatccaagtgctgacaaaaaatatgtctttatatggaaatatccttcggccgatctttcaagaaatggcaattcctttttatatcgatgaagaacaaatgatggaaaatcatccgctgatcgaatggatcaacagtctgttcgctcttgaccgctattcttatcggctaagtgatattatgcgttttttcaaaactgaattatttctgtcgacggaagcagaaaccgaacttgatgaatggaaacaagagcgagatgaattcaggaaaaaactggacatcactgaaaatgtagcacttgcttacaattatcaaggaacttattggactcgtgaaaaagactggcagtttgtggcgtatgattttgaagcagaacagattgaagacgtacagtatttggaagaacagtcaaatacgattagacgattatttcagaaagctgtaccagtatttttgaaaaaaataaagaaaagcaaaacaggacaagaggccgcaaatgttttttatcaatttttgatccaaagtggcgtacagcaacaattattgttttggcgtaatcaggaagtagacagaggaaacttagaagcggcaagaaaccatgagcagacatggggagcgctgattgatctgttggatgaatatgtagtaatttatggtgaatcggcttttgactggtcactgttccaagaaatcattacaagtggtctagaaaatctaagttatggtaaaatccctaccgcaatcgaccaagtgcgaatcaatcgtttggaattagttcgaccaaatcaagctgccgtcacttttgcattagggttgaatgatcaagtgtttccagaccgaaaagagacaaaaggattgttgtccagtgaagaacgagaagtattaaatcaggccttgccagatggacagtttttattcgacccatcaaaggaaagtatctcttttgagcctttccaagcctatcttgtttttctttccggaacagatcgattatatcttagttatgcacaaagctatgacacagatggttcgctgaagatgtctccttatttgcgtagaatcacagaatatttatctgttcccgtcgagagaaaagagcatttgacgatcgaaagcgaccctaattgttatgtagggacttacagaagcggaatcaatacagtcaataggatttatcgattagctttagatgaaaaaaaacctgtaccaaagcactggcaaaagctcaaagaattagtactgaattcgtcatggcgaaattttgctttacagatttttgaaagtcaggaacatttaaatgttcctgtttcgatgccagaaaaaatggcggaagagctttatggaaaagagatttatacttcaatttcacgtatggagaatttttataattgtgaatacaaatacttcatgcaatttggtttgaaattgaaagaacgaactgtttatggtctaactccagcagcaactggtgatttttatcatgaatcattggatcgtttcttcaagctactgttttcaaaccaattatccttagtgaatatgtccgatgcgcagcgtagagactttactgaaaaagtgctgcaggaagtattcggagaacttcggtttgagatattggatagttctgcaagaatgaactatatccgctaccagttaggacagacgattcaaaaagtgacatgggctttgcaaaaacagagcaaaaatacaggcatgcatcctcttcagacagagattctatttggtcagattgctggagcaaaaggtatcacaggtctggaattaccgttgagtaatggtggaaaactccatgttcgagggaaaatcgatcgaatcgatgtagcttctgaacaagaagatacttggctaagcgtcgttgattacaaatctagcggacgttcattcgatgtcacagaagcttattatggcatggctatgcaattattgacgtatctggacgtagcattgatggatgcggtacgtttgactggaaaggcggctgttaaaccagcaggatcatattatttacatgttcataatcctgtattgacggagacagatgatgtagagaagaatacattgaaaaaatttagttatgatggcgtttttgtcgatgatcccgctcttttagaagtactagatcattcactggaagcaaaagaacaatcactgatctatccagtgaaaaaaaatgcgaaagatgaataccaaaaaggtagtttcagtaaagacaaatttttcacggaagaagaactgcaactattcatggcgcataatcgggaaaatatgcggttagctggagatgcgattacttccggagaaatcaaactaaatccagcttataaagataaacagcggattgcctgcgaattttgtccattcagaagcatctgtacgtttgatgtgatgctgaaagaaaataattaccaccgtctggagaaaatagataaggaagaagcactgcgtagaatattgaaaaggagtgaagaagagtga

SEQ ID NO: 2473 - DNA (genomic), 825 bp, Enterococcus faecium; double-stranded, circular
  misc_feature (B) LOCATION 1...825
  hypothetical: NO
  anti-sense: NO
aggaggaaaagcatgtctttacaatttattcttggaaacgggaaaaaagatcaccgtcaagtcttgatcgacgaagcatccgcttggctcctacagtctcttgtgttccaagaattaagaaaattgatggaatcgaaaataccgaatagaacggttgagtatttagatagtagaatatctcgttactcaatgaaatcaggcaagtgtgagattacaaaacaatttttgccagcaaaagccgttcactgtcatcactatttgccaaaaagtcttggtggagacgacaaattcgataacttgagaattattcataaggatatccatcttctgatccatacaacaaataaaatgataatcgatcactacgtgcatgaactgaaactggtgccagagcagatagcaaaaatcaacctttatcgacagatgtgtaatctgctttaccttcacctcatcataaataaattgaacgccgccccacgtggagggtcaccccttcccctgtggagcgggggagggagaaaaaaaaaaaatttncttcttccccccccccccctaaattttctcaaaaaaaaaaaaaggggggagaatttaaaaaaacccccacaccaaacccgaaagtttggggtccgccaaccgtggttgtcttttctgaaattttgggggttgcccaaaagggccgggagtgcgaaatattttagggaaaacggaatcccgcgaaacaattccactttccccgttggctttgtgggtccgtatgaattgaaactcggaatattccatgaaaggttggggggagggtcaaaaaaaaacttctcttatgaaacc

SEQ ID NO: 2474 - DNA (genomic), 462 bp, Enterococcus faecium; double-stranded, circular
  misc_feature (B) LOCATION 1...462
  hypothetical: NO
  anti-sense: NO
tttgttgaaagaaaaagggatcttattagaagatacaccgcaaggaacccgatggagaagagaagcatgagagattacacacaattgaacggtttagccttggcttatgttggagatgcgatttacgaaatctatgttcgtgaccacctgattgatcaaggagaaacaaaacccaataagctgcatcgtgcggcaacgaattatgtttctgcgaatgcacaagcctttttgattcagcaaatgctggaagaacatcttttgacagaagaagaagaactttattatcgcagaggaagaaatgctaaaagccatacgagcgcaaaaaatgctgatgttacgacgtatcgggtcgcaacagggttcgaagcgctcatgggctatctgcatttgacaaaacaaaccgagcggatggaagaattgatccgctggtgtattcagaaagttggtgaaaaaaatgggtaa

SEQ ID NO: 2475 - DNA (genomic), 219 bp, Enterococcus faecium; double-stranded, circular
  misc_feature (B) LOCATION 1...219
  hypothetical: NO
  anti-sense: NO
tctgttgaaagagccaaagctattagaaagaatcaagcaagaacatcaagaaatagtagcaagaaaaaaacaagagggcgctactttctagtaaaaaataaacttgtgtgtgaaagttataaaaataattttcagaaaaatgaaaaaatattttctttttcattgacaaatgatcttatggaaggtaaacttcgtacaagtcaacttttcacgcagtag

SEQ ID NO: 2476 - DNA (genomic), 327 bp, Enterococcus faecium; double-stranded, circular
  misc_feature (B) LOCATION 1...327
  hypothetical: NO
  anti-sense: NO
gcaaacgaaagaaaaagataccttggtatatggtattgttactggttttattggaattgcgttcttagtttggtatgtgatcgaaacaatatgagtaaacaagataaaaattattcagaagagacagatttagtactgaaaaatcatttaaaggacacccgtagagaattagggctttctcaacaacaactcgcagatatgatcggtgtttctagaaatacgattggttcaatagagagatgtgtgtttgttcctacagcaaaattagcattgatattatgtatcgctttagataaaaaatttgaagagttgttctactttgattaa

SEQ ID NO: 2477 - DNA (genomic), 486 bp, Enterococcus faecium; double-stranded, circular
  misc_feature (B) LOCATION 1...486
  hypothetical: NO
  anti-sense: NO
aaaaacgaaagaatgaataaaatgaaaaagttaataatagtagttacttccttgattgccatgattgttattttagtcggatgtagtaatgaaaaaaataaacaaactaatcaagataatggcgtattgaaatcaggaactatgtggaaagaagaagtaggtggtcttgtttataatttgaaaattatagacgagactacctgggaatactctgagagtgtatggcatccagatcctgtacaaataacagtcaagaggcaaaaagactataaaggtttagaaagatacaaaatagtagattcagctagtgttagggaatttataaacaaatctgattctttatttattgttgttccctatgagaagaatggcgtaaaaaaaataatttttcttggatctagcaaggatgaaaagcgaacgaaagagaaattgattcacgatggatcacaatccaataaatataagttacaaaagactagcgagtga

SEQ ID NO: 2478 - DNA (genomic), 366 bp, Enterococcus faecium; double-stranded, circular
  misc_feature (B) LOCATION 1...366
  hypothetical: NO
  anti-sense: NO
gattgcgaaaggagacggaacatgaccgaggaattctatagatggctattacagttgacaagagaagatcgtttggttaagttctatcagtctcctaaatggcgcaggcttagagagaaagcgatgaaacgagatcactatgaatgccaagagtgtagaagactaggtaagtatcatagagtagagaacgttcatcatataaaggaagtcaaggatagacctgacttagctttagatttagataatcttatttgtttatgtgttgaacatcataatgaagttcatggcagatatcttacagcattagataaacaagagaagaagatagaaagctttgctaacttcgatgcaagtgaaaggtggtaa

SEQ ID NO: 2479 - DNA (genomic), 2091 bp, Enterococcus faecium; double-stranded, circular
  misc_feature (B) LOCATION 1...2091
  hypothetical: NO
  anti-sense: NO
aaagcagaaaggaattttatgaaacaactaattctagcggaaaaaccaagcgttgcgaaagacctaagcaaggtgcttggtgctaatcaaaagcacaaaaattattatgaaggacccaaggtgatcgttacttgggcccttggtcatttattaggattgaaaatgccggaagatctgaataaggaatggcagagctggcaaatggacacgttgccaatgatccctaaaaaactaggaatcaaaccacttcctaaaacaggacatcaattaaaagcaatcaagcagctggctcagcgaaaagatgtctcagaagcagtcattgcgacagatgccggaagagaaggggaacttgttgctcgctggatcttagagtatgtgcatttcaataaaccagtgaagcggttatggatctcttctcaaacagataaagcaatcaaaactggattcaagcaactaagacctgcgaaagaatatgatgcattgtatgaatctgctcttgcccgggcaaaagcggactggctggtaggattgaatgtgaccagagccttaactgtgaagtacgcggataatttatcagcaggccgtgtgcagacaccgacactagcattagtgagagaccaagaaaagaaaatcgagcagttccgtccacaaacgtatttcacgatcacgttgcaagctggaaaagaacaagccaaaatgcttcaaaaaaatcaatttgctttaaaaacacaagaagaagcacaaaaacttgttcaattgatcagtacaagcaaaggaactgtcacagaagtccaagaaaaattaaaaacggaatctgcgccattgccttatgatttaacagagatccaaagagaagccaatcaacgctatggctattctgcaaagaaaacattaagtcttgtacaaagtttgtatgagacccataagatcgttacttatccgcgtacagacagcaaatatctgacaaatgacatgaaaagtacgatgaaagaacgattgcaagcagtcagcgactttgctcctgaggtcaagcagtatttgaaaaacggagccatcgtccaacagacaaaagtattccaagacagtaaagtgaccgatcaccatgcacttttgccaactgaaaacagagcacgttatgaaaaattaagtaatgaagagcgaaaaatctatcaaatgattgtctctcgttttttaggactgtttgctcaaccccataaagtcagccaaacaaaagttacggttgaatttggtaaagaacgattcatttttcggcaaaatcgtgtcgtccaagcaggatggaaaggcgaaactgaaactgagacggaaacagtcaaatgggaaaaaggaatgagaatcaatcccgatttcgccatcaaaaaagaactatctgcaccgcctaaaccattgtcagaagcaagcttgcttggtcaaatggaaaaatacagtctgggaaccccagctacgcgtgcagagattatcgagaaactaatcaaatctgaactgatggaacgtacccctcaaggactgcaagtatctcctaaaggtaagcaattattagtattggtaaatccctctttagtaacaccagatttgacagaaagctgggaaaaagaccttgaagctattgctgcaggaaagaaacaagcaggaaccttcttgaatggaatcgaaaaagaaacaaaacgcttggtgaatgagatcaaatcaagcaaacaagaatatcaagatttctcgattacccaaaagaaatgcccagaatgtggggccaatctgcgcgagaaaaacacacgtgacggcaaaatctatgtctgcaccaattcagattgcaactaccgcagaagaaaagatccaaaagtctctaatcatcgatgcccgcaatgtcaccggaaaatggaaatcatcgaaggtaaaaacggtgcttatttccgttgtaaatacgatggaacgacagaaaaattgcttgataaaaaagagcagaagaagaaaatgaccaaacatgaagaacgacgcttgctgaaaaaatatgcacaagcagaagaaccagaagaaagcccattagcagcagcactaaaagcagcaatgaagaagtaa

SEQ ID NO: 2480 - DNA (genomic), 672 bp, Enterococcus faecium; double-stranded, circular
  misc_feature (B) LOCATION 1...672
  hypothetical: NO
  anti-sense: NO
tacaaagaaagtctatatgataactataaaaaggagagcaatatgaaaattgtttttttgcatggtctaggccaagacgaacaatcatggaaagatgtaatctcttatctacccaatagttattcttgcaaaagtctttcattgttcaatcatttaaacagcacagacactgctactttagacgacttaaccaaatacatcgaagtacaattgaatcagataaaggaaccttttattttatgtggattatctttaggcgctgttattgctttaaactatcttgcaactccttctccatatttaaaaaaggttgttttagtcgctccacaatttgagtctcctaatcgcttattgcttactttccagaatatttatttttactgcgtaccttctaagatatttgaaaaattaggtctatctaaaaaacaaacccttaccctacttcgttcacttgaaacattagactgcaaaaaacagcttcgtacatcacgacttcctaaattgattttatgcggtaccaaagatcatgcgaataaaccagcagcaaaacgtttatataaactttcaacgaatggccggctactctttattaaaaacggaaaacatgaattgaatagagaaaagccagaaataatggcacaagctatgcgatcttttatcgaaaatagttaa

SEQ ID NO: 2481 - DNA (genomic), 969 bp, Enterococcus faecium; double-stranded, circular
  misc_feature (B) LOCATION 1...969
  hypothetical: NO
  anti-sense: NO
tttcgagaaagtccaaaaaggaggtatacattgagatactactttgtggatgaagaaaagaatgtaatagaaacagatgaaaaaaaatataattggctcgtacttgatagtgcaaagcccgaagagattgagcaagcaatcgaagaattcgagcttcctgatgatattttcgtaggaaccgaatatccggaagaagtttctcggatggagcgcctttatgagacgaaactagagcatccattttctttggtagtgattaatctagatcagtcagataatcgtatcgaaaaaaaattaacgccaatatcttttgtactttccgataatctcttgattacttgtatcgatagaaaaaccgaatttgtggatcggctgctgacaaagcatggaaatcatttaaactcgtttgaaaagatcatcacgtatacattattagatatttacacccattacgtgaaagaactaagagagatgaaaaagcgaattgacgctttggataaagcagctcgtaaaacaacggaaaatgaagaactgtataaacaggcagatcttgaaagagacatcgtatatatcgatcataccttaagagatcaacgggaaacaatggatcaattatggaattctgaaactttcatcaaacgtttagacgatgaacagctactctatgatgtccatttgagacagcgacaaacagaaaaaatgatcgagatctatcgagatttattagagagtattggtgatctattcaacgggatgatggacaataatctaaatcatatcatgaaatatctagattcagctgcattaatcatttccgttccggcgttgttcgcagggatttggggaatgaatacaggaggattaccgggtaaaagttctgctctaggctttatactcgtagtctttggctctttgatagcagcagtagttttaggttaccatttataccggaaagattatacaaattaa

SEQ ID NO: 2482 - DNA (genomic), 858 bp, Enterococcus faecium; double-stranded, circular
  misc_feature (B) LOCATION 1...858
  hypothetical: NO
  anti-sense: NO
acaagagaaaggaaatacaagatgattggtctgatttattttgtggtgatcgttctggcgaacacagttggcgctatttccgggatgggtggaggcgtgttgatcaaaccgattcttgatcttatcggcgcccattctgttgcagggatttctttttactcaacagttgcggtattcacgatgtccattgtttcgactgtgcgacaagtatcaagcgggaaatcactgaattggcagattgtcggttgggtatctagtggagctgttgttggaggagtagtcggcaacattgtattcgaagtttttttacagttatttgaaaacgagaagcatgtgcagctgatccaaatttttttgacggtattgaccttggtttttgcgttcttctacaccaagcatcatcagccaaaatttcatttgacgtcatggacttggtaccttatatgtgggggggttctgggctttttagctagttttttaggtattggtggtggaccagtcaatgtttctttgttgatgctgatgtttgcattgccaataaaagaagcaacactatattctctatctacgattttcttttctcaactggcaaaattggtaacgattgctttaacaagtagctttatgcgctttgatttatctatgttgttttatgttatccccgctgctgttattggaggtttgtggggagcaagatttagcagggttttgtctccaaaaaaagtgacctttatttttcaagtaattgtcctcgtggttcttttggtcaattgttacaatgcctttgtcatcttacaaacattaggagaatctagactaacgcaagtcaaaatcactgaaacatattgttctaaatga

SEQ ID NO: 2483 - DNA (genomic), 228 bp, Enterococcus faecium; double-stranded, circular
  misc_feature (B) LOCATION 1...228
  hypothetical: NO
  anti-sense: NO
ttccaggaaagtatccaaaagcgtttcattgtgtcgaacggatcaatgagtatcttcgacaaacgcaaaaaacgggaaattggggatcgcagagcagatttatttttaacgattcaatattccaagagtagtaaagtgaggaaaaaaagcatcccattcataaggattgttactgtatggccaggcaaaacccggattgaaaaaaatagggttcacgaatgtttgtga

SEQ ID NO: 2484 - DNA (genomic), 636 bp, Enterococcus faecium; double-stranded, circular
  misc_feature (B) LOCATION 1...636
  hypothetical: NO
  anti-sense: NO
aatcgggaaagtgatcgccaaagaaaaacatcgtgtggtgtttataggagaagaacgatgagaatcgctgtttttgcttctggaaacggaagcaactttcaagcgctagccgattatctatcgaaaaaaggattggaatcttcgattgactggttgttttgtgatcagcctgaagcatatgttttgaaacgtgcaactgcgttgagtgtaccggcagattgtttttcacctaaagaatttgattcaaaaaaagagtatgaagaagcaattttgcataaattgaaagaaaaaaagatcgatttgatcgtattagctggatatatgcgaatcattggaccggtattgctgaaaaattatgataaaagaatcatcaatatccatccgtctcttttacctgccttccctggtttgcatggcatacgtgatgcctttgaagctggagtaaaagaaacgggtgtcacaattcattatatcgaccaaggtgtagatactggaccaatcatccggcaggaaaaagtgagaattgaacaggaggacacgttcgattctttagaagaaaaaatccatagagtagagcatcgaatctatccagaagtgattagtgaaattattgaaaatggaggctatctgaaatga

SEQ ID NO: 2485 - DNA (genomic), 216 bp, Enterococcus faecium; double-stranded, circular
  misc_feature (B) LOCATION 1...216
  hypothetical: NO
  anti-sense: NO
ccaaatcgaagcggcgtaatcggaaatatcaataacttcaacgtgatttttcttttaactgtcaacggaccgacaaactcaaacttttatggtgcaggttccactgatcttctagttacttggctatacctgactgtcactaaaatagattacaatctagcttccgttatcggtatcttgatctttatctatatgcaaaaatttatatactactag

SEQ ID NO: 2486 - DNA (genomic), 288 bp, Enterococcus faecium; double-stranded, circular
  misc_feature (B) LOCATION 1...288
  hypothetical: NO
  anti-sense: NO
actagccgaagagccacgtatacagcggtttgttccgtcttatttcctaatggtgactttcctagtaggagtcgattcactcgcttaagttcaaacttagcttacactatcaacattattcgatgctatttcatcaagaagctcaccttaggtgaagtantcggaatgatagatacttttcctagtccattatgtaaaccatttacaaatagatcagcaccactattgaatccaatagccaacgttggctatatctcaacaaaaaaatcttatcttgatggttcttaa

SEQ ID NO: 2487 - DNA (genomic), 834 bp, Enterococcus faecium; double-stranded, circular
  misc_feature (B) LOCATION 1...834
  hypothetical: NO
  anti-sense: NO
cagctacgaagaataggggggacaagaatgaaaacaatgcgcaggatctattccgtcccttatattttgtggctcggtttattcgtgatcgcgcctgtattaatgatcatttatcaatctttttttgatatgaatgggcaattcacgctgaataattatctatcttattttacgtcggggacatcgctttctatgacgatcaattctgtatggtatgcatttttgatcacgtttttcacgctgatcatcagttacccgactgcttattttttaacaaaactgaagcacaagcaattatggctgatgctgattattttgcctacatgggtgaatctgctgcttaaagcttacgcatttattgggattttcagtgtgcacggcagcgtgaatcatttctttgattttatcgggatcgggccgaaacagatattattcacagacttcagttttctgttcgtggcaacgtatatcgagattccatttatgattatgccaattttcaatgcattggaagagatgaatccttctttgatcagtgctagtagagatttaggcgcgaatagctttgagaccttccgacgagtgatttttccgttatcattaaatggtgtgaaaagtggtgtccaagcagtatttattccttctctttctttattcatgctgactcgtctgattggcggaaatcgggtgatcactttaggaacggctatcgaacagcatttcttggttacacaaaactgggggatgggttctacaatcggtgtgattttaatcattgctatgttcatcgtgatgctcctgacaggcgagaagaaaaaaggaggtcgctcataa

SEQ ID NO: 2488 - DNA (genomic), 210 bp, Enterococcus faecium; double-stranded, circular
  misc_feature (B) LOCATION 1...210
  hypothetical: NO
  anti-sense: NO
aattttagaagaatttggatttacagtagaaaatgtcgtgaatacgtacaatcaactatcatagatccaagcaattgtttgactgataagaacagctgtctgcaagttggagacagctgttctttatgtgttagaagaataaatcaatattacttttcgttttcggctatgttacatttaaatgacaaaacaaagaattcttcggattag

SEQ ID NO: 2489 - DNA (genomic), 723 bp, Enterococcus faecium; double-stranded, circular
  misc_feature (B) LOCATION 1...723
  hypothetical: NO
  anti-sense: NO
ttatctagaaggagtgaagctatgaaccatttagatttatctcagcgcttagccgcagtgggtgactttgtccctgaatccgctcgtttagcagacattggatcagatcacgcttacttacccgttgcattgatattaagaggaaaaatcgaatatgcagttgctggtgaagtcgttcaaggtccttatgaatcagcacgtaagcaagtcaaaaaagatggattagaagaccgtatcaccgtacgccttgcaaatggtctagatgctatccagccacaagatggtattacagctgtcacgattgcgggtatgggaggttcactgatccgagatatcctagaagctggcaagttgaatcaacgcttaagcggacaagaacgtttgatccttcagccaaacatcggagagcgtacattacgatcttggctgcaagaaaatcagtataaaatccaatcagaaaaaatacttgaagaaaataaaaaaatatatgaaatcattgtagccgaaaaagaacaaaaaccagttacttacaatgaaatggagctgatgttcgggccatttctgcttgaagagaaaagtgagatcttcaaatcaaaatggacaagagagcttcaacaaagaaaagctatccgtgaacagctcaaacaagcagctaatcaagaggcacgtcaaaaacaaatcgagcaggaaatccaaatgattgaggaggttttaaagccatga

SEQ ID NO: 2490 - DNA (genomic), 777 bp, Enterococcus faecium; double-stranded, circular
  misc_feature (B) LOCATION 1...777
  hypothetical: NO
  anti-sense: NO
aaggatagaaggcctttggaaaaaagtgagcagaggaatctaaaagactggaatcagctattaaattttttagccgcacctgaagaaggaaattttgaggaactgacggcacctacacttattttagctggaaactgtcttcctatcttagctgataaagcagcacaaatgtatttaaatggccaagtaaatcaattgtttttggtccgaagggtggggcatgcgactagaatcctttatgagaattttgaaaagcaaagatttcattttgaagatggcatgagtgaaagtgaaatctgtcgtcagtatctaaaagaaatctatgatttggccgataaggcttttctgatagaatcgaagtctacaaattctggagagacacaccactttttcactggagattctccatcccttagagctgtaccagaaaaaatcttattgatgaatgatccgacactgcaacgcaggactcgagcaacttttgagaaagtatggcaaaatgaacacactattttcgcgaatgctgtgccatttgtgccggaaatccttcacttttctgaagagatcatctttacagcaaaagaactgaatcatcaatggcctaaggaatatttccatgcgctagtattaggagaaatggaacgtctccatgacgatgagaacggctatggtccgaaaggaaaagattttattcctcacattgatatatcagaggaagtttggtcttcttacaccagaattaaagagtcaataaaaacggatttttctcgtacttga

SEQ ID NO: 2491 - DNA (genomic), 975 bp, Enterococcus faecium; double-stranded, circular
  misc_feature (B) LOCATION 1...975
  hypothetical: NO
  anti-sense: NO
atgggtagaagattangaggaaaaaggatggaacaagcgtatcttgacttaggaagaaaattgttggaagaagggcatcgtaaagaagacagaacaggcacaggcacattaagcttattcggataccaaatgcggtttgatctgcaaaaagggtttcctttgttaacaacgaaacgagtaccttttggattgatcaaaagcgaattgctttggtttttaaaaggagatacgaatatccgctatctattacaaaataaaaaccatatttgggatgaatgggcatttgaacgctacatcaaaagtccagactataatggaccagatatgactgattttggccatagatgtttgacagatcctgaattcaatgaagaatataaaaagcagagcaagcttttttgcgagaagatcctaaccgatgattcctttgctgaaacatacggcgatcttggacacatctacggctatcaatggcgtcactgggaaacaaaagacggtggctttatcgatcaaatcaaacaagtgatcgaagcaatcaaaaagactcctgattctagaagattgatcgtttctgcatggaatccggaagatgttcctagcatggctttgcctccttgtcatacgatgtttcaattttatgttcaagagggacggctaagctgccaattgtatcaacgcagtggggatgtgtttctaggcgttccgttcaacattgcaagttatgcgttgctgactcacctaattgcacatgaaacaggtttagcggttggcgaatttgttcacacattaggagatgctcatctttatatcaatcatatcgaacaaatgaaagaacaattgagccgagaaatacgcgcatttccgactttagttttgaatcaggaaaagcagtcagtatttgattttgagatggaagatatccaattagaaggatatgacccacatccggcgatcaaagctcctatcgctgtttag

SEQ ID NO: 2492 - DNA (genomic), 300 bp, Enterococcus faecium; double-stranded, circular
  misc_feature (B) LOCATION 1...300
  hypothetical: NO
  anti-sense: NO
aacaccagaagttggacagcggattctagcatctgctatggaggcaccagttacagtgatggacacagccggagaaggtggagcgtggggaatcgcgttattagcagcctatatgatggatcgacatgggaagtctttagaaaacttcttggcagaagacgtgtttggacaagaccaaggaatcaccatcacaccttcagcagaagaaatagcaggctatcagatatttatgagaactgttaccgtgagggatcgacattgaaaaaacagcgattcatcaattgcaagaaaaaggagtga

SEQ ID NO: 2493 - DNA (genomic), 339 bp, Enterococcus faecium; double-stranded, circular
  misc_feature (B) LOCATION 1...339
  hypothetical: NO
  anti-sense: NO
ctcaaaagaagaagcgatactttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 2494 - DNA (genomic), 1254 bp, Enterococcus faecium; double-stranded, circular
  misc_feature (B) LOCATION 1...1254
  hypothetical: NO
  anti-sense: NO
tcaaaaagaaggaggcaacacaacatggataaacctattcacgttttctctgaaatagggaaattaaagacagttttactgaaacggcctggacaagaagtggaaaatttgacaccagatattatggatcgtctgttgtttgatgatattccatatcttccgattgctcaagaagaacatgacaactttgcaaagaccttgcaaaacgaaggcgttgaaactctttacttggaaaaattagcagcagaagcgattgacgcaggcaacgtcaaagaacaattcttgaataaaatgttggatgaatctcatatcgcatcgaatgcagtaagagatggtcttcatgagttccttctatcaatggaaacacaagaaatggtagataaaatcatggctggggttcgtacaaaagatatcgaagtacgttctagcagcctatatgatctttcagcagacgacgactatccattttacatggacccaatgccaaacttgtactttacacgcgatccttccgcatcaatgggaaatgggatgaccgtcaataagatgacttttgaagcacgtcgtcgtgaatcgatgtttacagaatatattttgaaacatcatccaagatttgccaataaagggattgaagtatggttggatcgtgaaaatccagatcatatcgaaggtggagatgaattaatcttaagcgataaagtagtagcagttgggatttctcaacgaacaaatgcaaaagctttagaaaaattagcacgccatctattcgcaaaaaattcaggatttgaaaaagtattagcaatcaaaatcccgaacaaccgtgcaatgatgcatttggacaccgtattcacaatggtagaccatgacaaattcactatccatccagcaatccaaagtaaagacggtaagatggatgtctttacgatcgaaccagatggtgatgatatcaagatcactcattcagataacttacacgaaacgatgaaagctgctcttggattagatgatcttgtattgattccaactggtaatggggatgagatcgttgcccctagagaacaatggaatgacggatccaatacattggcaatcgctccaggtgtcgtagtcacttacaatcggaattacgtatcgaacgaattgcttcgtagctatggtatcaaagtgttggaaatcaattcaagtgaattgtcacgaggtcgtggcggtccacgttgcatgagtcaaccacttgtccgtgaagacttgaagtag

SEQ ID NO: 2495 - DNA (genomic), 825 bp, Enterococcus faecium; double-stranded, circular
  misc_feature (B) LOCATION 1...825
  hypothetical: NO
  anti-sense: NO
gaaaaaagaaggagaggatcacatatgtcggattggttggatattgcaggaaaagtagtaattgtaactggaggttcctcaggaattggaagaagtatcgtcgaaaatttgttgaagcagaatgcacaagtagcgaattttgatgtaactgaatgccgtatacagcatgaaaacctactatctttaaaagtcgatgtgtcttctaaaacggacatagaagaagggatatataaagtaatgaaacatttcaagacgatcgatggtctagtcaataatgcaggaataaatattccttctcttctaatagatagaaatcatccaaaaagcaagtatgaattatcagaacaagtttttgataagatgatcgctgtcaatcaaaaaagtgtatatttgatgagccaagcagttggaagaatcttggtgcaaaagggatcaggagtgatcgtgaatctttcttctgaatcaggattggaaggatcagaaggacagagctgttatgctgctacaaaagcagcgatgaacagttttactcgttcttgggcaaaagagttaggaaagaggaatgttcgtgtggtaggtgttgcaccagggatactggaagaaaccggtttgagaacacaagaatatgaagaagctctttcttatacgagaggtataagcgtcgaacagctgagaaacggttacagtcgaacaagtacgatccctctaggaaggagtggtaagctgcaagaagtggcggatctagtctgctattatctttcagaaagatcaagttatatcactggagtcacgactaatatttcaggaggtaaaacaagaggataa

SEQ ID NO: 2496 - DNA (genomic), 1047 bp, Enterococcus faecium; double-stranded, circular
  misc_feature (B) LOCATION 1...1047
  hypothetical: NO
  anti-sense: NO
aagcgaagaaggaggaaacaaatgaaaaagaaaattactattactgcgatgagcctgttaacggctctttttttattacccattaatacgtttgcttatactattaatgacgagtataatttagcgccgaatcaaggagactccagattagcaattcctaacaaaattattttgcacgaaactggaatagatgcaccagcaagaaacgtagccgccaacatgaaaaataattataacggaagcaattcttatactacagatgttattggtgacggtgggattgtttaccgtgtgggtgagcaaggatatgtttcgtggggagctggtaacgctaatccttatgcgcctgtacagattgaattacagcgcacatatgataaagcattgtttgaaaaaaactatcgagcttatattgaatatacaagagatagtgcaaaaaaatatggaattccattgactcttgatcaaggaacttctttatttacaaaaggaatcatttctcatttgtgggtgacaaattatgtttgggggaaccacacagatccatatggttacttatcgcaaatgggagttagcaaagaaaagcttgcttatgatttagctcatggatttaccgatgaaaatccaacaacttctgaaaacaagcctgtcattgatccaacacgagctggtgcagctaatcctacgctgacagatggaacaaatcacgcccacattgatcagtttggggaaatcgaaaacgcaaacttgcatgtggctggatggcacattgctaactataaatacgagtatattttcattatggactacaatactgggaaagaattagctcgagtaagagctgatggaatttatagaccagatgtaaaccaagcttataatacttctggaaatgttggttatcatgtatctttcaatatgcgtaattttcctagtaagaaagtctatgtaatgatgcgggcaacgaatgatccagagggaaacactaaaggcggtgcgcaagatttccatgacaaacgttggtatttaaatattcctaaacgataa

SEQ ID NO: 2497 - DNA (genomic), 1857 bp, Enterococcus faecium; double-stranded, circular
  misc_feature (B) LOCATION 1...1857
  hypothetical: NO
  anti-sense: NO
aaaagaagaagtttggtttattttaggggggaatgtagggtgtttgttttaacaagaagaagaaaaatcattactttgattttagtagacagcttgttattgattgctgcaaatagtgcagcggttaattttatggagccgtttgtagctataccaatagatcttattttaatctccagcgggttatcgattgttttttatctattatatggtagttttttcaaagtattcactcgaatcaatcgctacaccaatttaagagagatgattgcgatttttggttcgttatctgcaagtgcggcctcaagtatcatcgtattgcttttcataaataaacaatacagtttacgtttagtcatctttgcatacctactttcgctgttattgatcattggcagccgattgatctggcgtatctatatcgaaacaaaaaatatgaggtatctatcaacagattccgctaaaaataccttgatcgttggggccggcgaaggtggacgtattttatacaacagttttcttggatccaaaacggctcaagatatccatgtcgttggattcgtggatgatgatccgaataaaagaaatacctatctttcaggaaaaaaagtactggggtcattaaaagatataccggaattgatcgaaaaatatgacatccaaatggtaacgatcgctatcccttctttatcaagaaaaaaattacgaagagtcttcgagttagtcgaatctgctcatgtgaaagtcaatacgatgccttctatggaagaacttgcttcagggaaaatcagtgtatcaaaattaaaaaccatcgacgtagtggatttactgggaagagatgaggtagagttggatatcgaatccatcaaagaccagatcacaaacaaagtcattctggtcaccggtgcaggaggatcgatcggttcagaaatctgccggcaaatcacccagtttgaccctgcaaaactattacttctaggtcatggagagaactcgatttacttgattgaccgtgaattacgcacgcatcatcaaaagtgtcctacagaaatcgtaccgatcatcgcagatatccaagatcgtaagaaaatcaatgagatcatggaacaataccacccagatatcgtttaccatgcagccgctcataagcatgtaccattgatggaatataacccaaaagaagcagtcaaaaacaatattttcggtacaaaaaatgtagcagaagcagccaaagcagcaagagttaaaaacttcgtcatggtctcgacagataaagccaacaatccgccaaacgtcatgggttcaacaaaacgaatcgctgaaatgatcgtgactgggttgaatgaagaaggatgtacgaaattctcagctgtcagatttgggaatgtccttggttctcgcggtagtgtgattccagtattccgggaacaaattgctcaaggtggaccagtcactgtaacagactttcgtatgactcgatatttcatgacgattcctgaagcgagtcgtttagttattcaatctggcgcattagcaaaaggcggcgaaatctttattttagatatgagcgaaccagtgaagatcgtggatctagccaaaaatatgattcgattgagcggatatagcgaagacgagatcgaaatcattgaaacaggtatccgtccaggggaaaaactatatgaagaactattgttggataaggaaagaaacgatgaagcagtttacgagaagatctttgtgggaaacatcaaaggttactccatgcaaacagtgatggacttcgtcaatagcctgccgcaagacgacgaacaattggctaaagagatcgtcacttttgcaaatgcttcgaataagtag

SEQ ID NO: 2498 - DNA (genomic), 822 bp, Enterococcus faecium; double-stranded, circular
  misc_feature (B) LOCATION 1...822
  hypothetical: NO
  anti-sense: NO
gggagaagaagcaaaatgaaaaaatataactggaatgaaacaaatgtcttcaccatgccaaaagaaaaagaaatagcactatatacggatgatctacatgtctggtatggcgacaatgaagcaatcgaaggagtggatctggaatttgaaaaaaataagatcactgcactgattggtccttccggctgcggaaaatctacgtatcttcgttcgttgaatcgaatgaatgatgggatcgctaatacgaaaatcactgggaaaatcatgtatcaaggcgtagatattaatgcgcctcgagtggatgtatatgatatgcgcaaacggattggcatggttttgcaacgtcctaatccgttcagcaagtcgatttatgactatattacatttgctttgaaacagcacggcgaaaaaaacgataagaaattagatgaaatcgtggaaacaagcttgaaacaagctgccttgtgggaccaagtaaaagacagcttggacaaaagtgccttggctttatctggcgggcaacagcaacgtttatgtattgctcgtgcgatcgcgatgaaacctgatatcttgctgctagacgagccggcaagtgctttggaccctatttcgacaggaacggttgaagaaacacttgtaaacttgaaagaagactatacgatcatcatcgtgacgcataacatgcaacaagcagctcgtatcagcgactatactgcctttttctatttaggaaaagtaatggaatatgacaaaactaacaagatatttaccagaccaaaaattcaggcaaccgaagattatgtgtccggtcattttggttaa

SEQ ID NO: 2499 - DNA (genomic), 378 bp, Enterococcus faecium; double-stranded, circular
  misc_feature (B) LOCATION 1...378
  hypothetical: NO
  anti-sense: NO
caagtgagaagaaggaggtatgtccacatgtatgaagaaagcgaactaagctattttaaaggcgggttagcagttggaatcggtctaggattattgagcggggtagcttcaacgatttggtatcatcgcaaaaaagtattgtcagcagaccaagtacttgaaaatatcaagtcatcttttctaaaagaaggtgcaatcgaaggttcttggatctcttttgaaaaggaacctattaggaaattcgccgttcggtcgagtgcttatcggggaggtctttctcgaatagaagatggcgaaactgtttattatgaatttttagcagatgctcatacaggaaccgtattagaaatttcaagaaaaaaaggtgcaacagattaa

SEQ ID NO: 2500 - DNA (genomic), 870 bp, Enterococcus faecium; double-stranded, circular
  misc_feature (B) LOCATION 1...870
  hypothetical: NO
  anti-sense: NO
agccagagaagaaaagcgaaatggggaagaagcgtaaaaaaggcgaatctggtctttcagggaaaattgacacccgcacaatcccgaaaccctaagaaaaatgaattgtatttagtcgaaggggattctgctggcggatctgctaaacaaggaagagacagaaagttccaagcaattctacctttacgaggaaaagtcatcaataccgaaaaagctaaaatgcaagatatcttgaaaaatgaagaaatcaatacgatgatctatacgattggtgcaggagtcggtcctgagttttctatcgaagactgtaattacgacaaagtaatcatcatgaccgatgcggatacagacggcgcccatattcaagtattactgcttactttcttttatcgttatatgaaaccgctgattgaagctgggaaagtatatatcgcgttaccgcctttatataaagtatccaaaggacaaggaaagaagcaagtcattgaatatgcgtggacagatgacgaattggcagcaatgattaaaaaagtcggcaaaggatatatgctgcagcgatataaaggacttggagagatgaatgcggaacaattgtgggaaacaacgatggatccgacttcccgtacgttgatccgcgtccgtatcgatgatgctgcgcaagctgaacgtcgagtaaccacactgatgggtgacaaagtagaacctcgaagaaaatggatcgaaaatcacgtgcaatttacgctcgaagaagatggcagtatcttagataaaaaagaggatactgaaatctctccttcagtttctaatgatttattagatgaagaacgagcagataaaaatgaaaacaatcagttatttgaagtagaatag

SEQ ID NO: 2501 - DNA (genomic), 267 bp, Enterococcus faecium; double-stranded, circular
  misc_feature (B) LOCATION 1...267
  hypothetical: NO
  anti-sense: NO
gcgtggagaagcaagcaaatccctacgatcacaaaaaaaatgctgacccagcagttaagagagttagaacaagatgaaagtatccatcgaaaagcctataaccaagtcccgcctaaagtagagtactcgctcaccgaagaaggaaaatcattaagagagattctagtagcgttgtctgtttgggaagaagaacgtatcgaaaaacaaaaagcctcaagggaagaagacacgctactgcatacacatggtggctacctaaattattga

SEQ ID NO: 2502 - DNA (genomic), 483 bp, Enterococcus faecium; double-stranded, circular
  misc_feature (B) LOCATION 1...483
  hypothetical: NO
  anti-sense: NO
gatcatggaagtaattgtcaaggactacctctcaaatcatggagtgaatttatgagagtaatgggcttggatgtcggttctaagacagtaggtgttgctatcagtgacccctttggctggacagctcaaggagtagagatcattcggatcaatgaagcagaagaagagtttggctttgatcggttgaaggaattagtagcacaatatgaagtagaccggtttgtagttggattacctaaaaatatgaacaattccatcggaccaagggcagaagcttccatgtcatacggagaaaagatcaaagaactattctccttgccagttgattatcaagatgaacgattaaccactgttcaggcagaacgtatgctagtagagcaggcaaatacttcaagagccaaacgaaaaaaagtcatcgataaattagcagctgtgatgatcttacaaaattatttagacggctcaggtaagcaattattttaa

SEQ ID NO: 2503 - DNA (genomic), 294 bp, Enterococcus faecium; double-stranded, circular
  misc_feature (B) LOCATION 1...294
  hypothetical: NO
  anti-sense: NO
ttgccaggaagtggcatcaagcctaattcagcaccaaaacttgtaaaaggaaagacagaaccgacnataattcctaatgtantgataacaaacatggcaaatgttgcgttgctttggataaatggtactttcggtgtacgcagtgcatggagcactaaggtgtgtgttcatagtgaatcgaacaaacatcctgcatggaataatgcgatgaaaatcactcgctgtgaactatccaatgtatggaaacttcggcccactacagcaggacaaataacaaaatacatcaacaagtaa

SEQ ID NO: 2504 - DNA (genomic), 1257 bp, Enterococcus faecium; double-stranded, circular
  misc_feature (B) LOCATION 1...1257
  hypothetical: NO
  anti-sense: NO
aaaaaaggaagtcccttctgtagaatagagttaccacaacacattcacagaaaagaggacttccatatgaacgattttactacagaaattctaaagactctagcgaacaaaggcgatttgaatgaattattccgtgtccatttggaaaaagctgtcaatacgcttctcaaaacggagttaacggctttcctcgattacgaaaagtacgatcgcattggttttaacacgggtaattctcgtaacggctcctatgaccgtacggtcaagaccgagtacggggaacttcatctccagattccgcgcgaccgcaacggcgagttcaagcaacagactgttcctgcttatagacggacgaatgataccttagaggagaccgtcattcacctcttccgaaaaggtattaccatgtcggaaatcgcagacttgattgagaaaatgtatgggcatcactacacgccccaaaccatgtccaatatgactaaatcatttacggaagaagtcacttcatttaaggaacgtgagcttcatgaccgttatgccgctatttatatggacgcaacctatatccctttaaagcggaaaaccgtcgccaaggaagccattcatatcgcagttggcattcgcccggacggatcaaaggaagtattgagctatgcgattgcaccaactgaatcgatcacgatttgggaagagattttaatagacctccaggaacgtggcgtgaaaaacgtcctccttttcatcacggatggcttaaaggggatggcaggggccgtgcagcggttctaccccaaagcccgttttcaacgttgctgtgtgcacgtttcccgtaatatcagtcacaaagtgcgtgtcgatgatcgtaaggaaatctgtgatgattttaaaatggtgtatcaagcgtcatctaaaaaggcggcattggaagcacgtggtgcttttgcggaaaaatggaaaaccagttatccaaaaatggtggaatcgatcctttctaacgattacctgctcactttctatgatttcccattagccatacgcaagagtatttactctacgaacttgattgaatcctttaataagcaaatcaagaaatacagccaccgcaaggaacagttccaaaatgaagagtcgatggaacgtttcttagtctcgtcttttgatacttacaaccaaaaattcctaggtcgcagtcataaaggtttccaacaggccgaaggcgagctcgaacaaatgctgagtcaaccgatggagaattag

SEQ ID NO: 2505 - DNA (genomic), 1251 bp, Enterococcus faecium; double-stranded, circular
  misc_feature (B) LOCATION 1...1251
  hypothetical: NO
  anti-sense: NO
aaaaaaggaagtcccttctgtagaatagagttaccacaacacattcacagaaaagaggacttccatatgaacgattttactacagaaattctaaagactctagcgaacaaaggcgatttgaatgaattattccgtgtccatttggaaaaagcagtcaatacgcttctcaaaacggagttaacggctttcctagattacgaaaagtatgatcgcattggttttaacacgggtaattctcgtaacggctcctatgaccgtacggtcaagaccgagtatggggaacttcatctccagattccgcgcgaccgcaatggcgagttcaagcaacagactgttcctgcttatagacggacgaatgacacgttagaggagaccgtcattcacctcttccgaaaaggtattaccatgtcggaaatcgcagacttgattgagaaaatgtatgggcatcactacacgctccaaaccatgtccaacatgactaaagtgctgactgagactgaagaagtaaatgcatttaaagttagaactctaaatgataagtatgtcgctattttcatgaatgctacttatattcctttaaaacggcaaaccgtctccaaagaagcaatctatattgccattggtatacgagaagacggcactaaagaagtactaagttatgcgattgctccgactgaatcgacctacgtttggaatgagttgttacaggacatttactccagaggggttcatgatgtcttactgtttattaccgatggcttaaaaggcatgaaagatacgattcaccagatttatcctaaagctaaataccaacattgctgtgttcacgtttcccgtaatattgctcataaagtacgtgtcaaagatcgaaaagaaatctgtgatgattttaaggctgtttatcaagctagctcaaaggaagaggcaaatacctttttagggagtatgattgagaagtggcagaaaacttatcctaaagtgacgcagtcactgataaaaaatcaagatttattgactttttatgagtttccgcctggtatccgccgaagcatttactcaactaatttaatcgaatctttcaataaacaaatcaagaaatacagccgcagaaaagatcagtttcaaaatgaagaatcactagagcgtttcctagtatccatctttgatacatacaatcaaaaattcttaaatagaagccataaaggcttccaacaagtgacggatacattagcttcaatgtttactgagtaa

SEQ ID NO: 2506 - DNA (genomic), 1443 bp, Enterococcus faecium; double-stranded, circular
  misc_feature (B) LOCATION 1...1443
  hypothetical: NO
  anti-sense: NO
aaaagaggaagattcatgcaacaaagcaaaacgaaaattcctgcaaaaaaattaacgttctttggctttttggctatgaccatctcaatggtcgtttcattatatgaatatcccacattcgcgacctcaggcttcagcttagtatttttcttgttattaggcggtttgctatggtttatccctgtggcattgtgcgcagcagagatggcaacggtgaaaggatgggaaaaaggcggtgtctatacttgggtcagtcgcacattgggaaaacgattcggttttgccgcaatctttttccaatggtttgagataacagttggctacttgaccatgctgtatttcttaactggtgcattatcctatgcaacgggtattggtgctatacaaaacaataaatatctgaaattggcaatcctattgattattttctgggctattttactctcacagttaaaaggaaccaaatacacttcattgattgctcggatcggttttgtagctggtatcttgttgccagcattagtcttgtttggcttagggatccattatgtcgcttcaggcgctccactacaaacgatactgtctatgaaaacattgattcctgatttttcgaaattgcctacgctggttgtttttgtttcctttattttagcatatatgggcgtagaaacatctgccagtcatgcaaatgaaatggaaaaccctaaaaaggattatccattagcaatgtttgtattggttattctggcaatcattttagatacttttggcggattgaccgtcgctactacagtacctcaacatggtttgtctcttaatacaggggtgattcaatcgttagaattcctattaagacacattgatccaaatcttgcatggattgcgaaaattcttgcgattcttgtttgtttaggtgtcatcggagaaattgcttcttgggtaacctctccttcaaaagcacttcacgtagcagcagaagaaggattacttcctgaatattttgcaaaagaaaacacacacggtgttcctgctcatttgatgatcgcaaatgggatcgttgcaacaatctgggcagccgtctttacattaagcggcggggggaataatctttcatttcttgcagcgatgtcattgactgttgtaatctacctgatgttgtactttatgtttttcgcgggctatttgaagctggtttttaaagatgacagtcttgaaagagcctatcaggttccaggcggaaaagttgtaaaagtaatcgttgcttgtttaggtcttttgacttcactttttgctttttgtatctcatttgttccacctgctagtatcgcagctggacagcatgggatttatgaaacgattctgattgtttcttatcttatcgtcttagttattccatttacgatctacgcatgccgtcataaattccagcatgcagaaaaataa

SEQ ID NO: 2507 - DNA (genomic), 675 bp, Enterococcus faecium; double-stranded, circular
  misc_feature (B) LOCATION 1...675
  hypothetical: NO
  anti-sense: NO
atgcggggaagcacttatgaggcgattcaattattancaaaaatgatgcatgtagatggacatgtttatccttcttcagaaactcctttgaccttgcatgctgtttttaaagacggaacgactgcagtaggagaatctaaaatcgcgatcaaccgtaaaaccattgaccgtgtgtatgtctgcaacacaaatgataaaagtgaagccaaagcggctcgaaaagtcgtttcagcaattatggacgccgacatggtcgttttgggacccggaagtttattcaccagtatccttccaaatttagtgataccagaaatcggcgaagcaatgctcaagacaactgctgaaaccgtctatatctgtaatatcatgacccaaaaaggggaaacggaacatttcacagatgccgatcatatacgtgttttacacaagcatttgaatcagccttttatcgatacagtattggtcaatacggaaaaagtgcctgaagattatatggacccagagatctatgatgagtatctagtacaagtcgcacacgacttcaacggattgagaaatgaaggatgtcgagtgatttccaccgactttttagaattgaaagatggtggtgtcttccacgatggagacaaagtagtagaagaattgttccgtttagttttcggttcaaaatattaa

SEQ ID NO: 2508 - DNA (genomic), 306 bp, Enterococcus faecium; double-stranded, circular
  misc_feature (B) LOCATION 1...306
  hypothetical: NO
  anti-sense: NO
tccattttgagaattttgaggtgggaactgcagtttccgccattttatcgtgtgaaaatgcgaaacaagtacaaggaggtactgtgcgtggcaaaagaagatatgattgaagtcgaaggtacagtcgtcgaaactttgccgaatgcaatgtttaaagttgaactagaaaacggacaccaagttcttgctactgtttcaggtaaaattcgtatgcattacatccgtatcttacctggtgacaaagtaacggttgaattgtctccatacgatcttaaccgtggccgtattacttatcgctttaaataa

SEQ ID NO: 2509 - DNA (genomic), 339 bp, Enterococcus faecium; double-stranded, circular
  misc_feature (B) LOCATION 1...339
  hypothetical: NO
  anti-sense: NO
actctattgagaaaaacatatgatcgtaaatttaaactaaagatttcacaggatatccttgagaaaaaagtaactaccaagaaaattgctgaagaatacaatatctctcgtccaacaatttcccgatgggtttcagaatatcgtcgatacgggaaaaatgcttttgctggacaaggaaaaagattacctgataaagcagatttctacattcttgaacaggaaaataaacgactaaaagaggaagacgagtgttctacgaacacaaagatcgatacggatctccagggatcactcaaaaactttacgatgaaggaatcgaaatcaataaacgtgttgtag

SEQ ID NO: 2510 - DNA (genomic), 201 bp, Enterococcus faecium; double-stranded, circular
  misc_feature (B) LOCATION 1...201
  hypothetical: NO
  anti-sense: NO
ccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaa

SEQ ID NO: 2511 - DNA (genomic), 201 bp, Enterococcus faecium; double-stranded, circular; identical to SEQ ID NO: 2510
  misc_feature (B) LOCATION 1...201
  hypothetical: NO
  anti-sense: NO

SEQ ID NO: 2512 - DNA (genomic), 201 bp, Enterococcus faecium; double-stranded, circular; identical to SEQ ID NO: 2510
  misc_feature (B) LOCATION 1...201
  hypothetical: NO
  anti-sense: NO

SEQ ID NO: 2513 - DNA (genomic), 201 bp, Enterococcus faecium; double-stranded, circular; identical to SEQ ID NO: 2510
  misc_feature (B) LOCATION 1...201
  hypothetical: NO
  anti-sense: NO

SEQ ID NO: 2514 - DNA (genomic), 213 bp, Enterococcus faecium; double-stranded, circular
  misc_feature (B) LOCATION 1...213
  hypothetical: NO
  anti-sense: NO
aactggttgagtcatagaaaatgttacttggctaaacagagggaaaataaacactacaatcaacaaagtataaaaaaaagcccttctttttcattttttatcttccaatcacaaattgaaaaacttattcctgcaactttgagtctagtatcacaatcgactgactacaactattcatttacattctactttaagttcctccttaaccattaa

SEQ ID NO: 2515 - DNA (genomic), 462 bp, Enterococcus faecium; double-stranded, circular
  misc_feature (B) LOCATION 1...462
  hypothetical: NO
  anti-sense: NO
tccattctgagatcgcacctttttttcttgccagctattgaaaaagaactggtagaacacggggtctctttacgtgcggatgctcgtgcgttagaatatctagagacggctgctttagcagaagacacagattgggatactgaatatctagattatatccttgctgtcaaagtggtcgattctttggatgaagcaattgcacatatcaatcggcataatactaaacattcagaaacgatcgtgacagatagttatgcggctagtcaacgtttcttaaatgaagtggacgcggcggctgtctatgtcaatgcctccactcgttttacagacggatcggtatttggttttggtgcagagattggtatctctactcaaaagttgcatgcccgtggtccaatggggttaaatgaattaacttccacaaaatatatcatttatggcgatggacaaatccgcgaataa

SEQ ID NO: 2516 - DNA (genomic), 198 bp, Enterococcus faecium; double-stranded, circular
  misc_feature (B) LOCATION 1...198
  hypothetical: NO
  anti-sense: NO
aaaaccctgagtgggctatttattcatccggcgattgacgctactttttcgtttttatattggtacagcgatccttacaaccatgaccgtttcatggacccgggaacggattctgtaggcattgctttttctaaagaaaatatgttattcttattgcaagaagaaaacggagaaagtagtgatagcagtgatcgttaa

SEQ ID NO: 2517 - DNA (genomic), 1536 bp, Enterococcus faecium; double-stranded, circular
  misc_feature (B) LOCATION 1...1536
  hypothetical: NO
  anti-sense: NO
aagaacatgagctatttttccagccagaataccgtgtgccagatatggtgtggtcaaaggtggcgaatactgcctatgaagattgaagcattattagaaagaaaagagcagttacagatcctgattttgcgaaaccttgttctgcaagggggaacagcctctatcaatggtttgagagagcatgtccaactgtcaaaagcctcgtttgatcaatatttggaagatattgaattgattggccgaatgatggaaaaaaaagtagaagtacagcgaaatgagtatcaggcgctgcttgtgttggacgaagatgtaagtttggaaaaaattctattgtttttattgcaggaaagcttgaagtttaagatgctcgtctatttattagaacatcagcaagtatccatcgttcgattagcgacagcgtttaatatcagtgagtcttctgtttttcgaaagatcaaagaattgaaccagctcttagaggaatttggattacaaatcaaaaacggtcaattatacggagaagagctacagatacgatatttttattatgaactattccaatatatcccggaagatcagcgaccgctttttttgcaaaatacaccagaaaaaagaccgttcattctaggattggaccgtgtattagaaacaacgtttacggcatcagcagaagcacagattgcttgctggctcgggattacgaaaaaaagactattgaatgaaaaaagtacgtacgcaactttgaaagaaaagaaattactctatcagtcggaccggctttatcaagcaatcgatccaatcatcgtgatgcatcttagtcgaacagcagcagaactgaatgtatacgaaacaatgatgttttacagcttttttgtttctttttcgatagtagacgaagaaatattttatcagtatgatttgacacggagcaaaaagttaccaaccgctgttttagatacttacattcgggaaacgatgttatggcattatcgtcctcgtcgtttgaaaatcaaagaagaaaaggcagtaggctaccaaatttcccagatcaacaatgaatggtttttctttgttggaaagatcgaagtctatgagcgtgatcggcttttggaacagcagcagaaaatgctcgggcattccttaacacagttactggcgaaattacaggaaacagcggtgcagcaattgccgaggaaaagagctgaagatagtgagcttagttacctgatgatccagtatgccaatgttcttttgatgatcgatttttatattgcaaaaccagtagtgattggaatcgatttagaaagtctgccgatttatcgtattgcttttcaacaatatctgatcagagaactgaggggaatcggcggtattgagattggaagttatgaagaaggtaaagaatatgatttggtgatcacattttgccagagaaacaaaaaacagtgtgaatattatctgtcagaatttgcgtcaccttacgacattattcgattgaaaagaagaatagagacgctgaaaaaagaaaagaattga

SEQ ID NO: 2518 - DNA (genomic), 924 bp, Enterococcus faecium; double-stranded, circular
  misc_feature (B) LOCATION 1...924
  hypothetical: NO
  anti-sense: NO
aaccaaatgaggaatattctagatgtagaacaggttagaaaaagattagaaaaaggagtgattttgatggagaagagatacggcgtagttcctgtggtaactgcttcagacgaaaattatgctccttacttgagcgtgatgatcgcaactgcattagaaaattgcaataaaacaagacgcataaaattttatgtgattgacgatggtctatcagaatatagtaaagaaggattggaagaaacggtaaataaatattcaagtaatgcaagtatccaattcctgacagtggaaaaagatatctacgaagacttcctagtcagtgaccatatcacaactaccgcttacttaagaatttctttaccaaacttattagctaaagaggattataagaaagtcctttacttagattcagatgtgttagtactagacgatatcgtaaaactatatgatgagccgttaaatggaaaaacaatcggcgctattatcgatccaggccaagtgaaagctttggaaagattaggaatcgattccgatgacttgtacttcaattcaggagtgatggtgattgacattgatcaatggaataaaaaagaaattacagaaaaaactatccattacctcagtgaaaatggcgatcgaatcatctatcacgaccaagatgctttgaatgctgtactttatgaagattgggaacaacttcatccaaaatggaacatgcagacttcgctgatttttgaacgtcatccagcaccaaatgaaaaatatgaacgtcagtataaagaaggaaatgaaaaaccttcgatcgttcactttacaggacatgataaaccttggaatacgttgaaagatcatccgtataccaatttatacttaaaaaaattagcacacagtactctaacgaaagtaggcgagatcaatgaataa

SEQ ID NO: 2519 - DNA (genomic), 1158 bp, Enterococcus faecium; double-stranded, circular
  misc_feature (B) LOCATION 1...1158
  hypothetical: NO
  anti-sense: NO
acaaaaatgagagtagtgcatgttgaagatcgatttgagcctaatgccgggtatcaaataaatgaacttataaaagagcaagttaaactaggatatgatattgagataatcacttctactatccctattttttcgtcatatgaacagttaagaaaagatgatgaaatttattttaacaaatatggagtaaaaataataagaataaagccaatgtttattatttcttcacgttattattttaaagggctattcaaattaattgattcgaaaataccagatattgtttttttacatgggattgcagattttaaagacttggttctttttcaaaaaaggaagaattacttaatctttcgggattgtcatatgtcatggacagctagtcagaatcgctttagtcatatattcgccactcttttttcttatacttttgcaaagataatcaataataatcataagtataagaaaatttattctttgggtacagaagaagaacaatatctagaatatataggagtgaaaaaatcattgatcaaaaaaattcctcatgggtataattcgaatgaaatgtattattcaaaagaagcaagggataacctaagaaggttctataacatcggagaaaaagagtgtttgattggttatgtaggcaaattagattttgcaaaacggccagacttgctatttgatatttttgaaatgattgaagaagaagtaatgtcaaatgtaagtattttatttgttggtaattttgaagaaaaatacaaaaaaatattttataaaaagtatgaaacttttagatataaggaaaaatgtatttttatggtagctcaaaaatattcagaattatataaagtttacagtactttagatatttgcttttggccgagacagacaactttaagttctattcatgcgcaagtatgtcgcactctaccagttatggagttacatgaatctaataaagaacgcgtttataatgatagatatttatttgaaaaggaagatatggaaaaggcaagagaaaaactgctattagctataaaaacgtttcgagatgttgacttttcaagtatgcaagtttttttatctcaaagagattatataaaaacagtaaaaaaaattgattcagattggaagagataccttgctgaataa

SEQ ID NO: 2520 - DNA (genomic), 462 bp, Enterococcus faecium; double-stranded, circular
  misc_feature (B) LOCATION 1...462
  hypothetical: NO
  anti-sense: NO
tggaaaatgagtaagttgaatcctaagcaacaagcctttgctgatgagtacatcatcacaggcaatgcttatcagtcagcactgaaagctggctataaagaaaactacgctaagaacgcacaagaaaaattggtggaaaaaggtggaaaagtatccgactacattcaagagaagctaaaagaagttcaaactaagaggcatttaacaatggaagaagctttggctattactgcttctattgcaaaaggagaaccacaacgctttgaagttgttaagagagatccttatacaaacgaaatcatagaacgtgaagtgagtgaatattcagcaggtttcaaagaacgtaaccaagcacttgaacattattataaaataaacgcagcatttgtagataagcagaaagttgaaatttctgaaatacctactttcattgatgatataagtagtgatgatgatggctaa

(The sequence listing continues in the following parts.)

What is claimed is:

1. An isolated nucleic acid consisting of a nucleotide sequence encoding an *E. faecium* polypeptide selected from the group consisting of SEQ ID NO: 3857, SEQ ID NO: 4234, SEQ ID NO: 4304, SEQ ID NO: 4368, SEQ ID NO: 5256, SEQ ID NO: 5965, SEQ ID NO: 5985, SEQ ID NO: 6156, SEQ ID NO: 6320, and SEQ ID NO: 7224.

2. A recombinant expression vector comprising the nucleic acid of claim 1 operably linked to a transcription regulatory element.

3. A cell comprising a recombinant expression vector of claim 2.

4. A single-stranded probe comprising a nucleotide sequence of at least 40 sequential nucleotides selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570.

5. An isolated nucleic acid or the complement thereof consisting of at least 30 consecutive nucleotides of a sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570, wherein the isolated nucleic acid is hybridizable under conditions of high stringency to a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570; wherein the complement indicates full complementarity and of the same length.

6. An isolated nucleic acid selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570.

7. A recombinant expression vector comprising the nucleic acid of claim 6 operably linked to a transcription regulatory element.

8. A cell comprising a recombinant expression vector of claim 7.

9. An isolated nucleic acid consisting of a nucleotide sequence encoding an *E. faecium* polypeptide wherein said isolated nucleic acid consists of at least 40 sequential nucleotides selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570.

10. A recombinant expression vector comprising the nucleic acid of claim 9 operably linked to a transcription regulatory element.

11. A cell comprising a recombinant expression vector of claim 10.

12. A single-stranded probe consisting of a nucleotide sequence consisting of at least 40 sequential nucleotides selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, and SEQ ID NO: 3570.

13. An isolated nucleic acid or the complement thereof consisting of at least 20 consecutive nucleotides of a sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, and SEQ ID NO: 3570, wherein the isolated nucleic acid is hybridizable under conditions of high stringency to a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, and SEQ ID NO: 3570; wherein the complement indicates full complementarity and of the same length.

14. An isolated nucleic acid or the complement thereof consisting of at least 30 consecutive nucleotides of a sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570, wherein the isolated nucleic acid has at least 80% sequence identity with a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570 and complements thereof; wherein the complement or complements indicates full complementarity and of the same length.

15. An isolated nucleic acid or the complement thereof according to claim 14 wherein the isolated nucleic acid has at least 90% sequence identity with a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, SEQ ID NO: 3570 and complements thereof wherein; the complement or complements indicates full complementarity and of the same length.

16. An isolated nucleic acid or the complement thereof consisting of at least 30 consecutive nucleotides of a sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, and SEQ ID NO: 3570, wherein the isolated nucleic acid has at least 70% sequence identity with a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, SEQ ID NO: 3570 and complements thereof wherein the complement or complements indicates full complementarity and of the same length.

17. An isolated nucleic acid or the complement thereof consisting of at least 20 consecutive nucleotides of a sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, and SEQ ID NO: 3570, wherein the isolated nucleic acid has at least 90% sequence identity with a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2502, SEQ ID NO: 2666, SEQ ID NO: 3570 and complements thereof; wherein the complement or complements indicates full complementarity and of the same length.

18. An isolated nucleic acid consisting of a nucleotide sequence with at least 70% sequence identity to a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570 and wherein said isolated nucleic acid encodes an *E. faecium* polypeptide.

19. A recombinant expression vector comprising the nucleic acid of claim 18 operably linked to a transcription regulatory element.

20. A cell comprising a recombinant expression vector of claim 19.

21. An isolated nucleic acid consisting of a nucleotide sequence with at least 80% sequence identity to a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570 and wherein said isolated nucleic acid encodes an *E. faecium* polypeptide selected from the group consisting of SEQ ID NO: 3857, SEQ ID NO: 4234, SEQ ID NO: 4304, SEQ ID NO: 4368, SEQ ID NO: 5256, SEQ ID NO: 5965, SEQ ID NO: 5985, SEQ ID NO: 6156, SEQ ID NO: 6320, and SEQ ID NO: 7224, respectively.

22. A recombinant expression vector comprising the nucleic acid of claim 21 operably linked to a transcription regulatory element.

23. A cell comprising a recombinant expression vector of claim 22.

24. An isolated nucleic acid consisting of a nucleotide sequence with at least 90% sequence identity to a nucleotide sequence selected from the group consisting of SEQ ID NO: 203, SEQ ID NO: 580, SEQ ID NO: 650, SEQ ID NO: 714, SEQ ID NO: 1602, SEQ ID NO: 2311, SEQ ID NO: 2331, SEQ ID NO: 2502, SEQ ID NO: 2666, and SEQ ID NO: 3570 and wherein said isolated nucleic acid encodes an *E. faecium* polypeptide selected from the group consisting of SEQ ID NO: 3857, SEQ ID NO: 4234, SEQ ID NO: 4304, SEQ ID NO: 4368, SEQ ID NO: 5256, SEQ ID NO: 5965, SEQ ID NO: 5985, SEQ ID NO: 6156, SEQ ID NO: 6320, and SEQ ID NO: 7224, respectively.

25. A recombinant expression vector comprising the nucleic acid of claim 24 operably linked to a transcription regulatory element.

26. A cell comprising a recombinant expression vector of claim 25.

27. A single-stranded probe comprising a nucleotide sequence of at least 30 sequential nucleotides selected from the group consisting of SEQ ID NO: 1602 and SEQ ID NO: 2311.

28. An isolated nucleic acid consisting of a nucleotide sequence encoding an *E. faecium* polypeptide wherein said isolated nucleic acid consists of at least 30 sequential nucleotides selected from the group consisting of SEQ ID NO: 1602 and SEQ ID NO: 2311.

29. A recombinant expression vector comprising the nucleic acid of claim 28 operably linked to a transcription regulatory element.

30. A cell comprising a recombinant expression vector of claim 29.

31. An isolated nucleic acid consisting of a nucleic acid encoding an *E. faecium* polypeptide wherein said isolated nucleic acid consists of at least 20 sequential nucleotides selected from the group consisting of SEQ ID NO: 1602 and SEQ ID NO: 2311.

32. A recombinant expression vector comprising the nucleic acid of claim 31 operably linked to a transcription regulatory element.

33. A cell comprising a recombinant expression vector of claim 32.

34. A single-stranded probe consisting of a nucleotide sequence consisting of at least 20 sequential nucleotides selected from the group consisting of SEQ ID NO: 1602 and SEQ ID NO: 2311.

* * * * *